United States Patent 8,071,291 (GENETIC POLYMORPHISMS ASSOCIATED WITH VENOUS THROMBOSIS, METHODS OF DETECTION AND USES THEREOF) - sequence listing, part 4

SEQ ID NO: 490 - DNA, 1269362 bp, Homo sapiens
agtttatgaattgccagatattagaatgtccatgtgattgaatttatggctgaatagcaatcaaggcagatgcttattttgagtgtttatagcattgctaaacaatcctaattgccttccagatctggagttttgatctccttttgccacttcatgaattgaggggccacaacggctgtgtgcgctgctctgccttctctgtggacagtaccctgctggcaacgggagatgacaatggagaaatcagggtaggctgtttgctgacatgagagcactgctcttcttgtagcttgggctagcactgttcacagtggggacctttgttcacgggccagggaagcatagtcctgaagttgtggttggatgaggcattctttttgtttcttgtgcacattgtattcacagctgcactccactgcagaaacggattcattttagagttagagtgaagcattccctgtatatgtgaggaagcaagtgctctagtcatttgtagttcattctctgccattagcttgagaatgattcatcttaattcttggacttgaaccaaaggtttttggtagcagaatttgaggaaaataattttgtaaattatggtctggattataaatgaattgcaaattctgctttttctgtgctgaaagaaaagatctctttagcactatacccatttgatagccatttccagtgtggtttgttgcagtcctctgtggactgcctgcctgttaaacagtgcagaggttcacatttccgtcattgtggggcagcgaagggctcctaattgagtcacagtctgcatgctaggccagtttttattaccctgcagtgcttaagatatacatacaaaccatgccaattttatttagaaaacaatctattttttttagatatataattttgacttttagaaaacaatctttttaggaggcttagaatgttgttctctgtgtctgtggaaatatagtaccatatggaaagaattgcatgctgaaagattagaaattatggaaaaggagtcagttgacctagttgtgtcagaagaattggggagccgattggaaaagtttgggtattgggatgactactttggtaaccagtgtagatgaggaagatggggttttccccctttcattacaaaggaggatctaaaactccaggaacaggtatatagtgcagaagactaggagagtatacagtttgcaggaacagaggtgttatcagatgggctttccagggaaattaagattcttcttcttgaggactaagtaaccaaccttctctctaccagtcacataaatgtgtgtcagctgaagtggcagggctgctttggaaatgttcattttgctctgagttcgcgtctttggatgaaagtgctcctttcccagttatgaggcggtgtttcatttttcaaccactgcaggaaaaagttgtctccattaaaattgtgttattttaaaaatttttgttggtacattaaaaaaatttttttctccctgattattcagaatataggaaagttactgatttttgtttgtatatgtactaccttactgaactgtttctaatgagtttttccattcggttctcttggattttctagggagagatttacaaatgattgtttaattttcttttaccatttatgcctctgtttctttttcttattctggtgtacctttatttgaaaaattagagcactgcttatatattaaatgccactggaaataaatggcaatattagtatctgtgttagggttgtttataataaagtctagtaaaataattttagaatacatatatatggacatatatatgttttaaaaccagagaagcttctggataactctgttaatgaattgtgtatcatgtttatgtagatatggaatgtctcaaacggtgagcttcttcatttgtgtgctccgctttcagaagaaggagctgctacccatggaggctgggtgactgacctttgcttttctccagatggcaaaatgcttatctctgctggaggatatattaaggtaagagttccccaagaactgtgaaagaaaataatagcctatatcatactttccaagctattttcacttcctgtttctcagttgggccttttacaacccagcagagtaaaaaggctgctactccggaggctaaggtgggaggatcgctggagtctgtgaggtcaaggctgctttgagccatgcttgcgccacttcactccaccctgggtgacagagcgacatcctgtctcaaaaaaaaaaaaaaaaatctggcagtaaaatgagtttagtaactaaagaaaagaacagaaaaaaatattgaaaacaaaaaagaaccagaaaaaactttaaaaaataattaaaagccaggcacggtggctcacgcctgtaatcctagcactttgggaggccaaggtgggcggatcacctgaggtcaggagtttgagaccagcctggccaacatggcgaaaccctgtctctactaaaaatacaaaaaatagccgggcgtggtggcatatgcctgtaatcccagctacttgggaggctgaggcaggagaatcgcttgaacccgggaggtgaaggttgcagtgagccgagatcacaccattgcactgcagcctaggcaacaagagcaaaactctgtctcaaaaaagaaaataaataaataaataaattaattaattaattaattaaaaaaataaataaaaaggaaaagaaaaaaaaaggcagttactattatccccattttgtagtgatgaaactgagatccacaagactgctttcctcagatcttggggaagctttggtgacagtggcagggatgccctcaatccagagctgtcatactgcctcatactaaacttggggcattagaatgactagcaagttgggtgtttaacttagttctgttttccatgtcattcacaattaactatgttggttgaaaatctttaaaaaaacatatttttgaaatttcttcagtaataataatagcagcagtatatggctttatagtttacaaaacgcttcactcccctcatcttactagccagctttttgaggcttaaatttcattcttggtttacagatgaggaaaatgattttctatggaggttataactttcctaaagttacataattagtgccgggtgtggtgactcacacctgtaatcccagcactttgggaggccaaggcgggcagatcacttgaggtcagaagttgaagaccagcctggccaacatggcaaaacgccatctctgctaaaaaatacaaaaattagctgggttttgtggcgggcacctgtagtcccagctacttgggaggctgagaggtgagactcacttgaaccccgggggagcagaagttgcagtcagctaaggtcacaccactgtactccagcctgggcaacagagcgagactatctcaaaaacaaacaaacaaaaaaaccaaaaataaagttacataattagtaaatagaaaagccaggactcaaacccaggtctctgcctctgctttctctagctaattggctttttaaaacttactagtgattgaggccgcaatttgaatgtgttgtggtgcttcagggtcatatttttggtgtttttttgatgtatcttttatctatccactcaaaaagactgtgttgaatgtccagtgtgtgctaagctactgctctgtggcacaatgtttatggcttggttcctgcctttcagcagcttacagtctatgggggaagcaggtggtaaaccaataaagtccctaaagtttagaaggggtctgggacatgctttcatgagggaggtggaagcacaaaggagaggagtgaccagaccaacctcagagagttagcagaggcttcacctggaggggaatgcttgaagtgagtcttttgaatagcagtttacttgtaaaagtggtagaagatgatactctatatcagcggtccccagcctttttggcactagggactggtttccttggaagacaatttttccacagatggggtggtggtaggaagtggggagcggggaatggtttcaggattaaactgttccacctcagatcatcagcattagattctcgtaaggagtgcacaagctagatccctcgcatgtgcagttcacagcagggctcttgctcctgtgagaaactaatgccaccactgatctctcaggagacaaagctcaggtggtaatgttcactcaccagccgctcaccttctgctctgcggatgggttcctaaaaggccacagaccagtaccggtccatggcccagggactggggactcctctatattgggctgatcacttggacattctgaaagctttttcattcaaaattgattcctaataagatcttatgatactgttatttcttactgaaaacattcaagtgtaggagatgattctcattaattgtctaaggcaggataagtgtttggaaatatttgaatgactggtgttttggttacatgagacccacacagctgcaattttaccaccataagaatctagcttataaaaaagataaattagaggacagtttttagctttatgaaaggatgtactaaggggtacaaaaatacagataaacaaaaggagtaatttctagtatttgataatacagtagggaaattatagttaacaatttattgtatatttcaaaatagctagaagaattataatgttcccaacacaaagaaaagataaatatttgaggtggatatcccaattatcctaatttgatcattacacattgtatcacatgtacccccaaaatatgtacaacttaattatcaataaaaatttttttaaaaaagaaaggatgtatgttatccctttacaaggtttcattgaaaacacaattctgtttacaaaatgttgcattaacctacatctttattcagttattaggagatcctgagaaatgaccaccaattgttctcctttagtgtaaagataaactagaactcagtctgctctggggatgatgcttagaggagagtcattgctgtctgtgttggaagctggggagtcttcggctatattagctgctgacaaatttaactgctcagctttgacaccaagtttctagagaccacatcatttgattctctggcctccacagaattccatcacataattgagagtctggtttataagatgttacaaagatcagtgaccatatttgcagagttcttggggaaccttgaaataaagcagcagaataggtttacatagtatagatgttatgtctgaagggtgaaagaacttctagcctatgtatttagtttgtatatttaaatgacaatcaggctgcctttgccttctggtttgattactagcttattcaactgattatgatatagcccagcctgcatctacccagcatgttaatgagactatccaaaagcacagagcaaattaaaagtaaaaaggaacagctgctgtagtgtccaagaaaataggccttttgagcctgtttactttagaatccaagctgtataaattgagtgccagtaagataaagtaggtatccagaagcttaaaaagttcttaacttccaaattattcctatttataagtgaaaaaataatttagctgtttacctgcattatgccacagagtacatactgaatgacaagaaattcacattaattcatgtgcatgaagggaaagctgatctgaagtatggaatacatggtgataaatggtggtgtgccatgacttggtggcagcagagtgtaatggtcaggagagtgggcttttggccttgagataggctgcctgagttcaaagcctgcctctgccactcattagctttgtgaccttgcacaagattgtttaacttctgtgccttgattttcttatctgtaaattgatgtaatgataatacctaactcatttcacagatttcccatatacccctttcccccacaaacacatagcctcttccattatgaacatccccccaccagagatgtgcatttgttacaattgatggatccacattgacacatcattatcacccacagtccgtaattagggtttgttcttggtgctgtacatttttcgggtagttgaactaagtgatctctaagagccttagtgactgaaaacaaatgaatctcaggttggtggaatgtgcttgattacactgttattttacaaagcaaacttgtgagttctggaaaatcccaagttagtgcatgctggttcagtgaggtttaccaaagtccattgggtatacttttagcagttactattactaatagtgaacatgcttacttgacccactcacatgggaaagacaaaatgctaggtactgccataggcacaaaggtgggtgacactattactgtgttcataatactcaggatcatggtgagcttgaggccttttcagaataagtttacatgtattgtctcttgcccccattttagctgtgagattcatgggtaaactttatgattcccatttgttaaatgaatataaatattataagcaaattcagtgattgggaaggaaaggaaggacttggctacagcccttgctacgtttgagatgttcagtatttgtttagtaaataaataatatagattattttataaagaaacttggtcaagggctcttgcatcacacctggggaaagggaagattcagtagagagaacattgtttcctgtagcccatattatgaatagtttgggtctctgtcagaataccagtctgtgtctgcaaaggggcatttgagtgaagagagggggaatcttctgcccattctcccgagaaggacatgcagacaagagagttgagtctggccactgctgtaatggactctatagcttcctgtctgcagctctcaagcaggctgcatgtttctccagcacaactcaacggttggagttgggtgtaggcggagcagtgaggccatcaccagtgttcatcaggaagaggctgaccaggttgaatagtatattcagcattaaatccgagacattttcctcctgtttgcttgagttcggttggggggaggagatagggtaaaggatctgctggcactataaattgtcacacagtgtaattaccaatctaatgagaattttatttttctctgaacagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacatttttggattgtttcattctttgcttgtcatttatctgttgattagaccactaaagtgaaggattcaagctaaatacatcaacctttctatttaggctttatcagctatatgtaaattcaattctatcaaaattttctgagtgcctcctcagtgtgtctctctgatggttcctgcccggtatggctggcatgaagaagatcctgtaaaaaagagaattcatttatttattcacttagtttgttcatgcatttgtttaataaatattgagatgtaccatgtgcctggcattgtggtaggtattgggaacacaggagtgagcaaaacaaaagtcttgctctactgcagttaagggccagggagaggcagaaaaagtaaataagtaaaatctatagtgaatttggtggtatgtacaagcggaggggaaggggttacggttttagatggactggctctttcagaagctgacacttgtacagacctgaaagatgtgaggaagtgagctatgcatctgtcgggaaaccattctgaaggatacagcaggtgcagactccagtgggatggttggtgtattctgggagcagccagacggcccatgtggctggagaagggtgagtgtgaggagtctaacaggagaggcagagaggaattggggtagcaccggaggctgcctcttaggccacagtaaggacttcacttttgactctgggagccagtgtaggagttttgagcagtggtctgatttaagctttaacgaatcacccaggcagtgggaatcaactgaaaggggaaccagtgagaagcttttgtaatcatccggacaaaatgaaggtgggccagactagggtggcagcagcagagcttgtgacaagttggattctggacatattttgaagataagagttaataggatttgctgatggattggataaaggttgtgagagagacaagaaaagaatgatgcaaggttttagcctgagcaactggaagaagagagttgccgtcagctgagatgaagacaatgaaagcagctttgcggacgcggtaagtttgagatgcccgttaacgagacatccaggtggggatgctgagtaggcgggatgcaaggctctggagttcatgggaaagctccaccaggaggtagaaatctgagagtcatcagtgaattgatggtatttaaaatcagaggagtagatgaaatcagcagtgaagtgggtgtagatagaaaagacagggggccccaagactgagtccagggcagtctggagatcagtgggatgagggataagcccaggagactaaaaaggaccagcagagactaagagttgcaaattagtgtggtaagtacagtgaatgcagcaggcatgggccccttaacgtcttcttgtctgtagtccttgatcagtctgctcattcacccacctatctatcctgtactccttgagcatctgcatgccaagcactgttttaagcagcagaggaagcaataagtaaatacatttgagttgttgagagatcatggggacaacagatgataagaaaacaggacagtatcagcagttgtcttatctgaaaaatgaggatccgttcctccctccagattgttgtaggatttaatgagataaagctcctgaagcacttatctcattgcctgcactaagagaccgctcaggggacattctgcaatgccatttgagctccctcctctttgcctggcaacagccccagctgccatctctgcctccagttgtgcccttctgcatgatctttccagagcactcatctgaatcacattaaacttctctgtttaaactttgtgtttacacttctgtttaaaccctggacctgctccaagttctcttctgtagctttgtgtacactgttttctctatgctgtcctctcaccgattttcttttccccgctaactccctatgtttcacaaattctttaagatgaccctcaagagctgaagggctgccctgccctctcctagcattctcttttctctgtcatggcttttgttgttttggaattgcttgcttattgaggtccccagtaaatcgtaagctccttgaaagccaggactgtatagagtctaacatgagcctagcattgcaatgagggcctcagtaaacacttgttggatgactggaattcatctcctgagttccatgggatgaatttgcccacgtgttcataacacagtctatgttcttcctttccataaggatatcatgaggctgtcaaatgaagatgtagcatatcaccagcattttatcttgccgttttagtttggcctttttctgtgaaacatcattaggggaaagtaaaactttacttggacaaaagaggtttgctaccaaattatataaaatgaataaacatatccctggagtgtttaagtcagcaagtatggccatctattattccacagacattttatattataatttactcactgaactttaacgaaggagaaaatgattttctaataattcttagtctttgaagattgtcactggaatacattccttgctcataaccactccccttgggaccgtggatatactatacagttattaaaatgcctgaattagaaaatctgctgctcttgggctatgagtttaactatagaagaattactgtatatgctcacacgagaggggcagaagaagggggtcacatttgagacgtagcagagaccaggcctttgaagtcctctggcatcaacaatgacttgctcctgagtcaaatgatgtgagaaaaccagaatttgggaaattttcatttcaattaagattcaggaaaatgagtcactggtgttctttgtaaattcatttatgaggtcaggcccccagaactgggaatgctccttatcacatagaaatgaatagaaaaatctgcctctgtaatttccatcacccagggctagaatatgtaactagagagggtggtcgaggcctgagtttgggtctgggggttcagagcaaccgatcaaactggaaaactgagcaggtgagtggagactcctgctgttctgaggagcacacgttcgcattcattcaaatgtttatcgccgctccactcgaggcactgcccaactctcatttatcttcacagaagttgagtggatctgcagactgcagcttcagtttttagatagaggaagaactaaaccccagcagctaatcggtgacaaagccagggctagaatccaaatctgctattctttatagatagaaaggccaagactcttaggcttgtaagtcacctgtcagtcacaactggaagtagaatactcctgggttcagtggcagatgacatcagcctaggggtcataaggcttggtttcactagctggggaaagtcatccaatagcttacgtgatggttttggagatgttcttatattcaccttcaattagcagtgagcccttcactaagcccttcatcttgggcttattgccctacttgctgtcaattaacctctggagacacaccaagtcttttagaaggaaggaagggagctactattttttgagggccttttatgtgccaagcccacaggctgggcattttccatacgttatttaactgaatcataacagtgctgcaaggtgttatctctttcataggtgtgcaaacagatgcagagaggttaggtttccagggccccacagccaagtggtggagctgggtttctggtccacggccttctgtctccactgggtgacactccctgtaccttctcattgaagcccctgggctagagggtccaagagcatcacttcagttctgcatttcattcgttactcacttgcatcaggacagatgcatcactactaagctctcggagaaggcatcagatgctgtctgctcccaaggagcttctacttttggtagtctgcttaacttgtatctgtgcctgtagagattgctctttgaaaaaagcagcaggaacattctgatagaagccaatggatgggacaggtggggggaatgcgttggatttgccagcacctggccactgcccaacctgctctcaattctcagatgattcaggtattgagcaaggaaggtagcagagctactgttgccttccctttggggaagcctgtttctactttgaaactcttaagggattcatttcaaattagtggcaggccttggttagtggatctgtgtgctgtcttctgccatcttgattgcatctccccccttctccttttcctttcatttgaaaaaagatgcagcccctcagagcctcactttcctgatttgtcaaatagggaacctaatgtacaaggcttttgtggggcttagaaaaaacatgtcaagaatctgatatagatctcaataaacagcataatacttatctttcgtcccagttacaaacccccattcctgtactgcccaaatctccatgattcacaaattgcgaccctgctgcttctgctccatggcagacacctagctccaggcaccctcctctaccacctccttctccttatggccattggcttttaggagacagacattgcttacttagcaggaaagctgtcacctgctttcttttgaactatcccgaacttgattctctttgggcgacgcatacacccatcaagtggtaaagaagactgggaatgaggggagaaaagaccctgggcttgttgctggggccagtagcttgggagtgtggtggtatgtgtgtggctttggctgtcaagtggatctaagttcaaccctggctacactgactttccagctgtgtgacttcagcaaatgggttaatctcctcaaggattcacttcctagggaggctttaaatgtccccgggtgattccagtgtgcagtggaggttgagagccagcgccctctactctcacccttgatgcccaaccaactcattgccagtctcctcctttagcacagcccatgatgctgcgatgtctgccaatgcagcatgcccctttgtgcctgctctgcccataacattctcaggagcttgctggacagcacagatgtttggtgtgcatattaacccagctgtggggatctttcctgctcaggtttggtggctaatttatagagcagctctgtcaggatgatcaccaatccctcttacaggcactgctttctctgttcaagtgtctcacatgtgtgtgcttgtgtttgccttttagctattactgtgatgattcccaatgtagtagacactgccagtgaccaccgcaatatccaatctcccccttttcctcactaacaacccctgcattgttgggggctgcagtgtgctcagctaaaactaacaattgcagccacattttccatcctcctacataggggtggccaataagctgtatgcagaagttgtggggtggagcttccaggaaagctcttaaaagtctgccttattcagctggacaatgcttccatcctatggtccttaccatcttttctaatgcctggaatatgtgtgtgctggaggatgctccagcagccattttgtgacaatgaggcaatcttgaggctaaaagccacttccaaaggatggcagagtagaaatatagaaggatcttgagatttcaatgatatcataaagctacaattccagctctgtactgcctatctctgaagttcatgttacatgagggaaaattcaacccctgcctcgtttaagacattgttattgctggtctttgctactagttctttagttcaattcctaactgatacttcccaaaacaaacctggtgaataacagcaattcaacaaatgtcaccgacccctgaatctctgcctcctccacccactcaccccagctacaaacactctttctttctcctgatgagtaaccgggcatctagctgtaaggttgctgaagctttgtggaatctcagaaagtcataaagctactgaacaagttcacaaacaagtgatgcatagaccacacccagcccacagatgagttctgtgtggctcacacttattttttaaaactgggtttgctgccaacacttcaaaacccaacgattttgcgtgaaaatccagatttcttagaaaatctgtggacccagggtcttcctttctgcctggcaacaatcagctggaactcagcagtggttgcccctgagatgaggcacagccccatccccctcactcatgtcacctgtatggcttggaaggcatgtgagtttgcaacctgctcaaacccacaccccagaaacggcccgctaaaatgggatttcagaatccacttgtacctttcttctttctcagtctcccctgactcaacacagcacactggcattgtttttttcctctcagacaactcagcatgcacttttgagaatcagagagaaatccgcctctcaaatgtcagaaaacagctgatgctgcctcttacttgggggccttttgacttcccacgtgtcttactgccacttgagagggagggctgcaggcaggcaggctccctggggagcagctgttgggatgcttgattgaggccctgagacagccagaggacaattaaattgggtattgaatatgaattgctttgaatggtttttattaccacattgtgagctgactttggttgtaaaatctgactccatctcttgctcttactgtggtgatgagacagaacttcaagatgtcttaaatagcagggcttggaacatgcatattagctcatctgtactcgtgaagtctgtcatctgatacccgcgctcctccactgtctgaaccaagttaggagccctgattaaacctccgcggctgcagtcgccaccttccgccggggtgaccccattggagatgacaaatgaaggatgtcttatttcagcctgatgtgtaagtcttcacagcactggtcgttaactactcttggaaagttaaatgcccatgcagctttttttttttttttccccaaacaaacataggtctctgaggttttggagagaaaaacaaaaactgttttaataataatttgtagctatgctttttgatgagttgcacactgagtgcaatatgttggctgcagaatgaccatctttgcagaagcaactctaaggaaagtgatgccacgctaagcacagagtgagttctcaataagtagaccgacttgagcggaagacagaaacagttaagtggagttggcatttccctggttggcaccaaggtctcagggttatttcgaccacaaaattaagttccagctcctagctactaacagagtcacaatatgcagcatggtgatggtcaaaaggcctgagcaagttcaaagcgccgtctctgccggctttggaaccggtttctgtgggaagcaggactctgttgctggggcaggcagatgcttgtgtccatttgcctagaggcagtaaatgtggggctggctggctggctgttggggagctaggactggaatatggggtgggccagtgggccttgctgcatgtagactctgtgctggctgtgttggctagttagttacccaactttatttcaaaaaatgtgtttcgaaccttcagatcgactagcctatctaaaaagagaacttagaaagttattttttttaaaaaaagtcttcttcctacggatttcctgaacatggccattatattctaattctcttgaggctagatcacttatcaaattttcatttcttttcagaagtaattaggagtgatgctaccttgaatccaggtgtgaatttttattgatttttgaggatttggccacgtgttcctttatccaagcctgtcttctgctccatcttatccaaacaaacattgaaccagcaatattcccaagtattccaacttgagaaaaatcttgtgtgtcttgagaaaaatcatttccatgacttattaatgaactaactagggataattttcatagggttcgttaactcagatttatcatagaatacaatttaataagaaacaattaaatggagtaattgaattcaagtccttttttgagtaatgatgttagcattcaatgaccccccctgcccatggttattgaagttatcaatgtatcaattttccccttgaagaaaatcagctgcaaatctcttcgtcaatgcatgggccgcctctcatctgccccctgcaggcctagcccttccttttcccgtccctgctctggtctatggggctgctgtgtgtatagaaaaaaatgaaaggactgatgaccatgtagataatgtttttccaaacataccatcgaggctgtgctacaaaagtgatccagtttggtggtcctttctcttttagagatgcctgttttgacaattcctccttacagtctgctttaatatttaaaagaaggcagtgggggctttaggttaaaattaaagtttcagaggcctgtgtatctttctcagactggttgaacttggaactgtgcaacttttctcaacaattttgccaattaaaaaagtccctttagctgtagatgctgagaaggctgggcctttggttctgctcctaaatgggagtggggaaggtgctcacagaacgatgccaagcaccactgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccggtggccctctcctgtgggacttgcgttccagctgttctcagagcgggtatgatcggcctccagtagacttggagggtcacgggtgagattttgataaggttcaaatactcctcactcctgcctccggtttccaccaaagttaccattgtactactaccaacagttgtggaaatttactttggcaaaggttttgtgtttttgtttgtttgtttttccccccaaaaattatgccaattaaatccgaccttaaatgacaaggcttttctctcatgtttaaaatcccatttttttccccttgccataaataaataaaaataacttgtggcttacaggctgcttaataccacaacattttaatgagcatgtcaggtaacccacaggcttcagttctttgttgcttacaagttccatccgtaagtgtgagttgctcacttagtctggggtaacaaccgcagattcccacagagaagaatcagtgtcttaaaacaaggtaataccaacccaatggtctatgaataggttggaatggcggtactttaagtaaaagtataaagaaatggttaacattatgaggaacttccagcagtactaataatcaaccctgttgttcaggagacattcacttgctaaactttaaggctaggcatttactgccttgaaagcaaagcaaatgaagattttgaccaactgcaacattcaggctctaaaatagaaatatgaatgaattattaaataataggtaacatttactgagcacttacgattttccaggcatctgtgcattatctcatttaattcttacaactctatgaaggtttcattatattatcctcactttacagattaaaaaaaaggcttagatctgcaactggtagttttggaagaacattcttttccttaaacaggaaactctaaatgccctctgttttgtccacctttgtgccactgtctgcttctgtgagggtcaggataatagtatacctgaaaccgcccttttagcaagcggcagggccaggacataagctcagactagatgtctaattcacttgctatacatgtaacatgtaaaataaaaaagacctgcatcttgactggtgtactctttgataaatgggacctgattacttgatggaggcatgtttgactatctttgtttatgacattagcaaactttcaatgggtttggaagtgaggctatttagttctgtgtcttactctgcaatccagacacctgtgacttgaggtaaagtaagtgttttcttggtttcccaatcatgagagtgaccgaagaatgacattttccaggtcatcattctcttgtggatattgttctctgataacaatattgggcaatctcaaagagctgtcatttcttggcagtgaactacaggctatttggaaaggaggtgtaaatcactttttcatcatgtccagtcctctgcactctagagtcatttgggatgttttgtgtctgcactacctctagagaatgatggaaatctaattctctgtcagcttttctacctggctagtgaaaatgcttcttgggagagctgggaggggaagtcgctgtccatggtggtcgttactgaagccccattcagcaaaatcggttcatactctaaatactggaatcctgcttaattaaactaaggagcttctgcacagcaaaataataaacagagtaaacagacaaccttcagaatgggagaaaatatttgctagctatgcatctgaaaaaggactaatatccataatcgataaggaactccaatcaacaagaaaaaaaaaagcattaaaaaccgggcaaaggacatgagcagacatttctcaaacgaagacatacaagtggccaacaaacacatgaaaaatgctcaccattgctaatcatcagagaaatggaaattaacagcacaatgagatagtctcacaccagtcagaatgactattattaaaaagtcaaaaaataacagatgttggtgaggttgccgagaaaagggaatgcttatacacaattggtgggaatgtaaattagcacaacccctgtggaaaatagtatagggatttctcaaagagctataaacagaactaccattcgacccagcaatcccaatactgggtatctactcaaaggaaaataaattgttatatcaagaagacacctgcacttgtatgtttattgcagcactattcacagtagaaaagatatggaatcaacctgtgtctatcagtgaatgcttgggtaaagaaaatgtaaatatacaccatgggatactatgcagccataaaaaagaatgaaatcatgtcttttgcagcaacacggatggagcttgaagccattatcctaagtgaaataaaaccagaaaatcagtaccacatgttctcatttacaagtgggaactaaacaataggtacaaatggacatacagagggaaacagtagacactgggaactccaaaagcagggaggatgggaggggactgaaactgaaaaattacctattaggtataatgtccactctttgggggatgagtacactagaaacccaacctcaccgttatacaacatatccatgtaacaaacctgcatctataaaaataaaaataaaaaataaacagctgttaattttgcaaaataagtaaatattacagtctggaaattaacttcatcatggcactaatgaaatttggtgatattctccagtactgtatattaaaacataaagatcttatcagtataatctactggttggagtaaaaacattaaataattcacaggagaatgactttttactctatggcactaaaatagcccctattcattgtcaaattttagatatttttaggtaccagaacagcataaaggggataaatcatttcctgaaaccctctcaccttacagcaaagaaaatagctacctatagaggttaaccaccataattagaagcaggcgtaaaaccatgaattcttgccacagaatcacttatcatgattctgtgatgcaccaggatattgaatgtcagaatcattctttcttcagtaatttcatttttttgcttaaaaacaatttccaatttatgtcatttgaaaaacagataatatatagtctgatgtaatatgtagctcatgttcatttatgtggagtgtatctaaatcttataatattctagctgtattaagtaatattgtttcctgcaaagtgagacagtagaaaaaactcttatggtaccaatttctgaccactgtaacccagtgaaaagcaaagcattaatttcattacaggtcatcaagaatgcaaccgtcaacataaactgcttatttaagagcagccattttctatcagaaaggactaatattaaaattccccactttcctatattctccctttgtattaaaaaattatccaggggaccatgttgaatattccagtctcaaaaatccaaagatggtggtaatttttctaagagatatgtaaggccctttgtaagatttagaggaataggattttaagagtttattcatttgtttagtagtagtataatgcaatagttaatctcctgactttggaataagacctgtggattcaagtcatgggtatttaacttaattgttttgtgatcttgagtaagttacttttttgagccatgctgttctaatttgtgatatgaatgtgataataatgtaagctacttcacaagagttgtggttggaaataaattagattaccaatatgtagtacttttcactaagtaccacactacttttcactaagtaccacacattggtaatatcatttggccaggttaaagtttccatttactcaatcaaagactaatctaggtgtttctgtgaaggtattttgtagatgcaattaaagtctatagtcagttgactttaactaaaggagattatcttagataatgtcattcaactagttgaaagtccttaagagcggcttccctgaagaagaaattccacctgtggacggcagtttcggctcatccacaagagttttcacctgcccttcctaatggcttgccttagctcagtcttgtccagccagtctccacaatcatgtaagccaattccttgcaataaatctttttgtatatgtctcctactggttctgcttctctgactgaaccccaactaacacaccatgtaaagcattaactatagtatctgtgacataataaacactccaaaatattagttaattttttaaattaacccttattgaacatctctcacatttatagcactgaggtatacactctgataaaaatgtctgagagctctgaaatagaatagggatagatagatacttattgtctccaatgatagtaacctcaaccaggaagggatttaatgttttagtaaaatttccaggaaaacaagggaaaagtgccaatgggttgattattccatctggagctatgtaggggaattatgcaaattcagtatgaggccagtttcctgggttaggaagacaatgaacaaaaaggcagttactgttttctcaacagatccatatagatgtagcacctgaaactagacacaccagtttccatggatcaaccatggaattccattctgtaagaaaaatttatttacgacttggtcttaagccaattggaattatatacttgataactgccttgagattcttggaggaagaaatacgctcatatttaagagtattaaagtaaaagatctttcttatttcaatgttagcttatcttagtattctacattgttagatctttgaatttgttttgtgcatttttaagcaaggaaaaaatacttatatcactaaaaagcaggcatagcacaaacctacttaaatagaatctgcctccgtccttcagaattataatgccaaacttacaaaacttaaggctggaaatatctcagatgagtaaacaaacctcagggaggtagtctcagatataaataggattaaaaggtgatgagaaagtaagagagagtgagagcatgccttttggttttatattaaagctctgataatttagagtgaatcttagaaatagaaatgttttaaattgtgtgtttgcaggtgtgtatgtgtgtattcactaaagacagctgtcccatgatcctttatgccataatagtaattttctcaaaggcagtgctattgctgtaaaaatacttttactcattatgcaaagatttattgaatacctgtgatgtcatatgtcgagctggttgctaagggataggaaagtaaattagagatggactctaatcttgtggaactctctctgggcaactctaatttatccttatggatttcaactaacacgtgactttctctaggaaatttttgtacttcccttgctctgcactggcctaggcagttctcttttgctctcacagtaactttgcttccactaatattgcatttatcattttttttagtaattagtcaattgcttataaatctccctataagactgcatgaggtcaaggaccttgtttatgtgaacctctatttttgctcggctcttgtcctcaaataggcattaggtaaatatttacagaacgagtgaaagaaagcttgggacatgttgaattttaattgctttccaaatagaaatatgcaggaagcagaaaatatataaacctggagctgaggacagagatgggtgcaagggatacaaatttgtattagctgattcctggtagttggaaggcctgggtggattatcttcaatgaggctcacatgtagaattatgaacgagaaagtctgaggtcaggactctggacagcgtccacactctccattttatctgtgggatgaaacatggcccacatggctaggatggaaatgttttgggaaacccaaagcccaaataaatcttttcaaccatgtgagtaagtttctaatagatatttcagaactaagttactgtagagacaggagcactataaatatggatttataatcatgacattgtggaactttacctcccaatatgtagagagcagggttttcaatttcgcaaaataaataaatgaataaatgttagcatatgttaatagagggcacaaaatagaagtcagagagagaaagagtgtctgtggggactcaacagactctgtgggaatcagactctctgattttctctctcaatggaatcaaggagtcccacgagttaggcattgggaaaggctctctgggtggtgaacagacatgtgtggctattggtggtgaatgtccaccacagaagcagcgtggctcttccttatactcaaggcttttttttgccattaatgagaagtaagacacagactgactcccagcacttaccaattttattattcttattgcctcctcatactttgccatgggaaaatccctgtttggatcacaaatttaaaacaatagactgcctgttaaccatgggcatatttacagatctgactatgagctaatacaacccagagtgagcagaagggacttatactttttcctgaaggcaagcaggcttggaatccaaggggaatgaatataaacactgagacccatctgccccagtcttctgaattaaaacctagggacttcttttgttaactctgttcaaggcccaaaccacatacagctccattgagccacagctaagatttttgcttgcagcctttgcttagaactggcccctgagagtcagtttcatctgtacagcacagttggtaagtacctcatccttcccacacctttaagcaacagaacagccacagtcaacacttacagcaactttcaaggttagcaatgaaagaagaaggctgcagtaacctcatctggatgcctgttttactaagtaattatacatcccaaatttcacaggacaaccttctttaaatgaatcagatcataaaatctgatttttcacttaggaaaatatggttaaatcatattagagactcatacttggagtcttcaaggaggtagcataatatacagaaaaaaagtccatggactccgaccgtggttcaagttcagctctatcatatttactggttgtagaccctgagcaacttgcttaacctgactgcacctcagtttctgcatctgtaaaatgaggataagtgttctttaaagatgttgtttaaggattaaatataagtacactcatataaaaatctagcacaatgcctggaccacaataattattcaaccagagaatcaagttcaccctagtacaaattcataagcattcagaatcaagaagttattccagcttatcaacagaactaaataataaagctcattcccacagcaccttctagtgtgcttatcagctgtgtaagtgaggaggagcccatgaacttgggaggggacagtaactttttatattgtagactcataaaaatgattttatttttttctctacaggatttttagaggacaaaatagtctctcatttgatggtgattatgtacattattatgataattctctaggaatgcacattaaggattttgaaatatattagaaggacaaaggaagaaagaatgacataataaatattaaaacataatttggggttgggataattgaatcttaggataaaatatggctgatggccattgttttttcctgctcaacacccggtgctctatttctgttaccaatagtctgatttgttactggggacccaactctcccacacttagctatgaaatcctagataatcaaccttaaaagagctggccatggagtggacccatgagccactggccaagcagaagattccatcatgcagccacagtggtttgttcagagacggtcagaaccaagactgttggaactactgggaaaaaggggaactcttctcactggggcttctgatgatgagcttggtattaccagggtgccaggtgtaatgcctggagctgccaagggccatcttgtggagagggtctacccaagagtgaagccagcgcagagaaaagcagagcagagatatggattggagtccagtgatagtttttgaggctctggatccagtcatgcctgaaacctttggactttatctcttatatgagccaataaatttttcattttacttcagccacttggagttggatttttggcagttgtaactgtaaagtgtcctgatttcttcagcagggaacttaagtataatttatctcaacctcccctctgatgtttgaatcttctctacaacttctaatgaaagagtcactcaatcaaggcttggactcctccagtgatagggagctcattaccaactgaagaagcccatccatctttgagacttatattactgcaaaattttttcttatatcaagtgaaggtttctgaaacctttgtaattaccacttattttgtacccagtagaggccagagaccctgtgctatgttatacttaaaaatatacattgtgatttaattctcaaattaaaaatttgaaaattttatttttgaaataatttaataaattaaattaataaaaattaatatctaatgatattaaaattattttagaagctgctgcacaaatccaagtgagaaatgatgagaggctgaagcaagggctatgggggtggggataaagaagatgaggagggatccagtgatgtacagatgtagcatacaggtgactgagtggagggtgagggcaagagtgaaacaggagacttggagggcctccagaaaatagacaggtgttgaaaagcagggagaaacaacctggatgggaaagatgaaggttctgctgtttatcccaagagttaccataagtcgaaggggtcactacttccaaggacacatgatagctctacaaatttctttaaaattttaactgaatctggtttagtgttaagaaataatcatgaacagaattggatgtgcatcaaaagcaaagttttagaaagacctgcaatttttgcacagacctttaatcacatgagtgcaagtcagaataacacttttatgttcagcccttaagactggtttctcccttctctcctcctgccagtgccccagaaggcagaggagaggatccagagaactcagcacgaagatgcagcagagtttgcctgagccacaggggatgggagtctgaccgtgaggtccaggaaccaaagagaagtgcattccagtggaatatgtttctaggaatgggaaagagggagaaagggaagaaacattttatgtatacctactatgtgccaggtcctttttatgtaggattattattattatttcagtatcactttttttttttcccaaatgtaaaaactgtggaggtctgcaaagttaagtaattttccaagatcaagcagcattagaattaagtccaggatgtatgtatgcctctgagatctgtaatttcttcattatgctatgctgtctccttaaataattagcagttataagacgcaagttataaggtgacaaaatacattgacatggtatctggattaacaacaacccagaaggctagtatttctaatattgtttctattttatagatgaggaaactgagtccctaagaggttcattgactagctcaaggccacacagctagtaagtagaaccatagctggaactaaaaattcccatctccaagatctgtgtattttcccatgacactgcagctactacgctgggcaagctactatgaagctggactttgtcagaacagtgacagataacagctttgctctgaaacgttctttccttcaaaggaacgcacccaacctaatgcttgtggtggcgcctgctttcacccacattggctcacaagagaaagactccaaggaaaaaaggaatgagggtccctagagtttctgatgagggtagggcggaggtgctttcaaggatggttaaccctctctcagggctgggcgcaaaggctcctgcctgtgatcccagcactttgcggggccgaggtgggaggactgcttgagttcaggagtttgagaccatcctggacaacatagcgagaccccatatctacaaaaaatttttaaaaattagcctggcatggtggtgcacacctgtagtcccagctgtccgggagggtgaggcaagaggatcacttgcgcccaggaagttgaggctgtagtgagccaagatcgtaccattgcactccagcctgggtgacaaagcaagaacctgtctcaaaaaaagagaagaaaaagaaaaaagacatgagacgtaggagccaggcatttttcagccacaaataccaagtggataaaaaaaaataatgaaaagaatagaagaatggttagcccactctctttctagtgaaccctgggataaggtctatggtgcagtgctgtgaaaattcactcaatccacgagatctatacactttgttgggacctgggatagaatgaaccagtgttcccttagaatggaaatgactgagtagaaataatgtgggaagccacattaactctttcaggccattaggctatcatttagtaaattactacattgttctaaatgggtccctagtgggtatggagggtgagaatgttctaatttgcttttctctcctttctctcagctgctttctcctactatgatgtagaacaagaagtggtttaataactgctctattccaaatcactgaatgctcttataactactgcataaaagtgcccctgcaggtctgctatattgaaatgtgtggaatcaaatctatgcatatgatatgaggggtgggggctgcaatctggtacccacaggatctagaagtaactcgaggaaccaggatatccctgattttaaattctaggttaatggagggcgtgtgaccgagagccccatgttcctggggagggaacagatgccactggaagctgcagggcaggagtttctccacctaaaagggaggatccacaactctgatctgaggaggagtccgtgtctctgccttggcatgtatattacaagagaaaatcataggaagggcaaggatgttccctgacgactggcttccctctgtcactcaggatgcatggccactgttggttgaaggaactatcatttttctccctgattgaaaaacaaaagaatcaaagctctcccttgtgcttacaaatctggggatattaattaaatacctagtagagatgctggggcctaatattattgcataatggtgattacagcaacaatgcattatatagcattaaatgtttttgaagcactttcatattcatttgttttttaaataatttttgtttttatttttttccagtttcattgaggtagaattaacaagcaaaacatgtacacctgtatgtattcaaggtgtatgatatgttgttttgacatacatacacactgtgaaatgatttccacaatcaagctaatgaacatatcatcccctcacatagttactctgtgtgtgtgtgtgtgtgtgtgtgtgtgtgtgtgtgtgtgtgtatgtatggtgagaatacttaagatctgctctcttagtgaatttcaagtatacaatacattattattaactatagttaccatgctatattattaggtctcctgaacttattcataactgcaagtttgtaccctttgtccaacatctcccctttgcatattcgttgttggtcagggctatcttgatggacatatgaagatgggctccatgcttggtttaattctctgcagtcacagtcttgtaattccaaataactttaacttggaattagtattttgtaagcaaggtctgatgggactgtggagcatgtgctgggcttggaacctcagcttgatgccgtcctgccttcctgggatgggtttttggctgccagctccctgtctcatgctggtcctgctcagggccctgcccactccacccccttaccccacaaccactgctgcaatcaggtggcactggcagggggaggaaagagaccagcttggattcagtccttgaccactctcttcccccaatggtggtggtgggggagtctcgacatggacggtcatccacctcatggctttttggggtaggcaaggcagcagccatccttgtccctaattgcaacatcatggcttgtttggtgggtgatatagtttggctatgtccccacccaaatctcatcttgaattgtagctcccataattcccacgtgctgtgggagggacccagtgggagataattgaaccaaactgtttaccccatactgttcttatgctagtgaatcagtctcacaagatctgatgattttataaggggtttccacttttgcttggctctcattctttctcttgcctgctgccatgtaagatgtgcctttgcttctcctttgccttctgccaggattgtgaggcctccccagccacatggaactgtgagtccattaaacctctttttctttataaattacccggtctcaggtatgtctttattagcagtgtgagaacagactgatacagggggcaatacagttggtgactctgcatgagtctttcacccatctctgactcaagtaccaagcacatcctggcctagggattgtaatctgttgggtagtcacctgtctgctgtgggttgggagtggtgggcctgtaggaaagggagattgacttccctgtccctggccaggcctcacagtttcattttataccaggccttgcaaaatatatagccagacctgtagttgacatttattgtaatatccatgcaagctggataggacaagaatgttgctactgttatgtctgcttccattatttctactgctggggaggctaccattaccttctctgtgacttgcacttgggcaagcacttaacaatatatcatcccatttaatcttcacaaccaatatacaaggtagggtttatacactggggtggttccctaacttctctgagttttagtttcctcatctggaaaactggtatcataatgcctacttggtaaggatattgtgagaattaaataagatgacatgtatattaagagatggaggtaattttatctacctgcattcctctaattctatatttgttaggaagaaatcttttggtaagctgcttgaggagaagagtcaccatggacagactaaaataacccaataagcttgcttaacttttgcacttatgacaaggagtagtgtttgttccttgccattgttcccaagaggaaggtggcaaagaaagagttggtgagggcgaagcatttgcaggggaagagaacaggagtgacagtatgtcctttagaaagtggaaatattgaatggggttctaaacaaattgtttggttgggtttatgctataaacagcccaacctacccaccgtcatgaaatcttcagtaaaggctgtgtagctgactaacgcttttgtgtgtgattagataaatgcgggagaggggctcagtgtctgttctcaaagaggcattgaaattcacatccacgttggcacaagtgaaaacagacagcttgtgccagaagatgagtgcagagctggtgtgtggttctaatactattcttggaatgcttcctctgagtgacctccctctctgttcaggccacgcatttctggagggtataacagcagtatattgttatattgtatatatatgtatattctgtttggtttctattcttccacaggccccaccatcaggttccgcacagagtgaacactcaaatgttgagggctgataaatgtgagtagcaactactaaatgaaggagatgaatatgcttttgtatagtaacttcaacgatgctttgatatagaaattagtttacctagtgtactgatgaggtacatgaggctcagagaggctaagaaacttgcctggcgtcacacagctagtaagcagcaaaaacagacattcatgttccatacacaatgccttcctggtcagtgacactttagcagactatctagagttctggcatcgtataaaccaggcattatccacatatgtatattttaaaacctcactgaaagcagaaggataagatgaattgactttaagcattcctggggaacaaaaagtcaaaatggaaaaggagaacaggagcataagaaaaaaatatatagcataactcgttatcccttagataactgtagggtcatgctgatattagtcattgtactgtgatgacaccaaaaagggaaagtgtaccagctagccaggtagatgcaattcattgtgcaagaaaaggctgcctcaaatgtgtctaaaagcgtggttcttcattcagccaagtcaagaccaaaggagcacatgaataattggctacagctcccctttcagcaagtaccagctttctctgctgaggctgatacagctccatacctcagggggccgggaatcagctgccagcagccaatgggcttctgagcattcataagcagaccaggtgctgatccatcaggctaattagcagcctgtgggccacagttagctgggaaggtggagggttttaactcttttcctgacagactccaagcctatctgggctttttgagcaatgttctatcagtcaaaccacaaagaaaagtattagaattcaaaaggagggaagctaaaaggaaatatagttttgctttaaataagacaagggagactaacaacacaaaggaagtgaactttgactctcaaatatacatatatatagatgtatatatgtgtctgtacgcatctcagtctacgtatcttcatgttactgactgtaatgtcatcaccacagcagacattcaatacatgtttgcttttgttgaggatgatatagtgatatttaaaacagaaataataaacaagggaagaaaataggacaggattgcaagggagggggatatttagcttgttggcacctgaaatgtatttaattatcaggctcccaaaagagcagaggaaacagaattagcttcaatgaaaaatacagagaacatgctgaaagttcagaaaaaatgcaaaacttactttaattaggagatggagatggaatacatcagaaatagtgtcactgcaaattaccagacttataaaccaatatgtaaatcagcagaggaaacaatcccatgaattttagtaaatttgtagaaacttgttgtaaatagtgcatttaaaattagttttaatgtgaaatagaatcaacaatcaatgaagccaacaccatccaaatgtcttcattgacataaaaggagcattctatagtcaattggttctatatttttgactttagtgtggttttgttgatcatggatccaataatctccagtgaagcagtgccaatatatgatctagcgataggaaataacaaacaagcatcctaatccttaaagtagccaaatctgacaatcatagaaaatggcaaggcaggatactggcaaaagtcttaaaacacagaggtaacatttatggagatgtctgcacgggctctctgtcaacatatggagaattgaggaagagctacgggatttcaatgacaagcccatcaccaccatctggagataaaaattctgtggtagattttttttttaaactgtgatattttactgataaattttatattagtgacaagatcctaaccaaagtttccttggactgcttactataaaactgtgtactattgactctggggttaaaaaaatggatttatgcctcactgagaaacagctgtcattgcatttgtagaatcatagtgtcaagatgatgaaactgagctaattccagagtcttcagggacctaaagaaagcattatacagccctgaggaggtttgggtgtactggcagtaatgtcaactgtatggccctgagaaactaatctccatgttgagattatgaacacaaatctttccccaaatatttactgagtaaaaacatagtgagtggtccattagggagagcaggagcatgagttggattgtttttgttctaagaaatgaatgcactaccttggactataatcaatttggggattgtggtcttttaaacagaccatagcagatgattcagtgtcagtgggccactggattcatgccaagtgataattctccataacgcttcctacagtctggtgtgtgcaaaacaggcaaggtcacaagtctgttctacagccaccgggtgtgctggtccttttattgtcctggcaaagtaacaaccctgtgtatgcacccctacaaactatctccccatggtttggtcagagctgacccccaagctcaccctgcctaagtcatttattactagcagaggaagaaataagcatataatcatgaccttatctacttctctagcctcaaatctagtctctcctcaatcaaaccctttcctatccctcagggacaccttgactgggtgcctttgcctgtgggactctctgcccttagcatctttcaattagttctctgcctggaaggctgttcttctttcatgtgttacctcctcctgaaatggtttcttgataataacagcaaacacataggatttgcttcataccaggcgcacttctaaatgctttattaaatgtacttacttctcaccagaaccctttgaaataggtactgttatagtctctactttagatataaagaaacttaaaggcagagttgttaagaaatttactcagggtcactggtaaatggtagagctgaggttatgaaccatggcagcctggctccagagtgtctgttcttcatcacgactctgagcataatgatccctagactttgctgttagtatcctgagcactcgctaccagagaagtagctgcactgcactctagtcatgtttgtaagcttcctctctttccatgctaactccagttaatccaacaacactcagccaaagcatcaactttttcccccttaagtcttcctgatcctgctcccctaacctgtgggaggtgaatcctccactgcccacaccatgcttctctctgctagactccttatcacaccacgtgtcttgtttacctgtctgcctccctcattaatctgtgaactctgaagttttgaaggcacgaatggtctcagtaacacagtatctggcatatagaactgttgcttaataaatatttgtctgtttgatggatggagactggtgctaacaagtcttcattttgcaactctggtttctagcttttaccggcagattaagaacaaaagggattccatcacaaatcctgggagaatcatgacaaatgcttagcttcagttcagaaagaagcaagactatttatagctcagggactcaacattaaatgacccggacttaatttttccttgtgacctagatttgcacaactttagatggaaagtgcccttggagatcattttacccaggtattgcaaactggtggcctagagttgtttttatttgacatatattatttgtttctatttttattagaatacctttagacaggacatgtgctttttatttctccacattttacatcatatcctatcatacaccactttactcatttgtattatccacctgaccattcaaagcatttgaatatgaaatgtctgaattagtctaactcattttttttggtctttgtttacagtaaagctcccaagtctgtacttagggtctccaattttctcattaattcattccagtcagatgttctcccaccctctactgatgtgtagactgatttccatgtaacaatgtaccaatcatgtaccagtgatttccacctagctaaatccagttcctagcttggacctcaacccctcctccttgacattcaggaccatactctcctggttttcctcctacttctctggcctccccttctctgtcttcttgctgattcctcctcatactctcgacctctaaatgttggatcctccaaggtgcagctcgtggcctgcttctcttctggatctactctcatccccttggggatcttgtacaggctcatgagtttaaacactgcccacatgttgacacttcctcagtgtacatctccagctcacttggttgtctagtgggcctgtcaaacttaatatgtctaaaaacaaactgccaatttcttcatattttttttgttgttgttgagatggagtcttgctctgttgcccaggctggagtgcagtggtgcaatctcagctcactacaacttccacctcctgggttaaagtgattctcctgcctcagcctcccgagtagctacgatgacagacgcgtgccactaccacacccatctaatttttgtatttttagtagagacaaggttttgccatgttggccaggctggtcttgaactcttgacctcaggtgatttgcccgccttggcctcccacaaactgtcaatttctaccccaaacctgctcttcttagcagttttctttatgtcagttaggggtatatccgggccaccagttgctcaggccaaaatccatgggcttatctctcattgcttcctttctatgtgatatggtttggatatttttcctcttcaaatatcacgctgaattgtaatccccggtgttggaggtggaatctggtgggaggtgtttggatcatggcggcggatcccttatagacggcttagctctatcctcttggtgatgagtgagccatgagatctggttgattaaaagtatggtacctccccactctctcttgatcctattactatgtgacatgctggctccttgtcaccttttcagccatgattgtaagcttcctgaggcctcaggagaagcacatgccagcaccattcttcctataaagcctgctgaaccatgagccagacaaacctcttttctttataaattacccagcctcaggcatttctttatagcaacacaagaacagtctaacacactttcatatgccatatacaagtcctcagcagtcatgtctactccaatcttccagtgcctcccttgttctttaagagtaaaagccaaagaaagtccttagagtggtctctaggagccttgatattctaccttccttccttattcctatccctacctttatttctcagacccccattcccaccactatcccccttattgacctgcctccagctcactggcctcccttcactgttgagtgaacactccaggcatttttctacatcggggtgtttgcatttgctgttccttctgcctggaatacccccacccttcccttccccatccccaggtatctgcatgtatctgcatgggttgcttcctcatttccttcatgactactcaaatgaacctcctcactgaagctttccttgaccactctatttgaaatagacttccctaagccaggatgatttttcatccctcctttctgcttttctctagagcactttattaccctctaatatcctatatattttacttacctattttgtttctcttcctactagaatgtaagctaaatgagggcaggcttgtttgtcttctttgtttactgctacatcctcagcatcagaataaggctgagaacttgttatgggttgaattatgttccccccaccacccccagtaagtcccagtgaccttatttgggaacgaggtcattacagatgtaattagttaagatgaggtcacactggagcaggctggacccctaatccaatatgactagcgtccttctagaaagaatggcatgtgaagagaaggagatatccatagagggaagatgatgtgaagatgtacagggagaagatggccatctacaagccaaggagagagatctggagcagatctttcagacttgatttcagacttctaagacttctagcctccagaactgtgagacagaatttttttttagacagagtctcactctgttgcccaggcaggagtacagtggtgtgatctcagcttactgcaacctccgcctcccaggttcaagcgatcctcctgcctcagtgccctgagtagctgggactacaggcatgtatcatcacacccagctaattttttgcatatttagtagggacgggctttcaccatgctggccaggctgatctcgaactcctgatctcaagtgatccacctgccttggcctctcatagtgctgggattacaggcatgagccatcgtgcctggccaagacaatacatttctattgtttggaccaacctgggtgtgttactttatcactacagccctagcaaactaatactcaaaaaaattctcaagaaaaatgtatgggtgaataaacaagtgaattaatcctttcaatgaagaaactgaaggccagtgaagttgattaacttgccagaaacacaccatggtgaacgggcagaaccaagactcaaatccagctttcctgccgccccatctagctctcagccaccacatctggatgccacgtcagtctgtctcatgagcactaacaatggtgggctgaggttgagggggatctccggagccccttcaccatctcctaggtcttgcctatcctgccttcctgcttaacgctcccaccaccatcacataacctggatatgttgtggccagacaattattgacgtatgtttgttaagtgttctgatctcctctcagaggaaaaccctgtgtttgactcttctattattcaggaagtaataaaagttatagtcataatatataagaaaaaagaatgattcactgctgagctactgagctacagggagcaatccaaggtttagaacagacaattggctaagatcagtcacgatgatgtcacagcggaatatacaaatacctcagtgggctgatccaagagaacatcacaattaaatcagcttactgctgagcactcttccacatctgtgaagagctgctctccattctgacagccacgtttaaggaggtggtggaggcggcagtctatccaacaccctccacacaggaagaaaggattgcaaagtgctactgagtaaatgaacatcattcacatggaaatgcactggacgagatcatacatgttaagacagttaacagacaggttaggaacaatgttttcttttcagaatggaattacagtatgacattgggcatgggaaactgatgagagccatcagagatgatattcaaaatgtttaacaaaatatcgacagcataagccatcaatggccaatgcagccttatcaatgcagagtggttgaacatggtgctggtgaaactcacttggctagaatagcagagatgccattaacctctctgacccttagtttagtttcttcattgcagagtgaggcaccaccacttatttcctagtgttgttacaaaggttaagaaaaaaatctgtgccacaattcctggtacatatcagatccccaataataagagcaaacatttatgtgtctttattatatataaggtattagcaaatgctaatttacttaacccttatagcagccctagtattcaactattttttttttttttttgagacaggatctcactctgtcaccctggctggagtgcagtggcacaatcacagctcactgcagcctccacctcccgggctcaagtggtcctcctgtctcagcttcctaagtagctggtgctacagatgtataccaccatgcccagttaatttttaaatttttcgtagagacagggtctcactatgccacccaggctggtcaagaactcctgggctcaagcaattattattagcattttcccgttggagaaattgatatagagagcggttaagcaactttctcaatgtcacactgctggtgaatggcaagacagggtcttaggacccaggtagaatgaatcccaggggctccttccccaccctatgctaccctcaggaaatgtcggggcccatccctcccactttatgctccagagagccagtgtccctgcaaacctaacatctcattgcctcaaagtcccagctaaagcctagtggagaggacatcactctttggtccttcagtgccctagcccttctttctaggtttactcaatttccatttgcatgaagacagacaagaaaaacagtccaattaatacgaagcgtaagaccacaagatgagaaggcttttgctttgctttttattttgtatcagctgaagtgctgtgagtattcgggatgaaaaattatttatcccagttaatgaatctcatgataataaaaatgcctgacagctctgagattagtgagtagcccttatctggggaccacttagtgaagcaaatcctgcgtgaacaaaggacaaatgggatttgggagaatgaggaggaagggaggctaagaacgaacatgtgttttgcagctatctcatgccaggcatcacacaaggtactcaaccctcattctttcttttaattcttttgagaactcagtctttatacaaacacttatggcagtgccaggtaccataataagtgttggggttacaaaattaaataaatcatggcccctgtccttttaagtagaatggatacagaaaataagtagagaggctatttatgttcactgcaatattagtttgatatgagtatacacaggcagtggaactatgctatacaggccaagatgatacctaccatgtcaatagttcctgcataaggactatttcctgcatacgcagctgtgttctgggctgggtgatatacccctgcacctccccatggcccctcaggcccttcacggaggttagttggctagaggagtgagattctcttaggagtttacacttggaagcagaaagagaatcaggcaattggttgtgggaacagaaactgagaagatgatctaaaaggagtgatgaagtacagtagaatggggctgggtgggaccatgtgtaagcggaagctatgaatacacagaagatacaaggcacagaaaacgctgagcagaatgtgaggaagctaggtcgtagcaggaaatgaatagaagcagaggatactctaaccaacgtatgccccacaatttaatcctttccctaatgttagatcattctcattttttcctgtattacaaggaatcctatgatgaatatcattgcacatcagtatttgtagcatttctgatgagtttctctaatatattcttggattaaatggtatgcacattttaatgctcttgagacaagtatgcatctttatttccaggaagatagcactaatttcccacgcccttcagtattatatgagtgagtctactttaacacattgtctcacactgagtccttgtcacttaaacagggaacggtagtaactacctttttaattgtttaattatttaatttttaattgtttgcatatttttcatatgttatgggacatttgtatttcctcttttgtgactccagcttgtttatgtctttttgtccatttgcctataaggccatttataatgctcttattgatgtatgagaaatcaataaaatttatataacaagaccaatactcactgacatatttagcaaacacttacccataattagttgttttccttttcatttttatttgaggcacggaagttttatatttttcaatatattgatattttcctttgtaatttgtttcaaagggtttctttttgcggaaaaaaatctttttctgttttctagatcaggaaaatacttggctctgtttcttttcctacttttggaaaatgtttttgcttttatatttaacttttctgttcacttacaatttattttggtgtatttgaacctttatgaaggaagattttgtactaaattaaaaaagaggatggtgtgatcctgtttcagaaaaatctaatctgtgttaatgtttgttccccagcagaatcaaccatggattacttccaatgaccagtgcaatgacttgagcacacacagacccatttaaatacataatgagggagaacatatgatcaagggcggagatgccatcatttgtgctctgtatacaacctacttttattaaatggaaattatggtcactgaataactcaatctacctaaactcttacaaggaatcagaagccctcagttcttaagctgggtctgtactgatttacaatgggacacaaacacactgtacctccttaaccctaacacccactttccaattgcctgtctttcaaaactatctaattagatttctttaaaaagaacatttttgtcatttgtgaggaatttttcttttcttttttagtttgctcttactgaaaaaccaaggcaacttcaactttatcttttcatagggtccctttccaagtgttatgactgaatggaagctgtgtggttggtgaagtacttcggctatatttccaaaaatatgcaattgttaggggctgcaatgcaacagccagttccagagactagcaaaaggcagggggatactctcaagagtgactacactcgagactttccatttcagcaacttcaggaattggggaaaactcactaattcaacactgagttctctgaaagtgatggtgtattagtttgctaggtctaccataacaaagtacagcaaattgggtggcttaaacaacagacatttgttttctcagaactctggaggccagatattcaagatggcagcactggggagaaaatctagcttctggtggtttgcaggcaatctttgacatttctttgcttgcagaaacatgaccacaatatctgtcttactcttcacatggcattctctgtaaagccacactatttgcttagattgtttgaagaaggcactttcagatgtgttccagaggctgggcaccttgatctggatcaaacgctgccaattgttggttgaaggtgagtgtagaaatgtatctacttccaaagccaaaatattactgtattagtccgttttcatgctgctgataaagacatacctgagactgggtaatttatacaggaaaaagggtttaacggacttacagttccacgtggctgggaggcctcacaatcatggtggaaggaaaggaggagcaagtcacatcttatgtggatagcagcaggcaaagagagagcttgtgcaggaaaactccaccttataaagccatcagatcttgtgacatttattcactatcacgagaacagcacgggaaggacctgcacccatgattcagttacctcccacctggtccctcccacaacatgtgggaattcaagatgagatttgggtggggacacagccaaaccatatcaattactaagtacacagaaaaatttataagtcttggtccatgtacctcatcaacttcttctagcaagaagcagctggctgacttgcaatgaaatctccttagagttttatctttaaatcattgatctcaatggatatcttatacctgaaaatttgctgttttactaagggtgaagtaaattaaattccacaagagttagaaaataatttaatcagctggcaaaagctaaggatgaaagcaagttaatacaaatttcaattttcaaacaagattcaatacatgtatataatttatttggctagattcaatacatgtatataatttatttggctattacagggagagaaaacataattactaggtcttattaaaagtatgtctttcttcttttccctgtcatcctttcttccctttcttctttcatttttaaattcccttcccctcttcctcattccttcctcctttcttttcttcttccctcccttgatgttttccatttactcagaaaacatttagggagcaattaccacaagttagagtatacaccatatgccaaggatgcacccaaaatgtacaggtgataaagcagcagttcctgccctcagcaagttcatagcctaatagaatctgagttatgtaagggtgaaggccctacagtacattctctataatattgtagtaagaggaataatctcagatctcatgcatgcattccatgatttttctctttacttttgccactgtttttctacctgatattaatcttaatactataatcttatactactccttcaagcagctccgtgtgttttctataggcccaccaattattgccatgttctaataaggttttaaagaaaatatgtgaccctttagaacatcaccccacttccatgcctgtcttccatcctctgtataaagagcagagggtgtgaagaatggactagaagggttcctgggtggctcattgttgtgatctgtttgcctgctttggcatgctttgattataataaatatcttctctgaggggagcattttgaggaaagtgattgtaaaagaagatggaaatccatctataaagatggtaaccacaggaactaatttgaagaggtttttcatatttattaatagcatagaattgtccttccagaaagcataaagttctaaatttgaacaaagtccacagtctgaaccaaaattctgtacctttcagaatggatcataaaagaaaaaaagtctacagcacaaaaatagtttcctcctataacctcaaacaaatgtgagggcgatctgcccttgcaattttcattacttcaagataacaacaaggaaactatgattcagttagttctttcctttcacacattcagagttactctgcaattgctgagtgctagtgtatctatcctcaagtggcatttctgtttgagaactgtatttttcattatttagagttttctgtaatttttactggtaatattaatatttaacaatatcatacccccagaggtatctttgtgcaactttagaatatacgtactttgtttctttttatgactctaaccttttattctttcattcctctagtactctgaatataagagagtctacacgctttttagtgaggattttttgatccctgcttcataagtgtcactcattgtaggctttcctttgacaacaaaaattcctgctctctttacgttgactctaattacttcaccagaaaaggtaaacctgtcattgtgtaagaaaaggaattaagttaatgtaactgtttcttaaggtcttattattattttatttttatttttttgagacagagtcttgctgtgtggcccaggctggagtgcagtggcacaatctcggctcactgcaacctctgcctcctgggttcaagcgattctcctgcctcagcctcccgagtagctggaattataggcatgcaccaccacgcctggctaatttttctatttttagtagagatggggtttcaccatgttggccaggctggtcttgaactcccgacctcaggcgatccacccacctcagcctcccaaagtgctgggatgacaggcatgagccactgtgcctggctcttaagggcttaatgtgaatgttgcatacacatgtaatttctgattcatttgtggacctttgcgtaaaaataaaattttcttagaaattcatagaaaaacatggcagttcttaccatgcatcacagtcaatttcctgagggttctgttctttggagtctggggaggggaggtgctgtggtttggatgtgtttttttcccaccaaagcccatggtgaaattcaatcctcagtgtggcagtgtggggagatagggcctagtgagaggtgtctgggtcatagaggtatatccctcatgaatagattaatgccttcctgctagggtgagtgagttctagctctcaggggaatgggttagttcccttgaaagtgagaatgggttgttaaaaggagtctggcttccttggttttgctcttttgcttcctttctcagcctgtgatctctgcacactttggctctctgtcactttccaccatcagtagaagcagcatgaggccctcaccagacacagctgcctaagcttggggtttccaggatcatgagccaaataaacctcttttctttataaactacccgtctcaggtagtctgttctagcaacataaaacagactaagacagaggtcttcaataccaaaagatagtctacttgatgtgtgaagggaggctttggtttgcctgctataaaataattttagttgatgaacccgaagttccctgaaggtttagtttctggtgactttcattctgcaattcttgcacaaatggaaaaaaatccatcctagttgaatggagtacctacactacaaatgtagagtgaatctgtagaaaccactttttagataactgataaaccagctagttgctaatcacttcattgctgcttcccaccaccagtcaatgtttaaaaaaaataaagaattctccacctaactttgacaactggggaaaggtaggactttgtttcagcatcaaaaggaagtagagccacgtagaattatcatttagttccctcagtcatagccatttctcatttttcatcttccctacttttctcagggccatttattgtcctctaatgcctcccttctcttcattcttttttgctcttaatatctctggagggacaccaaagaagtgatttctttctgcattcattaaaaataggtttatgttttgccttcctgttcaattcccacttgggctgtaagcaagtaactaaagcaagggaagggttgggcatgtgggcgccagacttagatgcctctatttatgcctagattcttcctatttctcccattcttccctcaggataggagaaaaaggaggtggcagaggtctgattaaagcagggatgagcaactgagccaccactgcagtgctgagattgggtgaagcccccagcttcacagaaaggcctgcaacatcattgcaagattaaatgtgccaatattcttgctaagttactactttttgcacattaccagagaatagacttcccgggcctaaaggaatggcaatgttttcattgtcatttatttctctgttcagtaaggtagatagtacaggttttaagagtcttcttttttttcctcatgagactctatttcttttcccctctattttcttctatgctaaatggctgtatctactcttgaaaatacattctaactctaagtgtcctttgtggatttgactttaggaaaccaaagtagcttcccccaagccaccctctgtctctcttttttgtttttttgcccattggtcgattttaccttctttttgtataccatcaacccaaagacacagcatactagggacgtaagtgtggaactgataccgttagttttatttcggggtgatgcaatccctctgctaattcttagatggtcttatggtgtcagaagaaaatttccttctgtcagaaagccttaagtacgtttggaaaataattcagaatcaaggctgtcttcttctgttttttaatcaattcactaaatagtcttcatcatacagagaaattattccttctactccactccaaactaagacattattttgaaatagattatcaaataatagtgcagactaatttccatagctcaatgagtagaaggcaaagtacattatttgctaatgcaaatgctgagccttctccaaaaaatttaatattcaaagtccagacgggataaggagacaaaaaaagattgcttaacaattttccaaaccaaagtgacctataacacacaaaatatggttctattatgtgcaactgatattttctttgttgagaataatgagctacagcagaatggcataatgtagaactccacagctgataagctttctgcataagaacaggaagaggacatttcttaaagagttctgtgttcattgcttaccttgaggaggcagtgaatggaattactgttaatagtaacaatatgaagctaattggtttaaaatgaagcagcaggaaatgctgatgatgagactggggtatatgaaggaagaatgaaaaatctatactccggctacacaaaaatgatgcttaaaatgtaacttaatcttgatattttattcataaatgacaaatctgctcactacactgattccctaggtgactcatcaaatcccatctctaggtttatgaatctcaaaattttgtagctagttctgactgttttcactggcaaaatttgtcaaaatcaacttcttaagaatttggaaattaacccaaagtttgcaataatacaaaaagcatttacttttttaaaaaatggctgaatcccagtaaaaacagtgagctttgtggcattttaacttgcacttataaccatctgcctctccacagcttcacagtatccttgaaaatcaacagctttgcagccatgatagctatgaaaactagcagcctagcagccactggaggggacaggtcaggtatgaagctcccccaaaattcccattcccagagaatggtcactatttaacctgtctgaaagttccttaagaaagctccattcttatagtttgtctttatttgccttgacttaaagctcatttggtgggaatagccctgaccccagctaattttttgaaataatcagcaaaaaagctttcagaatagtgacactaattgaaactaaaaaaagaatgaccaaaaatttcacaggaaagactggataatgagatgtgtttaggggggtttgaaaagctctgatagatttctggtaatctagaaggccatgcacatatacagggctgtgcacgttcccagaaaagacctgagaagcccctattctctcatctctagttgactttgaggttctgtgcaagctggatgtgaaggctaaggcagagttgtaaactgcctggtagagcattgaagacacaccttaatacacacacatagtcctttggcagtggctgggagacttactggctcaaggcatttaaggaaatctgttcaatcattaggtaattggtaagctaactgagcacagacttctgtggatgcagtgagagataacacagaatttacagaattagtccaggaaagtcactaaacaaacagcagctgcaataataaagggcatcaacaacagaccttagagaggagggaggaatatgaattccagaattgccacactatattccttaaaatgtatagcattcaacaagaagttaggagacatgtaaataaaaagcaaagtatggcccatacacaggaaaaaaggaagtcaatagaaactgtccatggatgttggacttcctagacgaagactttaaaccatctatcataaatatgttcaagttactataggagacatgtctaaagaattaagggaaagtatgaaaataacgttttggcaaatagagaatgttaacaaaggatataaatgatttaaacgtacaaaatcggaattgtggagctgagcagtgtaatagctgtgataaaaatatagtggggctcaacagaagaaagaataagcaaacttgaataaaggccaattgagatgaataaatagaagaacagaggaaaaaagaatgaagaaaaacagtatcaaagacctgtgcagtgccatcaaatgtaacaacacatgcatagtgagagtcccagacagataagagaaaaaaaggggatgaagaatatttgaagaaataacagctgggaactctccaaacttgatgaaaactattaatccacacatgcaagaagcccagtgaactccaagtagggcaaactcaaagagatccttactttactacattacagccaaactttctacagctaaagacaaaaagagaatcttgagaatgccaagagaaaagtgactcattgagttcaagggatcctaaataacattaacagccagcttctcaacaaaaaccatgaaatccagaagaaaaaggaatgacctattcaaagtgccaagaattttacatccagcaaaaccaccagttaaaaacaaaggagaaattaagacatcctcagataaactgagggaatcttatcactagcagatcttgctccacagcagatagtaaggggaaaccttccgggggaaatgaaaggatgctggacagtaactcaaatccacatgaaaaaataaagagtaccagtacaagtaactgcatttgtaaatataaaagacaatataaacacatttttgcttgtaactctttctaatttaaaagacgaatgcaaagcaatgatgacaagctgtttgataggcttataatttataaatatatacttttttaattgaaatttttttcttttatcatccagcccaaaatgtcataaagatataatttctatgacaataataacacaaaggaggagaaagggaatgaagctatattgaagcagttttacatataattgacggtaaattggtattaatccaaactagattattttaagttaagatgttaattgtaatctctaaggcaaccactaagaaaataaagatatagtaagagaaacaagaaaattaaaatagtatactagaaaatttatatgttaaaaagaagaaaacctcaagtcaataactaaaacacacctcaaggcactggaaaaagaagagcaaattaaacctaaagcaagaagaagaaaggaaataataaaaataagagtagaaataaataatttagagaacagtaaaacaatagaggaaatcaacaaaaccaaaagtgtattctttgaaaagatcaagaaagttaaattaacaaatctttacctagactgaccaagaaaaaaaaaagactcgaatttcaaattattaaaattaggactgtaagaggggatattggctgtgcagaaataaaacaaaagattataagggaatgccatgaacaactgtatgccaacaaattaaataatcttggtgaactgaacaaatacctaaaaaaccacaaactgttgaaaccaactcaagaaaaattcaaaaatcttaatataacaaggatagagattggattcgtaattaaaaaaaaaaaacttcccacaaagagaagtctaggccaaaatggccttattaatgaattctaccaaatacttaaagaattaacaccaatttcataagttctaccaaaaaatagaaagggaaggaatacttctgaactgattctatgaggccagtatacactgacaccataatgagacaatgacatcacaagaaaataaaattaaagatcaatatatcttatgcatattgatgcaacaattctctagaaaatatcagcaatctgaatccagaaacatattaaaagaattataaccatgatcaagtgggatgcatcctgggaatgcaagatgtatttaacatacaaacataaatcataaatcaatgcaatactttaaattaatatataaaatgacaaaaattacgttatgagcacaatagatgcaggaatctcctttaacacagcccaatactcttttatgataaaaatcattcaacaaaccaggaaaaaaacacagaacttcctcaatctgataaagcccagccatatatagaacccatacggctaaaataatacttaatggcgaaagaccagatgtttttccctttcccaagacaaagctagctactctggtcacttctattcaatatagtattgggggtgctagccaggctaattaggcaagaaaaagaaatcaatgcatctagcttgaaaaggaagaagtgaaactatctctatttgcagattacgtgatcgttatatagaaaaccctaatacacacacacacacacacacacacacacacaagttcagcgaggtttcctgatacaagatcaatacacaagcattagttgtatttctgtgtattgacaatgaacaatttggaagtgaaattaagacaaaaattccttatagaatagtatcaaaaagaaaatgcctagtaatagatttaaaaaagaaatgcaatactttcacactgaaaactaaaatatcattgcaagaagttaaagaaaaactaaataaatggaaagaaaactcatgttcatgtatcagaagactgaatacgtgaagatggtaatactcccccaaattgatctacagattcaatccaatacctattagtatctcagctgccttatttgtagaaattaatgagctgatcctaaaattcacatggaaatgcaaaggacccaagatagccacaaaaatcttgagtaagaagaacaaagatgaagaactcatacttcctgatttcaaaacctgatacaaagctacagttatcaagacagtataaagcataagaacagtattggtataaggagagacatataaatcaatgaaaataatttatattttcagtagttcagtagcaggcttttacagggttaactgattttcagtaagagtgccaaggtaatccaatggaggggaaacaggctcttcaacaaaagttctggacaactgaatatccacattcaaaggaatgaagttgtaccagctcacatgattcacaaaaattaactcaaaatgaatcataggcctaaatgaaaatgctaacactataaaactcagaagaaaacatagaagaaaatcttcagaatcttggatcaggcatgacttcttagcaatgacactgaaagcacaagtgacacaagaaaaaatatataatggacatcatcaaaattaaaaactttttgtgattcaaatgatattatgaagaaagtaaaaatacaatccacaaaaatggagaaaatatttgtaaatcaaatatctgataagggttttctattccaggtatataattaattgttatagctcaacaataaaagataagtgacccaattttaaaatgggcaaaagatttgaatagacatttctccaaaaaatatatgcaaataaccaataaacacatgaaaagttacacagcctcactagtcatcagggaaatgcaaataaaaaccacaatgaaataccacttcattcctactaagatggctaaaataaaaaagaccataacaaatgctgacaaaggtgtggagaaattgtaactctcatatgttactggtgggattataaaatggtgaagccactttggaaaacagttcagcagttcctcagaaagttaaatttagagttaccatatgatccagcaattccactcctaggtatacacccaagagaattgaaaacatatgtggatacaaaatttgtacataaatgtttctagcagcattattaaaaatagccccaaagtctaaacaattcaaatgtccatgaaatgatgaatggatacataactgtggtgtatctatatgatgggataaaaatttgtcaataaaatgaagtacttatacatactataatctggtgaaccttgaaaacactctaattgaaaaaaactaatgaaaaaaagaccacatattgtacgattctgtttatatgaaatgtccagtgtaggggctggggaaagtgggggcggggtagtgactgctcatggttatggggtgtcttttggggatggtgagaatgttctaaagttaagacagttgtgatggtcacacaactctgtgagtacacgaaaaccactgaattgtacatattaaaggagcaaatttaatggtgtgtgaattatatctcaataaaaaataatgtggtgtaaatctggccactcatggttttcacctcccttttttttttctcccctattgggacaattcataagttaccatgctgctggcagctctggcagaaaatgatggtgacagaaaatgacatttcaggaatggcttttaaggcacgaggagcaatagcctgaggataatcagagttgttaggctactctcctgtcctggaaagtgaaatcaacctgattctgtccatcatggacactggtgacttgagttgttgacgaatgttctgtaaagtttaatatcccctgctacactttaaatacagagcccaatccaccatatctttcaaactcaggctatttcaaacataactgaagtagaacttcaaattagagaaacttgaggccttctgatcactggccagaggggaaaaattgttttttatgacctgaaaatgtatttagtatgaaaagaaaatgacttcttaagatgagaataagaaaggggggaaataaccaaatttgaagttctaggtaaatacaataaggcaactgaatagacactcctttctcctgttttctattaggattataattggggattctatctccatccaatagtgtttctgtacacttcaaaggtaggctaactatttaaaccagagacagaacactctgtattactctttttatattgatgtcctgttacaaccatgttttgtttcgttttgtactagagaaaaaagaggactcaaacttatgttgtcaaatatttcctagacacttttgtgtgtgacaggaaggaaacttgttaatactgctgtctcaggtaatactgcttttttagttaatactgcccttcatccctgtgtttaccccctcgagcttatcctccctgttatctgattggtttgtcaacattctgaaccaaaactctattttttaatggaaagcctaaggaggcactttttcctgaaagagattggtgtccctgattatacttactcagagccttctctggattactgggaaggaacacacctgtgcatttgatcttaacaagctctaaatctatattgtgttgctcaggggttgcctgacagagctcagtcccatggtggaagaaacctaccaacctcggtcttctcagctttcaaaggcgacacctgcctctggcctctctctgcattctccccattatgatgtggttctccagaccagggaagagaccagggggaaacacaaactaacacaacaagctccttctggttctgtgtgtagctctttgcaatttccctgctctggtaggcagcactttccaatcagccctgcagctccacctctgagaattcttcatgaggaacaagctttctttagtcatagtcacttgtataagaagagatgttttccttcatgagttgtttgaaatgcagtacagtcattccttgtgttctgaaaagctcccactaaatgacatcatttaattccaggatgctcagaatacttaataatacctttggttttgtctttgcaaaacaagttttgtgtttgtggaagggaacaaatctgaggagtggcaagcggcgaagaccaaaagcttatctgtgtggaattgctgctgtagacaagaacaatataatcctccctgttctgtacctactaaatcttacaaagggttagaaaaatagtatttcatctgtctttgggtttttgataataccaaataacatcaaatggaagcagtctcatggtttcttcattgctaaactaattgttattacatacttgttcctgtgtgatgttaatatatattcctggaaccagaaaggtctacatggtcaaataaatttgaaacttgcattaaataagaataaattgatttttttctccttcagggtttcacagaatctttaataccaatgtgcttttttgaacctcttaatgcagctctggtaggctgactttctgtgtgtgtgtgattattttatttactgccaatctccttaaagttagtttttatttaaaaattatttgtataaacacctgaactatttgactttttaaaaattccattctattgtgttaatagcacttaacatgcgatctacctctgtaaaccatttttaagtgtacattattgttgactgtaaggacaatgtggcacagtagacctctagagcatatttatcttggttgactgaaactttatggctgttgattagtaactccccatttagtaactccccaattagtaactctccctagccctggaaaccacaattgcactctttgattctatgagtttgacaatttcagatgccttacacaagtagcattatgtagtatttgaatttctgcgactaacttacttcacttagcataatgtcctcaaggttcatctgtgttgtcacatattgcagagtttccttctttttaaagactgaatagtattccattgtatgcaactgtgtatgcatacaccacattttctttatccatttgttgatggatatttaggttgtttctatgtcttggctgtagtgaatagtgctgctgtgaatataagagtgctaatacctctttagatcctgatttcaattttggtgggggatacatacccagaagtagattgctggatcatgtggtagacatatgtttgttttttttaagaaacatctatactgcttttcatagcagctataccattttacgttcccaccaacagtgtggagcggtctcaatttctccacattcttgacatttggtgtctttttaaaaaaataatactcatccagacaggtgtgaggtgagctctcatagtgcttttgacttgcatttccctgatgattagtgatgttaagtattttctcatatacctgttgtcatttgcatgtcctctttggagaaatgtctattcaagtccttagcccattaaaaaaaatcatgttactaggtttttttttcttttttactattgagtagtaggaattccttgtataggttggagaataacctcgtatctgatatatggtttgcaaatattttgtcccattcagtaagttgccttttcactcagttgactgtttcttttgttgtgcatgaactttttattttgatgtagtcctacttatttttgtttttgttccctgtgccttttgtgtcatacccatgaaatcatggccaagacgactgtcaagtggtttttcatgtatgttttcttctagcaggtttacagtttcagatctttaaatgtaaaataataatattgaattgatattttgtgtatgccataaggtccagtttcattgctttgtatgtcacgtccagtcttctcaatatcattagttgaagagactatcctttcccattgtgtattcttggcaccgtttgtgatgaccagttgaccatgtatgcatggatttatttctgggctctttattctactccattagcctatatgtctgtttttatgccagtatcatactattttgattactgtggctttgtgatatatattgaaataggacgtgtgaggcctccagcttttttcttctttctcaagattgacttggctaagaattttagcattttgtctatttatgtaaaaaaatgccattggaactttgataggaattgcatttaatctgtagattgctttgagaagtatgaacatttcaataatattagatcttccaatccatgaacatttgatatcttttcatttgtttgtttcttgttttatttctttttactatattttgtagttttcagtctgctttcaacttcttagttgagtttatttctagatattttatttttttggtgctattgtaaatagaatttttttcctaatttcttttttcagatagttcattgttagtgtatagaaatgcaagtaatttttatatattgatttggtatatatcaatatataccaactttactgaattcattttttagttctaacagttttttttttaaatggagtctttagaattttcaaatatataagatcatgtcatctgcaaacaatgtggacaatttcacttcttccctttcaatttgggcaccttttttccttgcctgactgctctggctaggactcccagtattatgttgaatagaagtggcaagagtaggcattcttgccttgactctaatcttagagaaaaagctttcagtttttcatcattgagtatgaggttggctgtgggctaaccacatatcaccttaattataatatgttgaagtaatttctttctgtttctagtttgttgagagtttttatcatcaaaggatgttgaattttgtcaattgatttttcagcatctattgagatgatcatatgatttttatcttttattctgttaatgtggtgctaattggttttcatatgttgagccatccttgaattctacagataaatcccacttggttatggtgtatgatccttttaatgtgcttttagattcagctttctagtattttgttgaagatttctgcatctatgcatatcagggatattggctgcagttttctcttcttttgtactgtctttatctggctttggtatcagcataatgctggtctcataaaataaatttggaagtattcttccctcttcaagtttttggaagagtttgagaaagatcgacattaattcttctttaaatgtttggtagaactcaccagtgaagtaatttggtcctgggattttctttgttaggaggtttttatgatagacagtcttgcctcttgaatgaatatttatatctcaagaagctagtgttctgtgaaagtttgtgaatgaagttttagattcataccctttaacctaatgtaataattaagagaggagactttggacaaaaagtactggattctatttgtgggtctctaccaattaacttcatttacagaattagcatagtaatacttgctacaaatcgagttgtgaaaatttagtgaaatatatgtatactaacaaacaaaaccccaggcacttaggtggccttaaataaatggtagctattattgtgtataaaaaagttagtttagtcaacaccttttccagcaagaagcaagaatttctttcgtttataataataatttaataaaatttcctaaaatgccttctgcatgatgcaagaatgatgaaattatatgcaatgttcagttcgattttagtggttagcacaatttatggtattttattgtttaggaaagggagagtaaagaacatctattgagagtttatttagtactcataccagtcttagggagtaaaaattatctaaccccacttcactgatgagtatgcttcagtaaattgctaaagttcatggaaagcatattctgtggcaatgttagaattcaaacccaggtcccctgactccaaagccaatgctgtctccatactgccataccaccttctttaaaaatgaacaatttggctgggcatggtggctcatgcctgtaatcccagcactttgggaggctgaggtgggcggatcatgaggtcaagaggttgagaccatcctggccaacatgttgaaacctcgtctctactaaaaatacaaaaattagccgggcgtggtggcagttgcctgtaatcccagctactcaggaggctgaggcaggagaatcacttgaacccaggaggtggaggttgcagtgagccgagatcgcaccactgcactccagcctggtgacagagtgagactctgttaaaaaaaaaaagaacaattaattcttgtgtgtacataatagctctctgttaactaaggctattctattcttcacttgtttcaaataaatatctcccctactagatctcaatacagtggtcttaagtcaatttaatcccagtaatgttttatagtcattttctcagaatttctctcatgttcaggtaaggattacataattgaacacaaaattttatcttgtctaagtacttctgacttcacagggaattgtgataaggagtataactcagtggagatgatgtgggatggtaggtggaatgctggccgtggccttagtagtgatcttagtccttcccctgctttaagtccctgtgtgacccagtgagttactctgtatctttaggtcttagttttcttactatttgctctatctacctcatgggagttctgtgaagagtagattaactcacttttccaactctccctatctgtagttgtctcaaagtggagaatgcatactccagggatgagcaggatggttcattcgggtagaggaggatgacatcaaggaacacttataggtgctttaaaatttgttcttttaaaatttacgtttttagcatatgttttataatgtatggacatagcattacatttatgaaaaccataaacacacaaacatatattggagatatgtgctttttttttaattaataggggtaggtgataaaaatgtcgagggcctggtggcctccaggataaagtccaaattctttagtatggcatttatgtcctctggggaccctccagcttcatttcctcccccattgcttctccttctacttaatgaactgaacatactagtatgttttgtagcttcactgtctttgcttatactactctttttgccagagactcctgaaacctctctcagcctcccaccttccacttgaaagactaatttctcaagactcagcaaaggagttatctcctgaataagccctttcctgaacctctcaggtatgccagatcactccttccttgggcttccactgtactgtacacatgccacctataagctgtgtggaagtgtgcttgtttgatttcatttactagtctgtagatctctgtattactctacactgctataaagatactatctgaaactgggcaatttatgaagaaaagaggtttaattgactcaaagttccaaatggctggggaggcctcaggaaatgtacaatcacagtggaaggtgaagcagaagcaaggcacatcttacatggcagcaggagagagagagagagagagtgcaggggaaactggcaattttaaaccatcagatcttgtgagaactccctcacgatcactagagcagcatgggggaaactgcccccatgatccaatcacctcttaccaggttcttcccttgacatgtggggattacaattcgagatgatatttgggtggggacacagagccaaaccatattaagggcaactgccatggcttcttaaatcttttttgttttagaacctaaaatggtccctggtatgtatttcataaatattgattagctatgcaaatagcaaataagctctgagagtactatagcatgttaaaatctccaggcaaatgttaatagttattattattaacctacgttaaattctcataggtttcagtggaatatctttattaaaaatcttaatcaagtgacgtgagcaaaacaatcctaattgacacctgtagacactggttttcaaccccgggagctttcaaaaatatcagtgcccaggctctgctcataggggttttgattcaattggtatgggatatgggtcaggcatctgtggtttttaaaagctccccagatgattttcatgtgcaggcagggctgagaaccattgtttcaaatgtcatggataggaaaagaaaggtgcttgggaaaacctaaggcagagtgctcttcctgaaaatgcaactgcagttgtgaaagcttctgtctttgtaaggttaagatgtgtccttgggggaagacacacacacacaaattgcagttatttattgagaccagactactaagtcacttcgatgaaaacttgagagcttaagactcgccagcatgggctaagaatagatcacattgcagaaaccagaacagtttcttggaaggaatggctgaagacattgacaaaggctgagcagaggatgaaattgggaagtcacccatcaactatgggggttgggcaacgtgaaaatgtgcttaccatttgcaatgaaatggaaaaggccttggtgagaaggcagtggagattaatgataataagtcatgttgagttttaacaagataacatacaggataacaaaaaggcaaaagtttattaagtcagatcctgattttgcaactaacaccttttttcctccctctctttttcaccttgagactgttacagatagctgagtaaggtgccaaattagactcgaactgcatctcagggtgaaaactgtgagtgagcatcagctaatgttatcctaaagtgtatggaattacaagtttctatgaagatgtttttgagaaaccttattaggattagtgcgtatgttgtcaacattggattttctagagaatcagagtgaatatagctggtacataagcattgttaatttgcatcatggatatcaaagccttcttgatagaaattacctatttgcactgcatactaatttgggcattgctgctctggaattgataaaagtttagcctataaattggctgaagttccttttgtgctaagaaagaatttgctaagcagatgcataatgtgccattggccattgcggttaatttttttaagagaataaatatttccaagcacttaagtgccatgtgttacaaatcacaccactcagggactagttgaggcttcttttttccttgaagtcgggcaggcaggacctctagtggcaatggctagttagcagttagatttagtgctaatgttttagaaagtacaaactgcacttcttttaaattctggttgatagacttcaggttgatattccccccaataatttaagctttgcacattctaattccctggtgttcaaattgtcacaagttcttgctgtgtacatatttcttggaggaacacttttaaagaaaatggcttcaaagattcccaggcaaagtggacacctggacctgtaaaaggaacgctgcccctaagatgtggaaagaggccaacaaatgttttaattggttcttgacttcagtactactgactttttctcacatggcacactgatgcccctaaatacccatttgtcctctgaatttggtctttcaaacaagggtgagagatgattttgagagtgagaagagagctgttctactggggaaaagggcacagggagggagttttgacaggtatttgtggtggccacagccagtgataaagcaaacactgcagctgagttcaggccccactgtgaacgggcctgcagttacatctcactcctctcttctgtcagttgggtcccatggggtccactggcaggacccactccaggcaggtgtccctgagcctctcctaaccacctctttctcctccatgtctttgctctctatgtggcgggggcaagaggggagcaaagggcagtagtggcttgtgtgcaggcagccagatgggagcctgaccttgggtcacaggcacacgaaaggcacagcctactgatgcactatttggcctgtgctgtgaggaggggggtgcagagggagagaggaagagagaagaaaactcctttcttctatctctaacctaggcatctagtgcatttcagtcctgaattctttcagggctcagctgaaactgttacttcagaacccttccctgatcaaggtcaggccttccacgggctttttgtagcttcctgtgcttgtctctaccagcacttattattattaccatgaattacttgtgtaaatatttattatctgtgtcagtggatgataagcttcatgagagcagagattggtgtctgtactatttatttttgtattcttatgcaggaggcctgagacaaagtgctaaataaatatttgttgaatgagtgagtgaggcaacaaatgaatcaatgagatacacaagaacatatgtataagaatgttctttggaaataacctagagtctagcaagagggaaacaaatcatggagatccatttgtttgaatatgtcattgaaaggcatatctcaaaaaatatttactaacattgaaaaattctcagaatgtaaggttaagagaaaaaagtagggacacaaaaattgacatatggtatgattcctttttctttttttgacataaagaaaatacagagaattcttactattcatggtagttatattctataaggtcactacaaacactgaattgcaaatactgaatgattgcacctaggggaaatacagagttaggctcctgcaagcctctggtcacaatatttttgtcaactgatcaatttataaccttgttttatatgtgtttctgtttaaagacaccttcttttaatatatattattgattacttaacattgaaatcatgaccaacagcactgtcacttatgcctgaaagaagcttatctaataacacacgtattttctcaagacacatcacagtcttgctatgctttggacaccagacagtgcttcagctccatgctgcaggcgattttaaaccacaagaccactaacaaaaagcatataaatatgaaaaatatagcactaagtagatcttagaaaagatacttgtttacagtatgagagctgaaacaagaaggagaggcatcaccttgtttgacttcgcctgggcatgtatgcatcagccaactcaacctttttgctgctctgagcatgtgcatgcccacaaataactgaaatgcactgtgagtattgatttgcggttacaattcaattttagcaagtaggggaatttgcaaatacaaaatctgtgactaatgaagattgactgtatgtccttaaaacaaaaaaaatctcagggcaaatctgcccctcgtggtagcgggactatggtgacataaacatttaaagatgtatccttttctttaattcctcaaatttctaaaattaacttgtattattgtataagtaggaaaataaatattatttttcttttattaggaaatggcaaaatgtgatgggcagaatatatatagagaaagggtagcaaaaatttctttggccagctgtggcacagtaagtttaaacgtaaacagccaaaactgtcagtagagtagtttcaaaaacatattgagccataactttgaaatatattttgagccgggcacagtggctcacgcctgtaatcccagaactttgggaggctgaggcgggtagattgcaaggtcaagagtttgagactagcctggccaacatggtgaaacctcacctctatcaaaaatacaaaaattagccgggcatggtggtatgtgcctgtaatcccagctactcggaaggctgagacaggagaatcacttgaacccaggaggcagaggttgcagtgagctgagatcgcgccactgtactccagcctgggtgacagagtgagaccctgtcttggtgggaggtgggggagcggggggagggggaagaaaaaaagaaagatattttgaattctctcttatatgacttttgtgaatggccaaagtatcattctgtagtcaggaacaggctgactttttgagccagggcttcaagctgaacaggagaaagagacataagcatgaacaagacctatctctgcaagcagaggtcagccacttgacaaaggcagtgcaaaggggatggctttctccggaaatccctcgcttcagctactcatcctccacctcctgccaagtctaggttaggttcccctcagcagaatgtccttctctgttctagcactccccacactgtgttgtcattacctgtatatgtctgtgttcccaactagactttaagctctatgagggcaagggctgaatgtagcttgctcactattgaattacattgcctgacacattgctttgcacgcagtgagggtgaagtaaatatttgttcaatatataacggaatgattatgcatcaaacaccccaactgatagcgactcctgtgagaatcgtcctctttaaatataagtcggtgtcagaaacaacgccaaacctcaaaaaagaatattgaagagttcaaatgagaaaattcaaacaccccaacagacagtgcctcctgtcagaatcgtcctctttaaatacgaagctcagtgtcggaaacaacaccaaatacaagaatagtgaggagttcaaatgagaaaatttcagtcttaaaaaatagacaagatttcatatactcaggcaaaaagagatagaaataagaatctgcctacgtgtgaaaggcaaatacaattcctgtttcctttatcttcttacgattgtacaccctgttcaaccatctttgggcttgtgattactgggtagtacactgctatttcttgaagtgtccataaacacagatagcagagctcaattcctgaaatgtgctcctgtttgataaggtggattggactggatcttgttcagcctttaatctacttccttaagcatctgaggatgttccaaactcaaggctatttcagtacctttgtatttgcaatgtatgatgctttaaaatgataactgtattaactttctatggcctttataacaaattgctgcaaacctaatggcttaaaacattgtaaatttattatcttatagttctatttatcagatatttgcccagatcttactggacaaagattaaggtgttggcagggtacattctcttctggaggctctaggagagagtccatttccttgcatgtttcatctgtagaaggggggctgctttcattgtcttgtgcccaccttcctccatcttcaagaccatcaggctgagttcttcccatgctaccatctctctggttccctcttttcattcccccttccactttcaaagacctttgtgtgattaagcccagcaaaataatccagaataaaaaatcttattttaaggccaaccgtttggcaaccttaattccatctgcaactttaacccacctttgccgtctaccctaatatattcacaaattctggggagtgggatgtagacatctttgggagttgatatagtttggatgtttgactactccaaatctcatgttgaaatgtaatctccagcgttgcaggtaggacctcctgggaggtgttgggttattggggtggatccctcgtgaatggcttagcgccatccccttggtgatgaatgagttctcagtctattagttcacacaaatgggggttgtttaaaagagcctgggctgggcacggtggctcatgcctgtaattccagcactctgggaggccgaggcggttggaacaactgaggtcaggaatttgagaccagcctggccaacatggtgaaactccatctctactacaaatacaaaaactagctgggtgtgggggcacgtgcctgtaatcccagctactggggaggctgaggcaggagaatcgcttgaacccgggaggcagaggttgcagtgagctgagatcacaccattgcactccagcctgggtgacaagagcgaaactccacctcacaaaaaaaaaaaaaaaaaaagcctagcatctctcttgccacatgacacgctggctccttttcaccttctgccatgattgaaagcttcctgaggccctcaccagaagcagatgctggcgccatgcttcctgtatagctttagaaccataagccaaaataaatctcttttcttaataagttactcagcctcaggcattcctttagagcaatgcaaatggaagaacacaggggcaattgctctgcctaccaaaataaatgtacacactattatatatgcatacaaactaggaaatatagtcatttatatttatcaggattcaaaatatcatgtccctatcccaactgtctactgtctgtcccctcactgcccctgaaaaaaagaaaaatatcctaagatgcaaacactcaaaccatggaatgaaatactcttggagataaaaaagtcaaatacttctcttgctatgcggatttaagagaaacatctccacagtatcagttgtgtgggagtttatgtgtaggaatctaactgctcatgagttatctccatgaagtcccgctcacagtatgaatagatgggatcctgttataatctgcttactgtttgccttgcagttgtgcatataaattatgtctaaacccttttcttcttaatcattcttctttcagaaattttgtttatctttctaatttgattagacaaggctctcctatcccccactgcttttttaacagcacagagatagcaggaggattgatcagtgactggagatccacaggggtgataagcttttctgtatatttatgtagaaggcaaaacacagcagaatgagaaatatcagattccagatttcatgtcccatatgtccccatccaaccctgtatcatgcattaaacaaataaaaagtaacagaagggcccagcatgttggcttctgcctataatcccagtactttgggagatcgagatgggcagatcacttgagctcaggagttcgagaccagcctcggcaacatggtgaaaccccatctctacaaaaatacaaaaattaggcgggcgtagtggtgtgcacctgttgccccagctacttgggaggctgaggtagaaggattgcctgagcccggaaggtggagtttgcagtgagctgagattgtgtcaatgcacaccagcctgggcagcagagccagaccctgtctcaacaaacaaacaaaaaaaaaaaaaaaaaaaaaaaaaaaaagggagagagagagaggaaataagtaacagaactagcagcatttcatattccagctaccttttccccatttacaaactcctgagtctgaaacatttgttatatttggttttgagtgaaaccagaatcaataacaaatttgttttgcattcattcctcaatatatttactgcgtgaatatggatcagcagggatggtgtgagactgccacactcaagctgggcgtttgtgcaatccacatcaacacttccaatactctcaagcaaggccaataaatcataaagctcatgtgctactgaattcagcacttcaccatcggcaaaatcaatggagatgcttccagaattttcagttttacagcttcttgaacaaatcttttcccctagtccctctctttgtctgtctggctaaggttgaggcatggacactgggtttgcctcctctccatccaccttctccatccccttttgagaaatgaccacgtggttgaggtcgatcttgtagtcaagccaattgtggtttttccatccctattcccagtgaggcaacttgttgcatgtcattcccctggcaaccaagactggttcagtttgggttgattcgatgctagcagaagttttttggggcttctaggtaaagcgtcctcatccttaagtgaaagtctcaaagagtcatctttccccatcccaaactgattctagaacttctgcaggcatcttattatagatctgatgaagtaactgtcctagaagaatcacagggaggtggagctccttccctatccctgcactcacctctccagttatgcaggaatatatgcattattcttttgtttgtttaatcctgtttgagttggagttttttgttatatttcctcattcattcaacaaataattacaactgtctgctgtgtacaggcactgctttaagcaatgtggattaaaagaacaaaaagggttcctgccttccagtaggaagagtttaaaaagcaaataataaatctaataaatcaggaaactcaacaagaacaagataaagaactagagagtgacaggagctattgggggaaagatgagagcagctgactaattttaaatagggtggtcaggtttcacctcattgaaaaatgtgatttggctcacacttggaatcccagcactttgggaggctgaggcaggaggattgcttgagcctaggagttcaagaccagcctgggaaacatagcgataccttatctctactgaaaaaagcaaaaaagaaagtacaggcatggtggcacacacctgtagtcctagctactcaggaggctgaggcaggaggaccacttgagcccaggagttcgagacggcagtgagctatgattgagccactgcactccagcctgggtgacaaagcaagatcttttctcaaaaaaaaaaaaaaaaaaaaaaaaaaaagtgtgttttgagtagacttttgagtgaatgagcatttgtggatatttggagaagagttttctaggcagaggatactgccaacacaaattccctaagttggaagcttgcttgggaatgtgagaggagaaaggagtggtgggagtgaagtgagggagggcaggggttaacagggagccctgtgggtcttttagcccagtgcagaagcattttgtttggctttgactctgattcaaatggggaaccacagaaggcttttgagtagagtgaaaaagatcactctagctactgtgttgggaaaggattttggagcagtaaaggaaggtgcagggagctgacttagaaggccacagtcccatgccaggctggagatgctgcagcagtggtccagggttgtagtgatgaaggtggtgagcagtggtttggattctggatatgttctgaaggcagagccaacaggatttcctgagtataggggaatgtgggagaaaagcaaggagtcaaggatgactccagctgaaagcaacctaaatcattaactctcaaatttacctgacttgattatcagctatttacaactcatgaatgttacataccatggagaagtccaacccaaacacagggttcacacgcaaaccagtaatttgatattgagggctctacatgttccattaatcacatccccctacttaaaatattttccttggctgccttttaagaataaagttattttccatagtctttgagagttaactcaggtaggaccgaagtgatgaccgttctgtcctctgcagcaacgccattgccctttatccttgttgtgatgtggttttcctgtgtcttctgctgctagatgtgatgacgatatccctcctttgttgatggactcagcatctgtacatgggatattttgactccaattttcctgatgcatcatcctaattgtctggtagttactgactgtcacttaccaaccggtgtgagatattcttcagctcttcatcaggaacagaattacagcctctatctttagaaatgatatatgctgaggattattcatgtttgtaattacaaatctagcagaagtgcaattattaaaaaaaaaacccttggaaaggacattttgttgtataacgcagaacctgctgttagcctcttgtgctggtattacttttgttgctgtaattgccacctgcatttcagttgtaatttaacattatctgtcttctctgtatctttctacctgattgtaattgttaggactcctgccatttattcttaaatactttcttgtctttctgaattactgggctattttctatgattataacctaagaaacagctgcagcaacccttgttgcattgtaaaaacttcagagggctggtttatctctagtttaaaaccagtgaagcaaacagtggggggaccttcggaggtcattcacataaaaccatcattttaagaatgaagaaactgaagcttttgagtgattaactaagttgctcatgatcatttacattcttattgttatgctgtactctggagtagcaagtatggatatatattcagagataggatcttttaagtcctagcactttgcaatttatgctgattaaccaacgacctgccaaacagagctcaagatgggaagggaagcgacactaaatcctttttttgagccagatactgctaggtgctttgtatcatggaccacattgatatgcacaataatctgatgaggtaggaataattatgccaatttctctctctctctctctctctctgtctctcacacacccacacccccccccacacacacacatgctgggatttttgggagattaagcaacaggctcaagagcacacgggtagtaactctcaaatagtaagaactgcttgactttccaccctttctctttctaccaaatcaggaacagaataatggatatcttccaaaggggtgagatatgagcatgagctactttttttttttttttttttttttgagatggagtcttgctctgtcgcccaggctggagtgcagtggcgtgatctcggctcactgcaacctccctctcctgggttcaagggattctcctgcctcagcctcccaagtagctgggactacaggcacgtgccaacacacccagctaattttttgtatttttagtagagtcagggtttcactgtgttagccaggacggtctcgatctcctgacctcgtgatctgcccgccttggcctcccaaagtgctgggattacaggcacgagccaccgcacacggccaggtatgagctacttttaaggcagttggaagcccaaagagcttgggaaaccatgaagactaggcctcacaactgcagttttctcaggcctatgcagctgcctccatccttttgctctgagcaaaactggacctagttaagcaatgttgcccaactgttaaaaaaggaagctcaaaactaggaggtaggatgccagataatttgtttaaatttttgatctttaaaatcttgactctttgagcttgttttgagcctcattggtccaaagtggctcaatctgactgaggaaggggttggaggaggaaggaatgtaaaaatgaaagatcggtgggaaaaggatactgccttaggttgtctgtaggtaaataaaggtttgactctataaaaactctcttcctgaaataatcaagaatgcttcacatcagaagcatcaattaaatggctgccttctttttgttaattctttagtctttagctatttctgctgttgctgcagaggcagagagatggtgaaagaatcaacctcaggaaatagtatggaggtcaagggtcagctaagaggatctactgattttctgatctgcggagctttctgagtgagtctcccttgaattgcaggagggcatccaataggaaacccagtatgcaacaatctcaagagatagcctctagaacactgggattagcattaatccatgaaaatgaggtgctataatgatgatgatgatgagactagaacctatagttacatgcattgtgggaaaggtttgaattgaaaggctgaaggagggagtggttgtcttccaagagggtatgatggtcatgctgaatgaagaatgaagtgaaagaagtcagtgaagatgcattaagaccgtaggtcaggttcaagtagtaactcccaagggttcaaccacataatgacgcattgaaggatgtctattacaatcataagaaacagcaaagtggttgagtatagtggctcatgcctgtaatcccagcactttgggaggccaaggtgggcagatcacttgaggtcaggagttcgagaccagcctggccaacatggtgaaaccccatctctaccaaaaatacaaaaactagcagggcatggtggtgcccgcctgtaatcccagctacttaggaggctgaggcaggagaataacttgaacctgggaggcggatgttgcagtgagttgagattgtgtcactgcactccagcctgggtaacagagtgagactctgtctcaaagaaaagaaagaagaaaagaaacagcagagtgtcccatctgtcctgcgagtcctaaggaaactgattaatggcttcaaaagtttatttctcatcaaaatgaacttgattaattacaaatccagattttttagtcctgccccccaaaagtctgattttaccaatgaaaataacccccaggtaattcctgcaagcagcctcactggaaacatctggggtaggtgaccccaacttctgtcattgtgagtttctgtgtgctacctttcttttttggtttttgtttttaataaacagggtgttgctctcttgcccaagctacggtgcagtggtgcaattatagctcacttcagccttaaactcctgggttcaaggaatcctcctgcattgctgggattacagatgtgagccactgtgtcaggctctctgtgtgttccttctaatagtacttctagaacatctcttatttttttcttttccagctcggagattcttaatttgagtttctggggctcaatgaatagggcccaggggatctacaacccccctgaaattacatgcagaatttcacatatatatgagctatgtgaagagtctcaaaggaatctgtggtttccaaagggtttagaacaattgctccaactgttctatttatctcctttctgccctgacccctggagctggttcacagctttttatcctggccagtcttcctggctttagtggacagtacatttgtctttgactttgaaactttacattaactatgagacatagcgtgaaactttggaaagagaggggatcacttctatgtttctattaaaattaatttcctttggaagaatatgcctgtgacagttttcatagaacactgctgtccccattttaatgagaaacaaaaaaattcatccacgtcaccaatattctattgtgtctcttttctcccagaagccgatctctttgctaaaccatcttcagcacagctccagttgaagtcctttgcttgtctgggtcctttgttgccctcccggtgttctgctgtccacagaatatagccctgactcggtagcctggcatctgtgccctttgcaatctgactacctcctgctgctctcctaattgttccatgttccaagctaactgtgctcctcgccattgcccaagccctgtctgtgccctcttccctctgggcctacaggggatgccctccctctcctctccatctgtcaccgtgtacccttgttcaaggccttcatcccatctctccgtcagccagaaatttcctcttctgtgaacatcaattgtacttggttcatacgggtcttatggcatttgttacatattgatttttgtttgattatgcatgatttgtgtttctcttttttcttattagattccaagacctttcatcacagggcctttgttgatttaactgtgtatctggtcaattgcctgtcacagtacctagcatacaaaaagccctcaataaaatctggtgaatgtatttaaaaacctagatagggctattttaattcagaaaaataaatctgtttgccttttttcctggtaatctaagttgggcagttgcacgagaactgcatataaactgcattcaactcttgataaattagaaaagtcatctgatggcttcattaaaatgtgggctttaaaattatttatgatttcatttttcataacatctttgtgagacttgtagtagtgtagtattccccccgtcttttggatggtgatttcactgaggtgagaggttaaagtgggtcattcaaggccacagagcaggcaggtaacaaaactggcactggaaccttggcctcctggggccacgttagcagagcgtagcattgactgcactaaggatggaatacaaatgtgcttacacattgtcaaatcctgtgggtcaaaaagtttgttttagtgaaagcatcacagataatgaagtatttgaaattttctcttttcaccttttggcatgcaggctcctctctctctgttccctaaataaggacacgtctgtaggtctgatcctcagccctgtctgtctgtgaccttctccagtatccaggaccctcggcgatcaatacctgcctcgtggtttcaatgatcatcactctgctgacttacctaacgtctttgcctatggtgatgacccctgcctgctctccacctcacatctcttgtggtttaccagaagtttccacttagaattctgccatcacttcaaaatccagatatctaaatccaaactcatcatctgctctctgaacaaacttactcctttctcaatctacatttttctaccataattctcctagtcatccaagttcaaaatcattgttatctttaacttcctttatttttttaagagacagcttctcatcccactgcccatgctggagtgaagtggtgcgatcatggctcactatagtttcaaactccggggctcaagtgatcctcctgcctcagcctcccaagtagctaggactacaagcacacatctctgcactcagctattttttttttttttgagacagaatctcactctgttgcccaggctggagtgcagtgctgtgatcttggctcactgcaacctctgcctcctgagttcaaacgattctcctgcctcagcctcctgagtagctgggattagaggtacctgctaccacacacaactaatttttgtatttgtagtagagatggggtttcaccatgttggccaggctggtcttgaactcctgatctcaagtgatccacccaccttggcctcccaaagtgctgggactacaggtgtgagccactgcgctaggcctaatttttaaatttttgtagaaatggggtcttatgttgaccaggctggtcttgaactcctagcttcaagtgatcctcctgtcttggcctcccaaaatgctgaaattacagaaatgagccactatgcctggcctgttattttcagctttttaattggctttgtcttattgatacttccttcaaaatgtttatcatgtccatttgagaatctagagtggtttttttttttttttttttttttttttttgccaaggattacctctttctctagagccctccacctcatgcacattcctttctttctattttcattaccacattgtgatctaggtcttctcttcctcttccttaaatttcactggtgttcattttgttacaggatgaaatccatagtcttcaacctggcatacaaaacctcccacaagctgactccagttgatctttccaactttctagtctaatacttgcctctggtaattttttttccaattcttctgttgactgtcctggaatgcatcttacatggccttgctttggtcctcagtttagttcttttattttccagtttactcctttggatacttctcatcttcaaggtccagctcatgtctcatctttttgatatgaccattcctaattatttaaatccatattctgaagttcttggcccttgttgtctacatctttgctgctcaaagtgtcattaaatgagcagcagcattgtcaccacctggaagatggttagaaatgaatcttggggctctgcctcagacctgctgaattcaaatctgcattttagcatgatccttgaagtgatgcatgaaacacttgtctgtcccatttagatacttagataatactcaatccaaacaccaacttatgtacttatctgcactcctcaagatccttgaaatctgcgaacctgttttatttttctttagtatctctgaaacacaatttcatggtaaagtaggtgcttactaaatagattttagtgtccttctctttctttttctatttaaaggaggaaaaaactcccaagactcctagaaagtgagcatgagctgctatagtttgaatgtaacctcttcaaaattcaggtattgccaatgagatactgttaagaagtgaagcctttaggatgcgattgagccattagggctcctcccttgcaaatggaacaaggtcagcaaaccaataggagtgctaaggtaaatgactgtagaacaaaatggtgtttatgtagcttgatggtacatgtaatttcacaattgcattttgtgtctgaaaaacatatgaggttttgctaagcttagtagagaaatgcctgctttgtggcaatgttgtccattagttaaccagagagaaatatgagaacagatgatgtcactatattcttccactagcctaggttcttaaaagctctaagactacaagtgttatagatgactccagcatgcactcatactgctacttaactttcttcatggaaatgtgtcttattctgtcaacagactaaaagaggggcaaggacatatattatataattttgtatatactcgataatgctcaggacatagagcttcagttccttccctccctccctccctcctgcccaccctccatttctttattcctgcctttcatcctttaagtgtttgttgagtgattgagatcaaatattgatatattgtatctatagaatagaatattctattctagtgctattatatatgctggggataaatcacgcattaaaatgaatgtccttctctttatggaacttgcattccagtggagcaaaaagataaacaaaatcataagaggaatttatacttagaggacgataagtactgcagaaaaagattagagaagagggcttggaattggggaggtatactttaaaataaaaagccagagaagaccacctttgagaacataatttaagaaaagacttgaaggaggtaaattatgtagctatctgagggaagaccttcccagagagtggaacagcaggtacagggctgaggtgggcatgaacagggaagagtaagaacggtcttttgggtttgaagtagaaggagcttgcaggagaatgacaggagagatgaggtcagatattacatctcaataggatctctctggctgcaatattgagaaaagccagaagggggacaaggtggaggtgggaagacgaattagaaggccactgcaataatacagacaggagatggtggtggcttagaccagggaggcagccgtggaagaggtgagaggcagttacattctgcatatattccgagagtacagccaacaggatttgctgaaagattgaatttggcatatgagagacagagaggcatccaggatccaggcatttaagatttttggcctaagcaactagaaagatgcagctgccatcaagtgagatgggggaaggctgcggtggagaagtcttttttagggaagattaggaacttagctttggcaatgttgagtttgacatatcttttagacaagtggagatattgaggaggcagttgaatattggtggaatgaacgaataaccaggatcttaatcaagtgtttaactcccttaaacataaatcaactttttgtctacttcctcataatgtgaagcactttgggatgtgacattggaaatcagactcttctgaccaaggcccaggtctgcctgaattccaggcctagagatctgacaatgtgctggccatcttcccttaaatgttctctagagccacaccatgtctaaaatggaacgcactctctttatcccaagcctggtctccctctttgtgactgtggtgagtgggcaccactaggcatgtaagctggcagtcacacttcattccttccatttcctcatctccatatctaattggtcaccaaatcttaccaaccccacttccaaaccatctctagaacccatctcccccctccgtcttcactgctgcttttttggatttatgctctcattgtctctcacctggattatatgtaaatcttctcctacctggtttcccagtctccaatcgatccttcacatagctcccagagtgattttctaaaatgtaaatgtggccatgttactcttctgcttaaaacatttccaaaggctttcttctgtccataaaacccaaaacttgagtttggcctgcaaggatcatcaagatctggctcctgcttatctcttagatttattatcccccccatcccccccgtcactcctatccattggccagattatactacctgtagttagttaacttattcattcaattttcagatataaataggatgcttcatatgttacaagcactatgctaagctgtgggggatacaaagctagacattgaaaaagcctgaaataaacctggttgtcttccttcctacttacttacagtcgtcatacagtaagctgtggggatacaatgctgcattgtacgcagacttggttcctgccctcatgaaagtatactttctcaatttccatgcctttgctctctgaaccccctgccttgaatttaccaccatctgctcctccctccatctcactgccatgtcctccttctcctaccagctacttaaagaataccatctcaacttttaagaatcagcttacatcattcccttgtattaagctctttactctatctccttttctcttctaaaaatgtttcctccctcaaaaggtatcattgaaaaacttaatagctctagaagtgaggatatctctaaatacattccaggttcagttcagaatattgttttatcttatactagaagatcatagctcaaggaatgggatttccttctttatcccaaaagggaaaaaagcctccttttcctggatttttcccatgctccttgggctccacaagtgggataagcaattgttaacttgctgcagagtgagtgaacccaattgcattggattcacacacagtggatgctccaggattttttttaaatatttatttatttatttatttatttatttatttatttatttatttatttattttgagacggagtctctctctgttgcccaggctggagtgcagtggcgtgatctcggttcactgcaagctccgcctcctgggttcacgccatgctcctgccttagccttctgagtagctgggactacaggtgcccaccaccacatccagttaatttttgtatttttagtagagacgggttttcaccatattggccaggatggtctcaaactcctgaccttgtgatccacctgcctgagcctcccaaagtgctgggattacaggcgtgagctgccatgcccggccttcaggatttttaaatagtaaagcgttaggggtggtgagctgattggtaggggtgctaggaaacttgtcttaaagctaagtttgcatagctagcttacaattttcacttagattaatatacatagatttatagtagcttgtgggggactgataaagatgtgggttaaagattccttttaaagccatcccttaatgctaccactgtacagaaagatggcagagtgactgcctttatagacacctgcccacacttcctaatctgccctcagttgcaactcctagagagtaggcacacagcttagggtggaaaatacatgaaaattcagtacttgtaaatagatgggaggtgggtaatgaggatgagcgacagaagaaaaaaccttctatatttgtctgttctcaccacctaaggggttcttcagaaaaccagtgagctttacgctcaggttgagaaatccttgttacagtcactttaattgcaatctctatttcttctctctttttctttctctctctgtgtctctacacctctccctcaccactttctggatatgcacacatatttacattcagatgattttagaaagctccattggggaataactataaattatgaatatgcaacagcactaaaaccaactattatagtcaaaaatcctgaaataaacctcctggttctcttccttcctacttacttacagtcagcacacagcaatatatcttagagtgaggctaaatggatatctgatactcactcgaatgtgataggcagtcaacaacccagttatcactgttgaagcattttaaggactacttccatgtcactctggctatgataaaaaccatagtctccaaattggtacagtaggatgaaccttccatgacgactggtagcatgtgtttgattacacatatgtatacatacatgtacacacaatacacatacctaaacattataaccagattagtatattccttttgcattgtactgaatactttaaaataatgtttcatcagtgattgtcagagttataaaatcatttgaatatattaataagctataaacattttaattttaaaggataaaatatgctgcacaaaagagccagtacagccactgcttatgtgtttaatttatttaaagagatgcctgttctgttattacttcaaatatagttatatctacatgtaagtgattttaatttgctacaacatttagatgtatcaatgagacatttcataaattaaaattgtatcacgtagggagactatcttgattatgaagctttattaggtgatgattataagtgccttgtttaataattataacagcttaatggctcctgtagttatactttataataaaaatttcacatttaataatatggaaagggatggtacacagtgaactgacaaaaaagtattgattctgaacctttaaattggattcctattgatctgatgtatgaatattttattggtgtaaatgttttcagggttgccagtttctattactgcatgttagcaattttactggctatgtataatggacaaattaaatgccaggatatgggcatatccagcaccccacactgattattttgattcacttatcactatacactactagggccttccctttctctgtcccatctctgttctggaaggtgagccacagacttcttctgtacatgcctcagatacatgacaagccagtgatgggtggtctggcttgttatctggtagaggctgggtgggcatgtgtctcttcctgctaaggcccacagccccttagctaagacttacacatttgctccaaggccagtcatttgggcccgagtacctaatggataataacaggggctctgggattaggtagagcaagatggctgaacaaaagcttcaaccaattgtcctccccacaggaacaccaaactgaacaactatgcacacaaaaaagcaccttcataagaaccaaaaatcagcttaggtaccagcttggccacagtggagtagagcaccaagcaggctcttggggtccctgattccaggcctagctcttagatggcatttctggacttgccctgggccagaacggagcccattgcccttctgggagagtcccagtcctgccagcattcatcacaagctgactgaagagctcttgtgccttgagtgaacactggtggtacccaggaagtactcaccatggacctagggtagtggtgatcacagggagagactcctctgtttgtggaaaggggagggaagagtagaagaactttgtgttgaggtatgtgttccagctcagccacaatcgagtaaggcaccaggtatattcctaaggtttctgactgtaggacctggctcctggatggcacctctggacccacccagggtttggggaattcactgccctgaagggaaggacacaagcctggctggctttgccacctgctgattgtagaaccctagggctatgagcaaagataagcaatagccaggcagtggttaccacaggtgttgggtgagacccaatgctgtgctgacttcaggtctgacctagcacagtcccaagggcaatggccacaagggtgcttgtgtgatcccacccacagttctaggcagctcagcacagagagagagagagagagatgccatttgtttgggagaaagtaagggaagagaacaagagcctatgtctggaaatccaaagaattcttccagatcttatccaagaccaccaagtacctctaagagaccgcaagagtcacagtgttactagactcgaggtgccccctaatgcagttatggctacagtgaccaaaaacttagatcacaacactcaagtccctttgaatacctggaaggcccttcccaagaagaatgggtacaaacgagcccagacttagaagactacaataaatatctagctcttcaatgcccagatactgacaaacatccataagcatcaagaccatccaggaaaaataatcttaccaaacaaactaaataaatcaccagggaccaatcccagagagacagagatatgtaacctttcagacagagaattcaaaataactgttttgaggaaatgcaatgaaattcaagataacatagagaaggaattcagaattctatcagatacatttaacaaagagattggaataattaaaaagaatcaagcagaaattctggagttgaaaaatgcaattaacatactgaagaatgcatcagagtctcttagcagaattgatcaagtagaagaaagaattagtgagcttgatgacaggctatttgaaaatacacagtcggaggagacaaaagaaaaaaagaatgaataagaatgaaggatgcctccaagatgtggaaaatatcctcaaaagggcaagtgtaagtgttattggccctaaagaggaagtacaaagagaaataggtgcaggaagtttattcaaaaagataataacagagaacttaacaaacctagagaaaggtgtaaatattcaagtgtaaaaacaccaagcagatttaacccaaataagactacctcaagacgtttaataatcaaactcccaaagatcaaggataaagaaaggttcggaagaaataatataaatagagttccaatatgcctggtagcagacttttcagcggaaaccttacaggccaggagaaactggcatgacatatttaatgtgctgaaggaaaaaaaccttttatcttagaatagtatatccaacaaaaatatcctttaaatatgaaggagaaataataactttcctggacaaacaaaggttgagggatttcatcaacaccagacctgtcctacaaaaaaatgctaaagggagttttcaatctgaaagaaaaggacattaatgagaaataagaaaacatctgaaggtgcaaaaaactcacaggtaatagcacagagaaaatcacagaatattataacactgtaattgtagggtataaactattcatatctcaagtagaaagactaaaagatcaaccaatcaaaaataataactacagccacttctcaagaaatagacagtacaataagatagaaatagaaacaacaaaaagttaaaaagtatgcagtgggggggaatgaagttaaagtgtacagtttttattagttttctctttgcttgtttgttagtctatgcaatcagtattaagttgtcatccatttaaaataatgggttataagatagtattttcaaacctcatggtaacttcaaatcaaaaatcatacaacagagaaaaaatatgcaaaaaataaaaagcaagacattaaaacataccaccagagaaaatcacctttactaaaaggaagaaagaaagaaaagaaagaaggaaggaaggaagagaagaccgcaaaacaaccaggaaacaaatatcaaaatggcaggagtaagtccttacttatcagtaataacattgaatgtaaatgaactaaactctccaatcaaaagacagagagtggctgaatggataaaaaaaaaaaacaagattcaacaatctgttgcctacaagaaacccgcttcacctataaagacacacatagactgaaaataaagggatggaaaaaatatactatgcaaatgtaaactgaaaaagagcaagaatagctatacatatatcagacaaaatagatttcaagacaaaaactataagaagagacaaagaaggtccatatatgatgataaaggggttacttcagcaagaggatataacaattatatatatatataatatataatatatattttcacccagtgctagagcactcaggtatataaagcaaaaattactagagctaaagagaaagatagacctgaatacaataatagctggagacttcaacagtttcagcattgaacaaatgatccagacagaaaatcaacaaagaaatatcagatgtaatctgcaatacagaccaaatgcccttaatagatatttacagaacatttcatccaacagcctcagagtacgcattcttctcggcacatggattattctcaaggatagactgtatgttaggccacaaaacaagtctaaaaaattcaacaaaattgaaattatatcagtatcttctctgaccacaatggaataaaactataataaatcagtatcaagaggaattttggaaaatataaaaacacacggaaattaaatagtatgctcctgaatgaccagtgggtcaatgaagagattaaaaaggaaataaaaaaatttcttgaagcaggtaataatggaaacacaacataccaaaacctacgggatacagcgaagccagtactaaagagaagtttatagctataagtgcctacatcaaaatagaagaaaaatttcaaataaacaatgtaacaatgcatcttaaagaactagagaagcaagagcaaaccaaacccaaaattagtggaagaaaataaataaagatcagagaagaaataaataaaattaaaatggagaaaacaatatgaaagatcaatgaaacaaaaagttgggtttttctttttctttttttcctttctttttttttttctgagacagagtttggctctgtcacccaggctggagtgcagtggcatgatctcagctcactacaacctgaacctcctgggttcaagcaattctcatgtctcagcctcctgggtaactgggattacaggtgtgccaacatgcctggctaatttttgtattttttgtagagatggggtttcaccatgtaggctaggctggtcccaaactcctggtctcaagtgagccacctgctatggcctcccaaagtgctgggattacagggatgagctactgtgcccggccaaaaaaatgattttcttaaaaagataaacaaaatttttgtcagttgacaagacttaaatctaagacttcaagctatgaaactattaaaagcaaacattgggaaaactctccaggcaagtgatttcttgagtaataccttacaagcacaggcaaccaaagcaaaaatggacagatgggatcacatcaagttaaaaagcttctgcatagtaaaagaaacaatcaataaagtgaagagacagcccatttaatgggagaaaatatttgccaacgatccacctgacaaaggattaataaccagaacgtataaggaacccaagaaactctataggaaaaaaatctaggccaggcgtggtggctcatgcctgtaatcctagcactttgggaggccgaagcaggtgaatcacctgaggtcaggagatggagaccagcctgaccaacatggagaaaccctgtctctactaaaaatacaaaattagctgggtatggtggcccatgcctgtaatccagatcttcgggaggctgaggcaagagaattgcttgaacctgggaggtggaggttgcggtgagtcgagatcgtgccattgcactccagcctgggcaacaaaagcaaaactccgcctcaaaaaaaaaaatctaataatcccattaaaaactgggtgaaatgtctgaatagacatttctcaaaagacatacaaatgaccaacaggcatatgaaaaggtgctcaacatcactgatcatcagagaaatgcaaatcaaaactgcaatgagatatcatttcatcccagttaaaaaggcttttattcaaaagacaggcaataacaaatgctggtgaggatgtggagaaaagggaactctcgtacactgttggtgggaatgtaagttggtacaaccactatggagaacagtttggaggttccttaaaaaattaaaatggaactatcatgtaatccagtaatcccactgctaggtatatacccaaaagaaaggaaatcagtatattgaagatatgtcttatctctgtactcccatatttgttgcagcactattcacaatggccaagatttggaagcaacccaaatgttcatcaacagatgaatggataaagaaaatatggtacatatatgcaatggagtgctatccagccataaaaaggaattagctcttgtcattgtcaacaacgtggatggaacacgaggtcattatgttaagtgaaataaaccaggcacaaaaagacaaacttcacatgtcctcacttatttgtgaaagctaaaaattaaaacaattgaacacatgaagatagagagtagaatgatggttaccagaggttgggaagggtattgagggtgcggggaagggacggtgagacagtggggatggtaaatacgtataaaaatatagttagatatttagaattaataagatctagtatttgatagcacaacaggttaactatagtcaacaataatttattgtacatttaaaaataatcatttgtaacacaaagaaaggataaatacttgaggtgatgcatacccatttgcccatgcaataatgcctgtatcatgcctgtatcaaaacatctcatgtaccccataaatatatacacctactacatacctacaaaaataaaaaaaaaacccctggactctggagtcagattcattcaattcaaataatatttattgagagccaaatagcagacattgttccaggtgctaggaacagaatcgtgatcctggcttcatggacttccattctcatgattgcctaggttcaaatcctaactctacctcataacctcaggaaatatgttttactgtctgaacttatctcttaatttgtaccagattcatgtttgttgcaagaatttacagaggcaatgtatataaagcatccaatatcatgcctagctcattgcaagtgtcacttatttttatttttgggtgaaagtctgatgcaagccatatttatgccataaatttaattggatgtgaatatgatctactagttgaaatgactctgatttctatgctttttaatctagtctgagcagcatttatgatacagtaatggccaaaagacaatgaaaacactattatttatcttaataagacaatcctaagccaaaagaacaaagctggaggcatcacgctacctgacttctaactatactacaaggctacagtaaccaaaacagcatggtgctggtaccaaaacagagatagagaccaatggaacagaacagagccctcagaaataataccacatatctacaaccatctgatctttgacaaacctgacaaaaacaagaaatggggaaaggattccttatttaataaatggtgctgggaaaactggctagccatatgtagaaagctgaaactggatcccttccttacacctcatacgaaaattaattcaagatggattaaagacttaaatgttagacctaataccataaaaaccctagaagaaaacctaggcaatactattcaggacacaggcatgggcaaggacttcatgtctaaaacaccaaaagcaatggcaacaaaagccaaaattgacaaataggatctaattagactaaagagcttctgcatggcaaaagaaactaccatcagagtgaacaggcaacctacagaatgggagaaaatttttgcaatctactcatctgacaaagggctaatatccagaatctacaaagaactcaaacaaacttacaagaaaaaaacaaacaaccccatcaaaaagtgggcaaaggatctgaacagacaatcctcaaaagaagacatttatgcagcccacagacacatgaaaaaatgctcatcatcactggccatcagagaaatgcaaatcaaaaccataatgagataccatctcacaccagttagaatggcaatcattaaaaaatcaggaaacaacaggtgccggagaggctgtggagaaataggaacacttttacactgttggtgggactgtaaactagttcaaccattgtggaagacagtgtggcgattcctcaaggatctagaactagaaataccatttgacccagccatcacattactgggtatatacccaaaggattataaatcatgctgctataaagacacatgcacacatatgtgtattgtggcactattcacaatagcaaagacttggaaccaaccaaaatgtccaacaatgatagattggattaagaaaatgtggcacttatacaccatggaatactatgcagccatgagttcatgtcctttgtagggacatagatgaagctggaaaccatcattctcagcaaactatcgcaaggataaaaaaccaaacaccgcatgttctcactcacaggtgggaattgaacaatgaaaacacttggacacaggaaggggaacatcacacaccggggcctgtcgtggggtggggggaggggggagggataacagtaggagatatacctaatgtaaatgacgagtaaatgggtgtagcacaccaacatggcacatgtatacatatgtaacaaacctgcacgttgtgcacatgtaccctagaacttaaagtataagaataaaaaaaaatgtagtcaattgtggtgagtcataggagggatgccaagtgtggaatcaccacagatgccagtcaaggctcaacgtgaccagctgttcagggtgctttgacaatcccaagccttgaaactacctaaaggctccttctgagtcaaatatcaaaaaaatggatcccaaatgactcctaatatgatttctcccagatgctctttctgataactttgtttccgacgttgatatctgatgctctcctaattactttggaccactttcttcctggaagactctatatggctcttatcattgagcagctctttgcaatgaagatgggaaaagacctccactatcttctgttatgatctaaggccctcgatgaggtacccattgcctccatgtatcttcctgggaaggcctttctgaggctttggctggtatcttaatttcttgtggaatatacatactggtgttctggtgctgtgatgtctggatatgttgaggtattgaccataccctggccagtggttttccttttgtttatatggagagagtccctgctctggcaagggaagagatgaagggaagagagggtagaagaggggaggggagggaagaggaggggagaggaggggaggggaggggagggaacaatttactgtgcctttttaaaaagagatcagccaataaaaaggtagattttggagacagacaaatctaaaaaaaaaaaaaaaaaaaagaaatgaaggttccaaattgatcacctaaatcatacagtcctttatcaaaatgcctggaagcctgtctaggctggaggttggctaacagcatacactcagctgacccggggagtactgatttattttcctatgttagaagttaggcctcatctgaaaggcagagagaagggcatcatcacactctatgccctatggactgggattggggtgggcactggagactattcaagagggcatttttgggaaaataggaagagagctcatggtggaagacagggaaagtaccagtagaagccgcattctgacaacattccacaaggagagaagctaattaaaaatgggaacctgacataggccaactaaatgagtatctctggggctgggatctggcagtgatctttcataagaaaaactcccctagataattctaacatagccagaggtaaaaacaacaacaaaaaaccccactactgctccagactagtagttctcaaagtgtaattcgcagaccagcacacgtgggtatttgtagaagtgcaaattaacaggaccccccaccaccccagatctactgaaacagaaactctgagggtgggactcaggaatctgtgtcttaacaagctctccagtgattctgatgcttgctcaagttggagaactactgctctagataagtcataccagaccaaaaaaacaaacaaacaaaaaaattaggaaggtcaggaaggcaggcagggtaaaatggatcagggtggaagtccactgtggtttccttttgtactttagagaagaatgaaaaacgcacattgctcacttccatacaactttggagaggggaaggtatctaacccttcacctttctctctcctaaagctccttcctaggagccattaaatgacagaggcctcttggttccaagtgggttttaggatttttaaataaaatgcagagactaataatgaaatttgttggaccatcagaaaggacagcagatggcccttgtgcctaggagggagggagggagggtaaccgctttccagaccaggaaaaaataaactaagaataaaaagaaaaccaaatgattaaaactgaactttgctttacttttcccttttatttcatgaaagcagtgtttgggcacagtagagatatgttaataaaattgaataatgtctcttgcactaagttttcagtacaagatgaaaactgcataagaacatgttctaatgatgcgttggttttctcacagtaacatccagcccccagaacattctctggcagcacccacactctcctgtcctagtgaataaacctggaacaaagctgaaaatctgaggagctgccgcctggatggggaaggatatgcttgtgaaatgtagcttggctctgttgctgacttagatgggagtacaggaaagtcattagtttctctggccctcaattttctcaagtaggaaatgacagaaaccacccaaatgaactgaaatgtcaaagtgatctccacaggcccaggaagagggccaggtgccatagccaaacaggatagcagaaaatcgcacaggctcatggtgtcacattctggtaaatgggcatgatgaaatttaactaagctgaaaaactgagaagtttagtgatcaaatgtgggccaaacattctatgggcatttttgttgttgcttattttaatggtcttttcctcctcatactcacatgctgtgcaaaaattatataattatataaaaaatatgaattatataagtaaagaaccccaaccaaatctcaactgattttgtgaaaaagaaatatcttttttttgcttactcttaagttctttttatcagaaaacaaataccacatgggattattattttaaacacaagctgcatttaagagaaagtgtctagtaaaccttctggggctgtaaattagctgctaattttgtttgactaaaggctgtaaaatgcatttctgggaattattgtgcacagagaacatcctcctaatacttcagtgggcttgaacagagaaatggaatcctattcagtatacctgttactaaactgaggctactccacgacccaggctcattctatctaactacatagccagcttttctggatttgtgaaagatgagattttgggaaagaacatgagaaacaatgagtcattcacagacacataagtagagatttgaaattggtgttcagaccatctaatcttcacatttcctcctttgttcaatctcattccagtctctgaaattttccaagggcctgtttattactctgttctattcacctactgctatgttcagttactgccccctgtttctctaatggagttttgctttcaagactgggcacaactcttctcaatatgtatttacatttttcatttccttatacaagttccatcattttttctttatgatagttttctttaacctgtttattcatttgtttcatttgttatattttcatgttttttatcctggtccttattttcctccatgacacctcttcttatacttgatgttgttctctagaatgctgttaaatttgctacctgtctctttcaaaatttacctgggcaatggtagcacacaaagggccatgcagacttgccaatattaggctggtttggcctagcatagtacctggcacacagcaggcattcaatcaatatctgttcagtgactgcctgaatgaaaatagaaatgatatcagtagttttttgcaataatcttaagcaaaattataaactaataacttccactcctttaaatgtgtgtcaacttttctgtactaattggaaaaacatctagttcatgtggatcaaaattgagtctatatgctacgtagggcaaaggcatgcctggattttaacatctcatcctcagtgactctaatggtgcctggcacagaggagatgcccaataagtttatatgaaatggcttagaatggactaccttctccatgcgactaatgatctgttactacttcctgaaaggttagccattattgatataccacttctagatgctgtgacaaatggcacagctcagcagcaaaagtactttttaaagtctatgggcctccacaggttgagtttgaaaaggatctgttaatcctctgaaattacatgtgatttatggggagaaagtttacaaaattattaatactcttgaaggggaatatgacctccccccaccccaaatttcagaaccacagtggataatgaaagtttctatgctgtaagagcaattaggaagtcctgaaaaacagggaatttagtcaggagacttgagttgaaatcctaactctgccccttgctggctgggtgaccttggccaagttttaaactctttcttatcttcagtttccttattatgacatggtgatgttaatgacaagtctctagacatagtggttaaacttcaacttgaacccaaatttttctggctctaaagcccaggctcttaacatctatcatcctacattaattaaatgagataactgatgtgaaaatgcctgatgtaaatatttgttaaagcaacaacaaaaaatgtcatttgtcaaagtaacaaagtattttttaaagtaacaacaaaagagacagataaccacaaagaaaaggccactttagaaattcctctttgacctattaaagaatgttcaagttcaaaatatgtttgtcattatgattaaaaatccaaccccaaaacttgggtgaagacggcataatctgttagtttggatatatacagactaaggggattctttggaataccctttgtctagagtgatcttatgacatggtacggataactagactcacctaacattcaaatgaagggctgtgtgtcttctatactttgtagacagaggtggcagatcatctgcttttaaatatagagggctcccattctgctaggatccagagggaatgagggtcctatgttacagatgtccctctgcctgcacaaaaggctgaagaacaagccatcatggagtgtgggagatccagctgttgtccatttccagaagaggagtgaatagtggcttaacagagaggacccttgcctggttctctttggaaatttcacagtagtgaggccaggtgcggtggctcatacctgtaattctggcactctgggaggctgaggcaggtggatcacttgaggtcaggagttcaagactagcctggccaacatggtcaaaccccgtctctactaaaaatacaaaaattagccgggcgtggtggcgtgcacttgtaagcccagctactagggaggctgaggcaagagaattgcttgaacccaggaggcagaggttgcagtgagccaagattgtgccactgcactccagcctgggcaacacagcgagactctgtctcaaactaacaaacaaaaaatttcacagtcgttatgaacagataatatgctcaggtattagccatttcattgcattgttttgacaagtgacaggaattaggtttgctaatgttggaagaaaaatctcacttgttgcttttaacttaaaccttttatggttttgagataggtttattcactgggctggagaatgaaggatttatctgtattagtcggatttgatcagttttcaagtagctactcagtgtcaggcctatacattatctcgtttaactctcttaacaccatggtaaggttgactgtatcataatctccatttatcagataaggaaacaaagattcagagaagtcaccaagttgagatcattgcccagctgcacacagctagtgagtggtgaagctgagacacaaatcagggcttccgacgccactttctattacactttactatgctgtgcattcgtgtaaaagcatgatatttttaaagtggcattccagctgccagaaggatatcaaatcaagtactaaagacaatattattagaaatggaaatctggactcaccaagaaatgtcttcagttctatataataggaagactggtattttgcttgatatgggtgtttcaatatcatctgctcctaaaatgcagtctagacacctcttgtgacctgctcaggtgatactaatgaagtttgggtcatttttagcatctacagagaacagagtaagagtgctgtgtgttcaatactattgcagacttatgggataaactggattttcttgctttactttataaagctaatgcctgattacaaatataagtttaaaacaaacctcaaaatttcttggcacccactctttgtggttggtaacatggacatctgtataaaatacccaagaccttcatagagcaaaagtgagtgggaaattaatttttattgggtatataatcatcactagccatgttcaaatactttttctctaaatcctttacaaagatcttgtaagttgggtattattacattcagtttagactaaacgaaatgcaaaaaaaaaaaataataaagaaaatagactcacaaggtaaagttgcatacttgagacataacaaaattaaatttcattctatgatgctgccacatagcagatgatacaagcagtatagaatacccataaacattatgttttaaggtatttccacctgtatctttcttggggcaggtaaatgaaactcactataaaccagttacaggtcctcctttatctgaggttttgctttctgaagtttcagttacctgcagtcaaccatggtctaaaaatattaaatgaaaaattccagaaataaacagtttattacgttttaaaatggatgtccttctgagttgtgtgatgaaatctcatgccatcctgctccatccctccagggatgtgagtcatccctttgtctagtgtatccatgctgtctgcccttagtcagccttcttggttgtcagattgattggtacaatggacacaaggtattaccgtgcttgtgtctaagtaacctgtgttttactattattacagtctattgttatagtttctattttaatataagttattgttggtaatctcttactgtgcttagctgataaattaaactttattatagatatctatctatatctatcacagatatatctatagatacgtacctgcgatatgtatctatatgcgatatgtatagatacatatcacaggtatgtatctatagatacatcggtatatatatgaaaaaacagtacatatagggtttggtactaaccacagtttcaggcatccactgggtggggatgcgggtcttaaaacacaacccttgtggataagagaggactactatatggaaagtcagagttagagagcttttgtaggttatgtagttcaatcttttgttttgctggtaaggagaagaatacaccttaattttgacttcttaactcgaaaagttaagaaacttgtctaaggtcacagagctagtggcagagcaagccaagcatcagtgtctccaaaatccagctcagtgttgtttgtgttatatcagaatgagtaagagttaagataagaacatgagtcttacagctccactatccatgttcaaattcttgctgaatgattggggaaacttacccaacctctctggacctcaggttattcacaagtaatacgaatataacagtatttgatagagccaattaaatgagttaatatttgcaaaatgctgaaatcagtgcttgccccataatgaatactcaataggtatttagatatttttattcttatctttcctcccaagcccaacctagtgtagaaacttctggaatggttgaattgaaggagaaatagtataaacagtataaaaaggtaaactttttaaaaagagaatcatgaagtagtgcttctacagagattgggggatggcaaacaacccatggagtaaattcacaagacttgacacttaagaatccaagagggctgcatgagatgagtccaggtaggcctcgtagacaaatcttagatggagttaactcaggaagccaaggagtatgagccagtagtcatcctgagcaaggataataatttttctttctgcctgccttcttgccttcttgtctccttgcctaccttccttcctttcttccagctttccctccctcttttccttccttccctatctccatccctcccttcctttcctacctccctcccttctttcttcttccctttcctccttctttccttccttcatttcttccttctttcctttcttcctccctctctcctacccttcttccttgcttccttcctccctccctcccctcccttccttccttttccttccttcctttccttccctccttcttcctccctctctccctccttccctacttccctccctcctactttcttctgtttcctctttccttcctctcttcttctttcctccctctcttccttccctccctcccaccttcctccctttcctcttccttcctctttcttccttctttccttcctccctcccatctccttccttccttccttctttctttccttcattcctccctccctcccttccttttttctctacctccctccctccttccttcttccttttcctccttctttcctttcctttctccttccttccctccctcccttcctgccttccacccttcctaccttcctgccttcctgcctgacttcctttcttccctcccccttccttctttcttgccttcctgccttgcagtcaccgaatgttttttgagtgactatgatgtgccaagacccggtataagggtgcacgaaataaagtctctaccctcaggagcttacttcctagtgggggagacagattataaacaaagacacaaataggtaatatactattatgtggtgaaaaatgctacgaagggaaagtcacagggagcatttttgtttggtttttttttgttgttttatatagaatggtcacaggtgcctctctgaggagcccttggagcagacacctgaatgaagtgaagccacatgcctggagaacaaatattcagactgagataagagtgaacacacacctgcagtgagagagagagagagttgggtgtgatttgcagacctgtaggaaggccagtgtggttgggcagagggagcagggaatgtaggcaggggccagatcacccagtatttgtaaactgaggcatggactgaatgatagggcggcttcattcatccaccaaaccacgtgctgagtaatctaccccaattccaaagcatgaacttgacaactgcttcttcatagtaatagatgaaggataaaaaaatttaaaaagcatatagatgagccaacttttatgtgcttaaagtgaaaacaatcatgtctataagacaaaagaaggaaagacatttgacatgctccatgtacctgagattcatctcgtgttaataaaatgttgaacatattacactattggccggtgtttagtttcagctgaggaactaattcctaaagctgcagcctgggggatggggagatagggtggacactgagacagggcatggaggaattcagatggtatttaccccagaaatatttactgaaattgggaatgctgagtcaagcctagccatgctagagggccttgggaaggcagttactagaatctccttgatttttttccaatttcagaagaagcaacaagaagaaagtgtcttgactaatccttctagtgaaagatattcacttttataataaggtgcttgtctacacagaggtttctgagtcaaaggaggagaacgtacaaaatagaccgaaagaagagcctgcctagctgctctttttcttttgtaattaccaagatcccgacggtttatacccactcaactgcaggtgctgggagaggagaggctactgtgacaaaaattatataaagaagagcccagcagatgcatttccagataaacaatgtaaaacatagtctatgtaagtgccataaaatttcactaataaaaaacacacatggctcagggaaacatttattatcaaaatggaagcaggaaagggcatatgctaagtcttattcatttcaataaatagcagaacgtgaattgataaaagttcttaattgaaaaacagttgctcatttgtagtttgatatttaaaagctttctaaacatgtatttattttgttttgccttgaagtaattagctattagactaactattttcttttcatgtcaggtacacagtggctccaaagtcaaaacaaggttagattggaaggaagcaaacaatgaaattgaagggaaatatcgacacttctcaatcaatgaaaatgcatcagcatgtatgagcatctttagctggcaataatacatcagaaataaataatgttagcaaaagagacagcatcattggctattcatagtatgtattcacggttgtacaataaaattctaaaggctgaggttgaaagtgaataaaaattattagttctaaacacttgaaaattccagcagcttagacatatttttgtatgctttcagtgccccaaatgtaaaacttaaatcattttatgaaaaaaccttgttcaatcttttaagaaatttgcatttcattgcaaagatggaacatagcatccttggctgagttattttctatagaagtcagtgccattttgtggtatatgattagcacattctaaaggcaaagattccagaacgtttaaatttagttgtgaaaaactgaaggcatttatccattcatatataagcatgaaaatgcaagcttcactttctcagtatgtttaaatgccacatattataatgggaattctagaagatgtgatcatcaaactctgatttcacgcttagaaatcaaataaaaaagagactggcctataattagaaaattagtcaagtcagatctaatatcaacacatggttgtcacagaacaaaaaatttttgctttgagaaaaatgagatatcattctggatgaatattctgggtcagtagaaaatagggaatcaaagtatagaaataaagtgtttatgtcactgtaaaacttctagttttctaaaataaaatttaaatatctgaaatagcagtttatacttcatactcatacagtcaatagacattggtagcttaagaaagaacttggtaagtgatgatttaaagagtgatatagattcagtagtattcaatatacagttgtaattgatgagctcatcaaactatggaatttgggatatttacataatatttacattatataatatgggagagatagcaagtatctataaagagtttaaattcccatactaggaaatgtatagtttgttttaatctatgtctacatttaaagtagatttttttttcagagacagcatatagttgggtattgctttttaaatttttaaatctaatctttgtcttttaaattatatttaacgtagttgttgatatggttgaatttatgtctattaccttgctacttgttttctatttatcccatttattcttgtttttttccctcaatgtctgccttcttttggattatttgttttagtattccattttatttccattagtggtttattagttatacctccttttaaatttatttacctaattttagttggtgccacaaggcttaaagtataaatctgtagtttatttttggaggatctttgccccacagattccagtcttaccatgctatttattttttagcgatttgattacgctctggtcaatatgtgattatgtgcaaactgtgtgtgtgtgcgtgtgtgtgtttatcttgcttgaggtttgttgaatttcttggatctgtgggcttagagtactcacataaaacttaaaataaatttctatattcttttttctggtatactgtctatgcactcttaattcatatagtcatgtttttatgtcagatattccattttttgtctttaaataatataccaattaatgtataacgtgatccttacaatagttatacttctatttccccatttttcctgctattgtgataatacattttacttctatatatgacaaaaaaccccatgatatacataacagtgtatataataataacatatttttgctttaaatagctaagtcttttaaataaatttttaaaacgagggccgggcgcggtggctcacacctgtaatcccagcattttgggaggccgagacaggcagatcatgaggtcaggagattgagaacatcctggctaacacggtgaaacccatctctactaaaaatgcaaaaaattagccaggcgtggtggcgggcgcctgtagtcccagctactcgggaggctgaggcaggagaatggcgtgaacccgggaggcggagcttgcagtgagctgagattgcgccactgcactctagcctgggcaacagagcgagactctgtctcaaaaaaaagaaatttttttttaaatgagaaaaagtattttatatttatccataaatttaccacttacatcacttcatttctttgtgtagacctgagtttttatgtggtatcattttctattttttaattaattaatttttttttgagatggagtctcgctctgtcgcccaggctggagtgcagtggcgcaatcttggctcactgcaacccccgcctcccgggttcaagcaattctcctgcctcagcctcccaagaagctgggactacaggtgcatgccaccatgcccagctaattttttttttgtatttttagtagagacggggtttcaccatgttagccaggatggtctcgatctcctgaactcgtgatccacccgcctcggcctcccaaagtgctgggattacaggcgtgagccactgcgcccagctatctttctctggttttcatagtttatggcaagaaacctgcagaatttcttacctttgttactttgtgaagtgtcttttttctctggatgcttttagattttttttttttagcaatttaattatgctgtggttaatatgtgtaattatgtgtaagctgcatatgtgtgtatgtgtgtgcgtgcgcttatcttgcttgaggtttgttgaatttcttggatctgtgggtttgtagtcacaccaaatttacataatttggtagccattatttcttgagatattatcccccatccattttttaatgtgtccttttttcccccaaatatacatgttagactgcttgatattattccacaggtcacttaggctctgctaattttttcactactctttttttctacatacttcattttggatgattctcttactatgtcttcaagttcatgggctttttcttttaatccaaatggtcacattttcatgtcagatattcttaatccaaatagtcacgttttcatgtcagatattctgttttatttttgtctgtagaaatcacatttgggctttaaaaaatatcctcaatttctctcctcatttcatgttttcctttaaatacttgcaaataggtttttttgtttgtttgtttgttttgagacggagtctcgctctgtcccccaggctggagtgcagtggcgcaatctcggctcactgcaagctccgcctcccaggtacccgccattctcctacctcagcctcccgagtagctgggactacaggcacccgccaccacgcccagctaatttttcattttcgtatttttagtagagacggggtttcaccgtgttagccaggatggtctagatctcctgacctcgtgatctgcccgcctcggcctcccgaagtgctgggattacaggtgtgagccaccgcgcccggccgcacataggtattttaacattcttgtatgctagttccattatctctgtcatttctgaatctatttctatttaatgcttttttcctcctcataatatgtcacattttcttgtatcttgtctagtaatttttgatagaatgctgaagattataaatgccaggtcatctggattttgacttccttaaaaaatattaattttggttttggcaggaagccaaacaaaaatccagatctaaagtccaagtttctagatatttgcccctcagcttctagcctgagcctctccaaactccagtctctgtcttctgagtcagccaggaagtaaatccaagctgttttgggttacccttccctctgcttatggaccataaattgcctcctggaagaaacctggggcaattgtagaaatcactttttttgtcttcttcctctcagagatcacagccctaagctgcctacaatctgatgtttgaaaacagctgcaccatatattttgttcagttaaattttttttttttaggccaggcatggtggctcatatctgtaatcccagcactttgggaggctgaggagggaggactgcttgagctcaggagtttgagaccagcctaggcaacatagtgagactctgtctctactaaaaataaaaaaaattagctgggcatggtggcacatgcctgtggtcccagctactcaggagccatctcaccgcagcctcgaattcctggcctcaagcgatcctcccacctcagcctcctaaagtgctgggattacaggcaaacaccactatgcccggctattgttcagtttttttttcttttgttttttgttgtttgcttttgcttttttgaggcagagtctcactctgtcgcccaggctggagtgcaatggcacgatgtcagctcactgcaacatccgcctcctgggttcaagggattctgctgcctcagcctcccgagtagctgcaactacaggcgcataccaccacgcctggctcatttttgtatttttagtggagacggggtttcaccatgttggccaggctggtctcaaactcctgacctcaggtgacccacccgccttggcctcccaaagtgctgggattacaggcgtgagccactgtgcccagcatattgttcagtttttaatgggaggttagggacaaattttgatactccattaacagcccaaagcctatttcccaaatctgttttagatacccttagatgaaataattcttacagaaaccatgagaccttaaatgattaatcataattatcaaagaaaactcctgagcagttaatgtcaaatgtaatatgatgtaagtaagttgattgataatattcgtgtcttgttaaaagaggctactttagtctgctgagatactgaacggattttcctaagggaaggagtatctgatatgaaataccagttaatcatcagtcaccaaccattaattaaatggctactttataaaggacattaaactgagcgctagatggagtatgttgttgcagtcatttcatagaaaagtctacaggggtaattataagaaaaagaaattgggtatttcaaagatctagtcactgatataagtggaatgtgatatcaaatgtgaatcaatactttaaaataatttttattaaatgcttattagatacagaagaatgctataaaaatatatgtaaacttaaaagtagtgcttctgaaactttaatgtgcaaacaaatcacctgagatcttgttaagatgcagattctgattcaggagtctggggtggggcctacctctgtagttctaaaaaaaaaaaatccaggtgaggacaatgtttctgctctgcagactatctttggagtagcaagagtaagagaagtgaaactacaatgatcatctgtgtgcccaccactggtgtaagaaaaataactttatttttatctctaatgtcttctgggtaccccctcctgatcccttccctccctcttagaaatgactacttccctccctcttagaaatgactactctcttgaattttgtttttatcatccttttgcttttcttaaaagttttaacacatttgcttgtcacttcaatatatattgttagggtttgcatatttttgaatgcatgaacctaatataaatggaatcatttgcatatatccttcttcaatttttcataccacattatgttcctgaggttaattcatatcattgtaatcatagtttgtataaacttaatttattttcatcactgtatggaattctattgtatgaatatacataattcattttaccgttgttgaattttgaaatttaggttttatactgccatgaaaattcttgcataagttcctggtgcacacatgcaacacttagtcagattatatacataggtgatgaattgctggctcataaggtatacacattttaaactttagtagattatgccaaattgttttctagagtggttatattgacttgttctgccaccaactgtgtgtacaaatgttctggttgttcctcatctgtattagttttatattgctgcacagcaaattgtcacaaatttactggcttaaaacaatatccacatattagatcatagctctataggtcagaaatccaggtgggcctggatgggttctctacttggggtctcaccagtctaaaatcaaagtttcagctgggctgactcttatctagaggcgctgtggaaaaatctgcttccaggctttttcaggctgttggaaacattcagttattggcagttacagactgaagccccttttcctgctgtctgttagctgctaaggaccactctcagctcctggaggccactctcagatccttgtcccatagccccctccacttatcaatggagaccctcctttgcatcaaattcctctcatgcttaaaatctctctgagttggataaaagtcaatatataaagagctaatgtgattagattaagcatatccaggcaatctcccttttgtcatataatgcaccatagtcacaagaataattccagcgattaaagttatgagggtcatctatagaattctgcctactctagtttactgatagccagactggccccatgattcactactgtttcataggtaaaatatattcaccacttcccaaggttcctagtgctttgattccattacagcatcagttcaaagtctaaaatctcaataaatcatctgaataatctaaaccagatggaatataaaaaggagtcagcaatccaaagcagtgttgaaatccagtggagcaaaactggttgggaaaactccactgagtttcaaggcctgggaataattctctttagctctcagctcctccctctccacttttggtttcaccctctgagtcaactttcttttttcataaagagtagatgaatagttttatctccctgcttctcgcagtagaatttgagcagatgtaagagtctcttttcattttatactctctctgtcccttttggtccagctggtagtatttctgctgatacaattttctcaagaactttctggatctcctgtggatatcacagtgattcactgcatcatacagaacacatgctgacaagtcttttgagataatcccttctctatttttggcttctactgaaatggttgagggacagaacccttaagcccagaggtcctctggtttaactgagaagatctgtgagaaacacccttaatctcctggaagggtagtttgtgtggtaaaatactctggccttttgatatttctgagttttcaacaaagaactgtatagtatacactcagacttttctttatgccactgttttagcagccatttatgacttttagcatccttttgccatctggagaggctgtgaattttctaaattatctactctggtttctgtttaaaagttcttccctcaatttatctctctcctttcacaatttactataagcaacaaggagaaatcaggctgtagctttaacacctttcttggaaatctccttagctatatattaaagttcattgtttacaaattctgctttccacataactgcaagatgcaactttgctagctatttggccactacataacaagactctcccttcctgcatttctaataatatgtttctcacttctttcttagtccgcactgacagcattctcaaagcccagatttttttaacctatttccttatattttaatgggttttctgtggctcatggtggctcatgcctgtaataccagcactttaggaggctgagtcaggaggactgcttgaacccaggagtttaagaccagcctgggcaacatagtgagaccccaacactgcaaaaaattaaaaaaattagctgggcatggtggtgtgtgcctatagtctcagctacctgggaggctgaggtagaaggattgcttgagcttgggaggtcaaggctgcagtgaactatgattgtgccactgtacttcaacctgggtgacaaagtgagactgtctcaatcaatcaatgaatagataaacaaaaaatgaatggaagttcttgtagacaaatatatgtggtttggcttttatttatccaatatgacaagccctaaattttattttatttattattttattttgagacagtctcactctgttgcccaggttggaatgcagtggtgacatcgtggctcactgcagcctcaacctcttgggctcaagtggtcttcccacctcagcttcctaaatagctggaactacagttatgtaccactgctcctggctaattaaaaaatttttttttgcagagaagagatcttgctatattgaccatactgaagccttgctttttaagatgatatttagatcatttacatttaatgtaattatcaatatttttagtttagtttcccaactttctatgtctttttatccaatttattttctcttcttttccttattcctgcgttttttgataagtatttttatgattacattttatttttcaggattggattattagttacacatttttgttttattatttttagtggttgctctagggtttacattattcatcttaacaaataacaccctacttcaaataatataataatatatattatttcacatatagtataaaactcataacttccattttcctcttttatcctttgaatgatactattgtctttcattttacttctaagatgttgtaaacctctcaacaaattgtttacatattttctttagacattcaattatcttttaaaatctttaaaaataagtaagaaaacatgtctcatatttatctacacttttaacatttccagtgctcctcatttctttgtgtaaatcccaatttctatgtagtgtcatttgtactgcctgaagaattccctctaatgtttcatttagcacagatctgccatcaattcatgttctctgcttttgtttgtctgaaaaagccttttttccttcagctctgagatattttttgctggttatagaattcagagttgacagttcttttttcttttagcactttaaaatgctattccattgttttttggcttacttatttttaacaagaagtttgtaataattcttttgttgttctgtgtataatatttctatttttttggctgtatgaaagattttctctttatctttggttttaagcaatttgtctatgatatgtcaaacagtgtttttaaaatattaattctgcttggtgttctctgtggtctgttatctttattaattttagaaattctcagtcattacctgttcaggcatttcttctgtgcatttctctctctttcctttttctacatgttaaaccaggtgatattttaccacagcttgtggatgctctgctcttgtttttctcattttttgtctctttgtattttagtttagataatttttattgtcttatcttcaagtcctctgacatattcttcttctgtgttcaagctgataatgagcccatcaaaggaattcttcatctctgatatattcttccttcatagcattcccattggacttttaatgactttctctctactgaaatttcccaacttttaatgtttgttgtgtatctcttctactggatcttttgttttgttttgtttttggagacagggtcttgctctgtcacccagcctggagtgcagtgatataatcatgggtcactgcagccttgacctaccaggctcaagctatccttccacttcagcctcttgaatagctgggactacaggtgtgtatcaccacacctggatttttattttattttatttttgtagagacagggccttgttatgttgcacagactgttcttgatctcctgggctcaagtgatcctcctgccttggcctccgaaagtgcttagattataggcatgagccaccatggctggctgaccttttaagactagagtcatagttattttgaagcccatgtctaatatttttacctgggccattcttaagtataatttttttgatgtttttatcctttgaaatgagtaattttgttcttgctttttgggctgtatcatattttttattgaattccagaattggtataaaagtatagtagaatgcgatttaaatagtattttcattaaaaatggatacacatgtttttgtgtcaagtaaacattcagaatcttaaagaaaaattgattaatttattctcagaaatgtgatatatagcatacaagataagaagtttgagcaataaataggtcaaaattgtgctgatgaacttcattaaaattttaacttcattaaaaattaaaattttaacttccttaaaaattaaaaataaaatatgtaattcaggaacatatatttctaaagtatcccattatactgaatattttagagtaacagttacaatggtatgtacatggcaagtaaaacagattttgaccttttcttgcaatagtagcaaaataataacaacaacaacataaaaaatcataatggtaaagtagcttatttacaaagtgaccaggagtaacattttatacccactctcacatgtaaagtgataagtggtacagaaaatgtattcagtgggaaatgtgggagagggtactccagagatagcagggagttataatggtctaggtctggacaatcacagcatcatatccctggattataatgattgatttgggaccggtcacagaactcaaacaaagactattagctctaacaagagctgttttgggaccctttgcagttagaactaaagttgtaaaaagataagactagattgacttggtgccattatgtcaccccaaagggtgagcctgaattaaaacagccaaaacacagaaaaatggagtgatggacagcaataagtttctgataatattatttaagtctttggattgagctatgcctaaagatctttttcagttataagaaccagcaaatgattttttcctatttttaaatgtaatttaattatttatctatgtttaaatcaacagataaaattgtatgtatttattgcatgcaacatgatgttttgaagcatgtatacattgtgaaatgactaagtataattaacatgtgcattatctcacagttatttttgtggtgagaacactttacttatactttcagcattttataagaatacaatatattaactatagtcaccacgttgtacaagggatctcttaaacttattcctcctatctaactgaaaatttgttatcttttgatcaacatctccccaattccctccttgcaatcaccttatcccctagtaatcaccattctactctctacttctatgagatcaacttttttagattccatatggtgagatcatgcagtatttatctttctgtgcctttcttaattcacttaacataatgtccttgaggtttatccatgctgttgcaaatgacaggatttcccttatttttttatggacaaatagtactccattgtgtatatgtaacatttttcttatccattcatccatgatgaacacttaggttgattccatatcttggtgattgtgaatactgctgcaatgaacaccaaagtgcagatatctgttttagatgctgattttatttcctttggatattatctcagtggtgggattattagatcacatggtacttatatttttaattttttgagaaacctccatactgttttccatggctgtattaatttacattctctccaacagtgtacagggttctcttttctccaaatcctcactaacacttgctatcttttgtctttttgataatagccattctaacaggtatgaagtgatatctccttatggttttgatttgaatttccctgatgattagtgatgttgagcaccttttcatatacttcttggccattttgtatatgttctttggagaaatgtcaattcagatcctttgcctatttttaaattggggctttgctgtgtttttgttttgctattgagttaactgaattccttatatgttttggaatattaactccttatcagatgtatagtttgcaaatattttctcacactctgtaggttgtcttttcactctgttgattttttcctttgatttgcagctgctttgtagtttgatataatcccagttatctatcttgcctttgttgcctgggcttttggttcatgttaaaaaaaataattgcctagaccaatgtcatggagctttctcctatgttttcttctagaagtttcatagttttgggtctaacatttatggctttcatccattttgagttgatttttatatatggtaggagataaggatccaatttcattcttctgcatttggatatccagttttcccaacaccatttattgaagagactgtcctttcctcagtgtgccttcttggtacctttgtgaaaaatcagctgactgtaaatgtgttaatttatttctgtgtactttattttgttccattggtttacgtgtctatttttatgccagtaccaggctgttttggttactgttattttgtagtatattttgaaatcaggtagtatgatggctccaaatttgtttgcttgtttgttttgctcatgattgctttgtctatttgggaccttttttgatttcatatcaattttaggattgttttttctgtttctgtgaagaatgagccaggcacggtggcttgctcctgtagtcccagcactttgggaggccaaggtgggaggatcatttgaacccaggattttgaaaaattagctgggtgcaatggcatgtagctgtcattcaggctgctcgggaggctgaggcaggaggatcctttgagcccaggagttcaagacagcagtgagctatgattgtgccactgcattgcagcctaggtgacaaaacaagaccccatctcttaagaaaggaagaaggaaagaaagaaagaaagagaaagaaagagaaagaaggaaaagaaggaaagaaaataaaaaaaagaaaggagggagggaggaaggagacagagaaaggaagaaagaaagaaagaaaaagaaagaaaaacagaaagaaaaagaaagaaagtcattggtattttggtagagattgcattgaatgtatagattgctttggataatgtggacattttaacaatattaattcttccaatccatgtgcatgagatctctttctatttgtgtcttcttcaatttctttcatcagtgttttatggtttttggtgcagagatcttttacctccttggttaaatttatttctaaatattttttgtagctattgtaattaggattattttcctaatttcctcttcagatagcttgctttttgggtacggaaacgctactgattttttttttcccaacaaatgatttttaacttagacaaatttacactgggttttatctcctttcaaaaaaatgaggctgatggaaaattcaagagtcaatgttttttttctaagagagaaacagaaaaataaataacctggcattagggtgtagtatggcctggagaaaagagatgctggagatcagcacagcagcaagagtcaggatgataaagagagagagagagagaaaaaaaaaaaaacactaagtaaccaaagataaagtactgagtgggaaaatattacttccaataagggaatctgatccagcacaaagtctgggctctggaggaaagaggcatgagaaagaaaaatataggatagctctttttaagtcaaagacatgaactgtttactccaaattagggcagtgaagacctgagttgcagactgtctggtgatatcttgcctttctgttaggtaagcactagggtggctgagctgagctgctgcaaatgtgacataaccggtttgggactatggtgtgcacctgcttgcgctatatgcatggcatgacccaattgagattatggtgtctttagttggcttgtcctagtggcagcaggtgaggtatccagatctgcacctgaaccgaggtatttgaataagtgatagaggagcaattcaaaaggcttttctgaaagtaagtcagtgagactggttgtgtgatggatgagggacctcaggaagagagaggagtaaatactgatgccaaggatgctagcttggactctggatgaacactgacatgtgtgactttgagtttaacaattgctaaactgtgatcaaaattatgggaggcattacactgaaaggcaaaactcaaagaaaactctaatatagtattagttgaaaagtaaatgggggtaccatgaagataactaaagccatatttggtatacatttaaaatgctagaatatgtcctttggatgtgctgtttgcatatagggtacacagaaggggacttttatcttgttaggttttatttcagatatataatggctctttttgttcccagtgaatttgggatgttctatgtgttgcttaatagtaaaatatttaaatgttaaattattagtatgcaatatgtgttagtataaatcaagtactttcattgaatctctgaagataaatacaaccatgtaatgtttaattttgactgtcttgcaaacgacctgaacatcaattaacaatctaataataatagtaactaacagtttttcatgctcaggcactattctaagtgctacacaatctggtaacctatttaatgttcacaactaccctacgaagcaggtacaattagttctcccatttactgatgaggaaaccaaatcactgggaagttaacttgctgaagtcgcatagctagtaaatagtagaaaccaatattagattctaggcagtctgattccagcgcttaaactcaaacactcatctttactggctacatgttgtatattcacatacacacacacaaaatttaacaaaacacttataaacaaagtactgtgagatctatagataagaacatccagtcttgctgttaggaaatgtggctgggaaaatagaatatttatatgaaaaagataataatagaagacagtgtgtaggaagtgacagatggatggcacagacaaatcactctgcagaggttgtagagaatggggcaggggtaggttacaggacagatggtcttaaactgatggataggacctacctgtaccatctggttcctgcccacctctctaaacttatcttcctgacattcaccaaattctagccacacggaccttctttgtgttcctcaaaatgccacactcttttctgtcccacggcttttacaattgttgtgtcttctgcctggaagactctttctttaaatcttggcaaggctgcctcctttattattcagaagtcagatcattgtgccctctgatatggtttggctctctgttcccatgcaaatctcatctcaaattttaatcccacatgtccagggagggacctgtaatccccatgtgtcaagggagggaggtgattggatcctgggggtgatttccctcatgctgttcttgtgatagtgagttctcctgagatctgatggttttataagtgtttggaagttctttcttcactcttctctgtgctgctgccttgtgaggaaggtgcctgcttccccttcgccttctgctatgattgtaagtttcctgaggtttccccagccatgcagaactgtgagtcaattaaacgtctttcctttataaattacccagtctcaggtagtatcttttagcagtgtgagaatggactactacaccctccttaatgagaacttccttggtgacccaaactgaaatactgcttcactcctaccccagtccactagcctgtttgatttcattcatgacactttccttacctgaaattatctacttgctaacctgcttatggtctgtttctcttcactagaatgaaagctccacgagcaaggatctatgatgcctgtcttgttctcatcttttttattttttccctcaagtagtttctgaagtttctacctcatctacacaatctttctgggctttaaaggctatgagggaatgtccctctttgacttgttttgaagccttgggcctacttatttgtatataagagaatatttttaaatggttctcttctttatatatttaaagcatgaaatgctctgaatatcaatgaacccaatcacatttgggtaatagaaaaggctgttttcttcatagttgattctttttttaaaaatttaatttcttatttatttattttgagagagagtctcattccattgcccaggctgaagtgcagtggcatgatctcagctcactgaaacctccacctcccaggttccagcgattcatacacctcagcctcctgagtagctggtattacagctgcacgccaccatgcctggctaattttttgtatttttagtagtgatggggtttcgctatgttggccaggctggtctccaattcctggcctcaagtgatccgcccgccttggcctcccaaagtgctgggattacaggcctgagccactgtgcccagcctgtagttggttcttttgaaatgttcctctcctttatgggccaagctgatagcatttgctttaccctctccatttcgtatatttatcagccatcaaaggcttttcttattgcttggaacttaattgaatgatgtttttgtttctttaccaacaaatgaacacaagcggctttcgaaaatactccaaaaaacagtgagctgtaggcaagattttattcttcatgtgtgatatattttggtaattaaggagtcaattctttggctaaatgctgaaagaaaaatgatgattattgtgtaggataaagctgtgaattatagaatactttcaactctgtttaaaatctaattaacattaattgttacattaattttccctgtgaaatttactaactgtatacaaaatgatatttaatcttcctaatggaggtctagtgtattcgtttcagtcctattcgtaggaatatgagttgaaatggcaaagttatagttatgttgaaagtaatgaagtaatttttatataaaactaatttattaactatcacattgtaattaattaaaacactcttacttttacacaatgttcctgtttttaaagtacttttgtgtgtgtgtgatatacatatctatatgtacatatatgtggattcccacagcgtcgtatgatacaagcagaaccattaattattatttatccccatacttatgtataatggagtttccatgaggtttaaaaacttcccctgtaacataaggatagtggatcatgaagttcataatttgtgaccttattaagttctaattactagggatacttcttgttttagtttgctagggctgccataacaaagcatcaagatttagtggttaggccaggtgcggtggctcatgcctgtaattccagcactttgggaggctgaggcaggtggatcacctgaggtcaagagctcaataccagcctggcccaacatggtgaaaccccgtctctactaaaaatacaaaaattagttgggcatggtggtgcgtgcctgtaatctcagctactcggaaggctgaggcaggagagaatcgcttgaacccaggaggcggaggttgcagtgagccaagatcgtaccactgcactccatcctgggtaaaagattgagtggcttaagtgatagaagtttcttttctcacagttttgggggttagaagtctaaggtcaaggtgtcggcagggctgactgcttctaaagcctctctccttggtttgcagacggctgccttctccctgtgttttcacacggacttccctctgagcatgtttatgtcccaatttcctctttcttataaggacaccagtcgtgttggattagggcctaccctaatgacctcgcttttgcttaatcacctctttgaagatcccatctccaaatacagtcacattctgaggtactggagattaggacttcaatttatgtattgttggaggataaaattcaaccataacgcttgtgtaaattgtgaagaaaacagtaattaatgtatagcttgttttaaattttctgagtgaatgagttaaagaggctatatgaaatagtaagtgctattttagccaagaaaattatgtctcagcacatgtggtttgtgtttcaaaaatatttcttgagtaaaatgtctgatttatctaatatttttaataatgctataacctttactattttgataatggtagtactacccgacatatattgagtcttaccatgtaccagactgttttaaacatatgccctgtattaacatatttaattattacaagcaacctatggaatactattattgccctaattttaaaaatatggaagctggccaggcatggtggttcacgcctgtaatcccagcactttgggaggccaaggcagatggatcacctgaggtcaggagttcaagaccagcctagccaacatggtgaaaccccatctctactaaaaaaaatttaaaaaattaaaaaaaagagagtaaactctgtgtaagaacgctaaatgacttgtcaaaggttctacggcaattaagtagcagaattggaatgaaacccaggttctcaggctctggaacttttgattagcaggccagtggttctcaatgggtggactctagtttctggctaagatggagtaagaggaaaagatttaccatccaatgtagaacaactaaaaaatgtatctaaatatgtaaaacaatggattgtaagacattggacttcatggaatgaaaggcagtgatccctgcgaggaaccatatagttgccccactttataatcgagagaaagagttcccaggcttgatgctcaggaaggtgatacctgacccctgcagcctgcagttggaacacagcactgagagtccagggagaccaatgcaatcagagtacagggaagaggacaagagtactctgcacagggagcgagaaagagcttcacagacagtcagagggttcccttgaatcatcagaggaaaacagattagtatatacatgtgcagaaactagccatggctggggaaagaactaccgaaggactagagggaacaattgctggaactcatctggggctggaatagttcctgtccccaaatcataactcatgggacattgggtagaatattcagaagaattttgactcggtggggaaaaattagccctacactaaattatgctagttccaccttaccaagcttaaaagaaagacctgaaagggtcaaactgtttccaagttgaagaggaaagggaataaacattcacgaattactgtcatcatcgtgaagggactctggatgtgaatcagtagctacacaagaaccttcagtgtctctgagcatgggaagatgaaaagatttgcttttcatgcaaggaatttaaatttccaatgtcatatatatgaggacaaaatacattagtgtctgagtgttcccagcacttctcctcttcaccccactgaaaagagtctatccacccagattcttcccctccacagctcttcagagagggttctgctggccagattggttcagaaagaaggtattaagaattaccagctgggtgtggtggctcacacctgtaatcccagcactttgggaggtcgaggcaggtggatcacgaggtcaggagatccagaccatcctggttaacatggtgaaaccccatctctactagaaatacaaaaattagctgggcatggtggtgggcgcctgtagtcccagctacttgggaggctgaggcaggagaatggcatgaacccgggaggcggagcttgcagtgagccaagatcccaccactgcactccagcctgggtgacagagcgagactctatctcaaaaaaaaaaaaaaaaaaaaaaaaaaaaagaattaccatgtgaatgatgaacacttcccagtgtttgttgataactgaagtaaagaccttgagatagtgttggaattactgtttggttgctgggtagtatttgtttacctctcacactactttcagatgggctatgttagtcatagctttaaccagattatagatttactgattggatagatgtttactaaaaattaagtgagcaaatgcaaggactagaacaacatagacaatatattctgatttttatttaaaagaaatatgcaaaaaacactataaaattttaccccaaatatacccatcagtataccaaaagtgtaccatgtatgctaacagccatataaaattactaaaaggatatataccaagctattggtaaaaggttatctctttcactggggaccaggattgggcaggtagaaggcagtaggaacatagcaaggagatcctttcactttgtattccgtatattgatgagttgcttgagttaaataaaacaagaattataatttgtcattaaaaaactaaatattaaaaattaccatcttcccagtgtttgcaatttttttttttttttttttgagacaagtcttgctgtcaccaggctggagtgcagtggcgtgatcttggctcactgcactctctgcctcctgggttcaagcggttctcctgcctcagcttcccaagtagctgggactacaggtgtgcccagttaattttttgtatttttagtagagatggggtttcaccatgttggccaggatggtctcgatctcttgacctcgtgatctgcctgcctcggcctctcaaagtgctggaattacaggcatgagccaccgcgcctggcccaggcttcaaaatttttaaacatttaactggaatagtaagtaaccaacaagcacttagaaagtgcctagtgtttatgattcctgccacctcagagagctacatttgtgttcaatcttcggacacttaaatgttttcaatgtatgtaaataattattgttaagattttcctaatttctttgttaaaatggttcatttcaaggttctttagagcttgcatttatttcattttttgtcatgtttcttttctcttagaataaaaaccagcagtcattttaattacccctgataatgttcatgaatactgccttggcctgtcttctggtttggaaccttttcaagggcgaatggatatttgtctggtgttccatgtataacctgtccttgtgccacttttccaatgtggcaggaagggaacaactgtcatctgttctgagaattcagcactgtgtctggcactgtgggaatttacccagactgctttgggggaagacatctgacacttcatgataattgtaattaaccagaaagacactggaattggaggatttgaagggaaatatgacaagggattaagactttgagattacttttggagccagggtgacttaagcacatttaaaaagttaggtttacttatatattattattatattctaaaccataagacattttctaataaggtttctaagaggaacatgtaaacctggatcaaatttaaataaggttactgaaaatattaatgaaaccaatgactgagcattttataaatgagaactgtattgctttaagttggagaaaagctgcaagtaagacaacatatttcttcatttgaaagcttgtgtccttatatgagggacattgacaaatgagtggtgataaaatggtggtctatgtgccataagggcttaggtacataaattaatgttttattaaccataaaaataaggttaaaaggttgaaatgtagccttcatgtgtctatgtaaaaaagaggcagaaaaaaatcctcagcactctagagaagcttagtctctgagcaatcactgcatatactaatatattcacatataatctagaatgaatgttaaataacaaaaatcatgttcgtttttatattttgctttgcctttgggatacgaagtgatggaacgagctcgttaacactgctcatttctggttagaagaacactagaaccacctagtggatttttcatttattgcatgatccctacactttactattgctaaattgttaattgctgagataggccttaaagtaaaatcagtggttataatctctttgtgggtcataatagaaatagtaattgttaatcttcagcagacaaagctgtccctaagtccttgaagggaagtccctgcccaccaaatacttaccaactagcacactgctgcatctagaaaagcacaggcagagttaaacatttggctgctgagatacaccgtgcaactggagctttaaatttcctgtgaaagtcagtgagcaaggtaaactgcagcaattcatctgcattcatggcagagtcaactttcggtgagcaagactagggaactctgcagagcacagccaaggggctacattagcagcttgacctttgtattcaatataaatctgtgggcacacaaactggcgtttctaatcaattttgtttttggagcaaagtagcttatgtggttacagcgtgccctggtcattctgtttcccattgctgaaccaactgggtctccgcatcttggtggtgatgacagatgttacgtatattacattgggatttgggtcagataaatagcaaatattctgggaaaggatactttatgtttttgcaaaaggttataaaataccaaactttagtaaaccctgattctaggccaaaggttaactctttatatctatgatttattaggtatcaaaagaaaaaagtcaggatctaaggggaatggaaaagtttctgctattctaacctaagagctggttgtcttctcctagtaaactaactgttcagcagatgggatgcatcgggctacaaggttggtgctttccagccggcaccgcgtgtgaagggcatgtggttgggctgggctctccaagtctgcatggcttgggttgactataaccaggggaaacacgcagtggctacaactgcttctcctaacaattctcgtttcattctcttctcccacagtgtgaaggaggctaggtggatattctctggggcttgaaatttcacactgcaaattttacgagagtgatgatctcttcctaactctttagaagccaagataggaaaaatttcagtttacaagaataaagcccaatccctcttcttatgttggaatgtccagtaaaatgctaagaaacgggtgggtagaagaagaggaaaggaagaagagaaacagagaggagagtaaggaaaaaatagaaaaggcagaaaaaaataatgtacatgaacaacaacaaaaatagtgacaaacagaatggactatagagataggggagggtagtgaagggcttcagagaagtcaggtgaagggccttcttttcttttctttttctttttcctttttttttttttttttttgagatggagttttgctctgtcatccaggctggagtgcagtggcataatctcagctcactgcaacctctccctccgggttcaagcaattctcttgcctcagcctcctgagtagctgggattacaggtgcccaccaccatgcctggctaatttttgtacttttagtagagacggggtttcaccatgttggccaggctggtctagaactcctggcctcaagtgatcctcctgccttggcctcccaaagtgctgggattacaggcatgagccaccgtgctcggccagggccttcttttttaaagaaaattttattatgctgtgataagaacacaacatgaggtctaccctcttaaaaattgtgtgcataatacaatactgttaactagaggcacaggttgtacagcagatccctagaatttattcatcttgcataactgaaacttcacccctgttgattagcaatttcccatccttgcaccccagtccttggtaaccaccatttattctactctcgcattatgtgaaatggactattctagatacctcctcaaagtgcaatcttgcagtatttgttcttctgtgactggcttatttcacttagcataatgtcatcaagtttcattcctattatatatgtcaacattttcttctttttaaaggctgaggctgagtaatattccgctgtgtgtgtgtgtgtgtgcgcgcgtgcatgtgtgtgtgtatataatattccaatttacgtattcatccattgatgaacattttggttatttccacatcttgttttttttgaatagtgctgcagtgaacagtgggatactaatatttctgagatcctgattttagttttttgtgtttattttttttgagacagggtctcgctctgttgcccgggctggagtggtggcgccatctcggctcactgctgcctcaatctcctgggctcaagtgatcttcccacgtcagtctcctgagtagctgggagtatagaccaccatgctcagctaatttttgtttattttttgtagagacgaggtctcactatgttgcccaggatgatctcaaactcttagactgaagcgatcctcctgtctcagcctcctaaagtgctgggaatataggcatgagccaccatgccaggccccagtttcagttattttagataaataccgaaaagtgggattgttggatcatctggtagttctatgttttcaatatttttaatttttcccagcttttttgaggtataattgacaaaaattgtatatatttgaggtatactatgtgataatttaagttgtgaaatgattaccacaatccagttaattgacacatctgtcatctcacataattaccatttgtgtgtgtgtggtgagaacatacaatatctactttctgagcaaatttcaagcatgcagtatggtattattaaccgtaattatcatgctgtactaatattggatccctagaacttaattcatcttacaacagaaagtttacatcctttgctcaacatctatttctcctacctctggatctctggtaaccaatttctactctctgtttctaagagttcaacttttttagatttcacatataagtagaatcagacagtatttatctttcttcatttggcttatttcttttagcatgatgtccttcagattcatccatgttgttgcaaatggcaggattttcttctttttttaaagactgaataagattttctttttatgcatacatattgtctttatccattcacctgtgatggacacttaggttgtttccataccttgactattacgaataatgctgcaatgaccatggggatacagatatttcttcaagatacttatttactttcctttggatatagacccagaagtgggattgattttattatatagcagtgttgttcttcactttttgaagaactgccatactattttccatagcaacagcaccattttgcattcccacaaacagtatgcaagggttccaatgtctccacaacttcaccaacacttttctcttttcctcggagctttttgtctgttaaaccccagcttcccccagcctgaagcatagttgacaaagattgtatatatttacagcgtacaacatggtgttttgatatatgcatacattgtaaaatgattcaatcaagctaattaacatagccgacacttcatgtacttatctctctttttttttttgtgatgagaacattggctttttgatagccatcctaatagatgtgaggtgatatctcattgtggttttgatttacagtttcctgattaggtgatgttgagcatcttttcacattcatgttggccatttgtatgtcttctttggaaaaatgtcttttcaggtcttgagccccgatttaattaggttattagtatttttgctcttgagttttaagagttccttgtatatttcagaaattaaccccttctccattacatagtttgcaaatgttttctcccattctatggtagtttttttcattctgttgtttcctttgctcacagaagcgttttagtctgatgtagtcccatttgcgtatttatgcttttgtcgctgtgctcttggtgtcatatctatgaaatccttgccaagatcaatgtcatgaagattttcccttatgctttctcccagtggtttcacagtttcaagtcttacatttaagtttttaatctacttggcattgatttttgtgtacagtgtaagatatggatccaaattcattcttttgcagttggagagccagttttctcaacactatttgttaaagaaaccatcttttgcccattgtatattcttggcacccttgtcaaagatcaattgatcatatatacgtgggtctatttctgggctcctgattctgttctattggtctatagtctgtctttatgccaataccaaagtgatttaattatggttgctctgtaatgcattttgaaatcaggaagtgtgatgcctctagctttgttctttctcaaaattattccggctactcaggggcttttgtatttccatataaattttagaattgttttgcctatttctataaaaaatgccatcgagattttaataggaattgcactgaatctatagattactttcggtagtgtggatacttccacaataataagtcttgcaatccatgaaccaggatgaagggcttctatatatagggcatcagttctcaagattggctgctgggcttctcagagcccatgaagataataatgagacactgttagttaattttaatattttaaagtttgatattctatcttttaacgtttacaggaatttgaaattgtatatttatgtgtgtacctatttgtttcatggctctatgaaggcaggaccatgtctcttttactcaccacagaacaactagcaccactgttgtgcagtagagcctgatggttagagctgcacgcatgggcagacctcccggtttgccatcctgctgcgaccactgactaccaatggcacatataccaccaattggctaggctaacaaacattccaagccccattttgccttgttgccttccattatagaggcttgtacaagaaaaaaaaccctacattttactttcccactctcatgctgctgggggatggtcaaaggacacagacttggccaatgaggggttagcagaaagctggcgaaggattctggaaaggctttgaattcctgctgaaaaggaaaaatgcagttgacagatgacactaccctctctcttcttaacttaaacgtggatgtgatgcttggatataggtccgccattctgtgcttctgagggaaagagtcagtcaattctcagagggagcagctctaacaccgtggagccatggaatgaacactaggaacaaatgacctcccagctgattgttatatgagagaaataaatgtccatttgtttcagccactgtacatagggctttctgttctttttcagcaaaacgctcctattacagcagttttgtgacttcaagcaagttactttactctgttttaatgttcccatttaaaaacagggattataccaatatcgtcctcatagggttgtttgaaagactaaatgagataatatacgtaaagagcacagagtaagcactagatagggataaattactatttttattactattttgatgatgggctcttaataagtcttagatgaataagtggagtaggtcaaacccaaagggtatggcttcaacccaaggcaacccaaggcaacccaagataactcatttttttctgtttgagaaaaatgagaaagggtggagaaatgagaggaaggtggggtgcggggaaggaggcagggctaaagtggagccaggtgggtgctgggtgggggggaaaatgccctatgaaaatctcccatggtgaatggtcaatgtgttggggccaacatattggccatgtgtggtccaggcatgccagtatcaacagacactaaataaacattttttttttttggctcattgaataaatgaatgcattgtgagggtgttcattaacaaagaaattgccatctcatccttaaaactgaagagatagaagtgagagggcagaaggtttttctccagtgtcactcgcacacctattataatatttgcctggaattatgtgggtgaagatgcattgctcaataattgcctgtgccctcgcaaggagcagaggagaacatccggtgggagcagaagcagaggcagaaagaacagatttcccacggagtaaaatattctgttctcataaaaagtcccttgctgtaacaaacgagaaaatgaaaaggagagcctgtagaagagaggcagacacctcttaataggcacatctctccaaagtttcccaccaggggccaactgttcattaaacagggaacaaatgcgggagcgtagctgtgatgggctccattccacagcccagtgctgggactgcagtgcgctaggaagggcgtcgctgttgttgctgtggcccggtgtgacagcaggtctggcatgtcagaatcgccctgcacaaatagctcctgtgcagctgctctcacccaaacctgctctgaggaggctcagtgcattctaatccttcctaaaaacatggacagaaagcaatggaaagttgacatgtataaaaggtttagtcatggggtttttaagtggatgcctccatgaaaggatcaactcagatggccacgtttctgaacattatttacatcaaaacctgacataaatgcctcagatctagctattttcttcctctatcctctttttacatgtctccttttccctctcgattgctttagcttgtaacctgcatgcgctttcaaatgtggtaagcaaatagaaagcaagacgccatttgaatagtgaatggacttgtattcctgtttaggaatgtgtagttgcccttgggctttctcagttataagactcataaaataaaaccttaacacagatggaacacacacacacacacgcacatgcaccacttaaagcagatgtgagtcaaaaacatatgctgatgaactcaatttgctgatggcattctgagcagtgagcccactcagtagggctgaagggttggcatagcaactcttcctgggaaaaaatagacagctggaataaaccatgacgatgaaagtcttcttccaatgactgaagaagtagagagaaattgccatctcttctaaccccttcaagcaaagcaccttggttgaggtttatagactaggatcttacaaattagaagttcatgtattttcctaggtcagattctataccttgggttatattccagctaagaaacactttcagataggctgcatggggctgtggggaaagagagagcacaaacctccaaaaagcatggagctttgaccaaagtttatttctgtaacttatcctaaggctatgccgagtgaagacttgtttactctagctgtaacttactccatcacatagcaccattactttgagaaattaacatattcattctcaattatttatcaagtatccagcactagcaatagggacacagtccctgcttttgagggattcatgactaggcagacagcaccctgagtatattaattaagatctgatcccatattagaataatatgcacaagagacttattacctctgtctcctcattcctataaacatttatctgggacctatcttatgtggactgtgctaggtgcaatgccaagggataaagcaagttaaatggcaacagtcctattcgacaggccagggactcaggatcagactcaggaccctttccctcttgttgcaaatcctgctatgtgtgggctcagccccaaactgtctctgaaatctcagaaatgagcaaaggctaaggatgtcaaattggctttgagatatgcctgtagactgataacaatagtgatgatgacgatgatattagttaatacaataaagctaatactgtgctattattaccaggcactgttctaagtactttaaataacttatttcatatactcttctgtcatttagtatgcataccattattctccttcccattatccatatgaggaaagcaaggcactgagttaaaacgactcacctttaactgttcatctatcaggtaagctaaccccggagcctacataaattcttaactattaaataagctatgccacttctcaaccactctgctgaaaactatacaaactgacaggtcctacaattaaaacccaaaatagatataataaagcataaaaaatcagttaggaattttctcttgcttttgctctgctgttattgttgttctccagataagtcccattttaaaatccacagtcaccttaaggatgtgatgtgggagctggagctgtctgcctacccaccagctatttttaaaggaagatgatcaggaactagttatgaaagaatcagattgtttaatctggtaccacagaacttgagaaactatagacttggtaagttggaaaatatgtaggcagaagtgatgtctctatggaaacagatgtgaagattcaagtaaatactaggcctgttggactttttatgaagatagcagaagcttttttccccacttcttcttctataacctgtttattgaggaatctgaccatggtgaggaacaagctagagacatatttttatctctagtcactgcttccaactctgctatgtcgaatctcccaactcttctagacatctctcaatgacatcttggacaggaaccatagtcacttacagtctagtccagccttatagcatatgcaactgcatatccagttcaagattttccattgctccattgatggctacacttattactcaaggatctactgtgggtgtgcttaggggtaactctttcaccttggagagtggtgtgggaatgttcttgttctagtatacttcatcccaaagacccaattcctcctgttttggggactgggagagaagatgagatggcttaatgtctcttggctttctctattgcttttgctgtctctctagcataccctagcgaccactgagactcttgtggggcagagatccacacgttatctatcttagggacatgatgggttcttcgaagtccctcatgagaggcgtgactctggctcaaacatgttcagcccccttcagctgtccaagcccccccaccctctatcagctctaactacactgcttgcatttttctttcctggtgggctgctttactggcatgtggaggagtgctgatatagcaggaagagttttgctacttcttattaagtcctgaaaaggtatctggtgggtgctgtgtttgtaataagatacttagcacctgtttcccctcgagctttgggcctaggtatcagttctcagacaaaaggaaaagtcaatttttataccctattataatgataaactttgattgaaactttggggataagaaagcatcgagatgtttctctctccttctattcctcttttctcctccctccctctctccctccttcctttgctcccttctttccttcctttctttcttccaaatagcaaccatgtaatctaaattatgaatgataaaaaagcctggcaaatcaatgagagaacttagagcaaaggaatttggaatattataagatagggaacaattttagtttcctgagcattttggttgtattaccacctgctccaatcatagactgtactttttcatgcccagaaaagacttctacaacccagccttcatagcaatcagccactcgggactttcttgcagtctgagctcaacctgtcttattttgctctgagttttccagttctgaaggcttgattactggtccaagagtgtcatttaggtagatatgctgaactcacatcatcctcgttacaaattgttatggaaaatcccaaaaatataaaagaaaaaaattttaaaaactagctaagggcactgttcacatgctgcaagatctcacggaggagaagatggaatgagtggaggatacacttgctgtgtgttcatcattgaagaagggaaagagcttgtgaaatgacccctagcagaaactcactggtgctttcaagttcagggtggcagggttgaaggtgagagttagcttcagggaagatggtggagaagaatgtttgctagtatctggaccccaaaggattacacaggatgctggagcctgcatgggctaggaataccattagttcaatcatggtctacacttggcaaggaagatgcattgagaataggtgaagggcatagtcaagaccaatgctaactgtcattccttatggaggaattatggaatctacttcaggctgccatgaaaagcaaagcagagaatctgttgggacaactcgttcagcagcctcagactacagctgcatctttacttatctaggcctctagatcactcagaagtaaaggaaaatttaaacaaatctaaacattctcattctttcactggggtcttcaaagttttgaacacaatctctcagaagaatcaatttctgatacctgaatctttgtaagcacgaacagagagaagggactggacagatgaaaaggatttgtagttcaaagaagagggccattgtggggaactgatgctgagctctcggttctatgccccccagacttccttcttcagttacggtccctgcagaatcagcatccatctgcgactctcctttattcattgaactccttgttttggagaggagaggcatattttctactttatgtagctctccagcccatgatctcctgtggtcaggggctaaggattcctttccctgtttcctagtaatgcataactctatctctccataaggcagggtgggccaggcattcagaaagttggggaagctaggcagaatgtgaaataagtgaagggaattgaagggtgctggaaaacctcccatcaaaatttcctcccccatgttattccaccattaggtaattagctccctggttcttaaaggattacatcacttttctttgttaagagttgagtcatctatgcaaaaaaaaaaaaacaaacaaaaaacccaaaaactgagtgaattaaaaccagaatccttattagttattacctcaggagctttaacagtgtcccacttcaattagagcaaagctcactgggaatgtgtgtaggataaagaagatgttggaggtaatagacattaaggaaggggccaggagcgtggagggaacccaagagacgtgggaggatctcaaaagtgatctttgcctattgccaactgtgactgaggccctggcccatcatttgatgttctctgtcattcttgggagaggcagaggagtgtgatgattaagagcatggactctaaagctagacttctgggttcataaagggtaacagcttagctctgccccttcctaccttggggactttgagcaaataatttaaccgctctgtgcttttttcttcatttataaaacaggagtaatattggtccctgcctcaaagggttgttgtgaggattaaaggagttaacacacataaaatacttagaagagcacatggcatagagtaaatgctagttgttattagtatgctttcaatttcacaaagggacttaaaaggtcagaacccttacttactcctaggaaccactggggaaggagtgaggaccaacatatattgcatatgtatgccccagatactgtatataaaatatctcattgaaacctcacatattgatgaaataggtattacaatatccctattttgcaggtgagaaaactgtgtctcagagggtgagaatctggcccaaggtaatacagctaaaaagtggtaaagttatctatgatatcccacaatgttacttacacagttctctttggaaataaaaatataaacaaatggtacaggcagattaagaacaactccagcattattattattattattattattatttttttttgagacagggtctcactctgttgcccagattggagtgcagtagtgcgatcatggctcactgtagccttagcctccctgggatcaggtgaccctcccactttcaagtagctaggactacaggtgtgagcttttgtttttttttttttttttttttaatagaaacagggtttcaccatattgcccaggctggtcttgaagtcctggcctcaagtgatccacccacctcggcctctcaaagagctgggattacaggctccagcatcaaatgtttacagtagttgtcctcacagaaaatgcatacataactcttatcttcctgactcaatgctcaccttcacctcccaccctgactgcagcctattatccctgcagtcagtggacttttaatccagataccttggctgagcaggctcatagaggaaactggcccacagaaactgtgagaaataaatgtatgttgtttgaagctgctaaatttgtggtaatttgttatacagccataaaaacgaaaagaccaaacagtcatatcctgaatgattaaaaattggttgcataagtaaaagaatgtatttgagttggaagatttggggttttcacatgaaaaaccaagtgtgagtaaaataaccgcagaatagctattttggaattctgatactcaaacacttgctagttgaaggagtgctaagattatggatataacaattgattctagggtttcaaaacttatttcccataacataggaaagctgaaactctggctataaagaaaaggctatttttctttctcttgaaataatttgtactattcattgcactgtcaatagccaagaacatgctagaaattacaacgtgctcgcacatatgggtatttctgctatgatgcaacatatatgtttctaaaattcattttgttttgcaaaatcaaccaatagaaaaacaaaggacttataagaaaaatagggttggggcacaatagtcacaaactgtcagtaacacaaaacaaaaagataaaatctaatcaaattgtggtagcacagtcttacacaagtcaaatgggtaagaaatatgtaaatactacaaaaataagacactttcctttgacaaagactttacatttgcttgtggaagtgggagtcagagcattgcagcttgtgagtttttgtgaaattgtggaaggaaggtgatttgaaatcaagggaaagttgtatcactgatgtggatggatatggcccatgttgagggtggtggactgaggtagctgacatgtttcaggtacgtgcatgtctgttttgtacatcttacctggctgggttcaggtgtgtgcaattttctgtgtttccctagtgtttttcatagactaaacagtgcataagcaaccccaaattcgtgttatgctcaaaatgttctctaataaaatcttgtgtcttgaaaacaagtgttaaaaagtaaaactgaccagatgttatttcatttgaatcttacgataaaagcaataaatagacatgaggaaacagctttagacatagagctagtaaacagtcaaggcagattgaactgaggtcttcctcctctgtgcttttcccattaggccactccaggaatgtctcagtctagcatattttaaatctgtgtgatgctatagtttcactactgcaatttctaagactttatattttcaattagacatttattttactaccaagaagtatcctgatccagaggtactattctcccagccatggagagttcctccaaaagacaaaattctatctttgctaatgaaaatgcaaataaaactgtatcaagagtttcatgattttactaggtatttcccatcatatgtttatcatacagctcaaaattgatgtcaagttttttactctactcttttctcaagttcattcactataaattgaatttcatttttctgcacttgggttgtattttttgaaccactgactttgcttatattagttttactatgatattcatcaatttgtttaaaaaaattcagaagatacctcttgcacaaattcattttataatttaagaactcacttcagaatgttgagactctgttaagtatcaattctaggattatgaagatcctgtctaccacaaagagccccacaaaggtcttttctccctcattcccaagcagtttaacttaatgaattcttctggtagaactttgtttagacggacttaaagcaggtaagagttctttttaaaatacttgtggagtgcatgagtgtgcaaacaaacttaaaagcacatattggctcaggaaagctgaggggaaatgataattttcaacagtccaaaatagccatcctggggcttacagaaagtaaggtagcaattagcctaactctaagcctaacaataacacagtcattaatcctgggtgcccagacacattccattagaggattttggcaacaaaattttgcttttctaattctgagtagatataaacaataatcccttaatttattagtctgtttatcacacttattaagcatttcctatgtcttaagaactgtgccacaagacaaggatgccctctcttaccactcctattcaacataatatgggaagtagacataaacaataattccttaatttattagtctgtttatcacatttattaagcatttcctatgtcctaagaactgtgccacaagacaaggatgccctctcttaccactcctattcaacataatattggaagttctggacagggcaatcaggcaagaggaagaaataaagcgcatccaaacaggaagagaggaagtcaaactacctttgtttgcagatgacatgactgtatatctagaaaacctcataatctcagtccaaaagcttcttaagctgataaacaacttcagcaaagtctcaggatacgaaatcaatgtgcaaaaatcactagcattcctatacaccaacaacagtcaagctgagagccaaatcatgaactctcattcacgactgccacaaaaagaataaaatacctaggaatacagctatgtagggtggtgaaagatgtctataaggagaactacagacttacaaatcactgcccaaagaaatcagagatgatacaaacaaagggaaaaacaatccatgctcatggataggaagaatcaatattgttaaagtggccatactgtccaaagcaatttatagactcaatactattcctatcaaactaccattgacactcacagaactagaaaaaaactattttaaaattcatatggagccaaaaaaagaaaaaaatccagaatagccaacacaatcttaggcaaaaagaacaaagctggaggcaccatgctacccaatttcaaactatactacagggctacagtaaccaaaacagcatggtagtgacacaaaaacagacacagagaccaatggaacagaacagagaatccagaaataagactgcacacctacaactatctgatcttcgacaaacctgacaaaaacaaacaatggggaaaggattccctattcaataaatggtgctgggataactggctagtcatatgtagaatattgaaactggatcccttccttacacgatatacaaaaactaactcaagatgaattaaatacttaaatgtgaaatcaaaaactacaaaaaccctggaagacaacctaggcaataccattcaggacataggcatgggcaaagatttcatgatgaagatgtcaaaagcaattgcaacaaaagcaaaaattgacaaatggggacaatttaagctaaagagcttatgcacagcaaaagaaactatcaacagagtaaacagataatttacataatggtagaaaattgtgcaaagtatgcatctgacaaacgtctaatatccagcatctataaggaacttaaacaaatttacaagaaaaatacaaacaactccataaaaagtgggcaaaggacatgaacagatacttttcaaaagaagacatatatgtggccaacaatcacatgaaaaaagctcaacatcactgatcattaaagaaattcaaatcaaagccacaataagataccatcttacaccagtctgactcttactataaagttaaaaaataacagatgctggtgaggttgtggagaaaaaggaacacttatacaccgttggtgtgagtataaactagttcagccattgtggaagacactgtggccattcctcaaagacctaaagacagaaataccactcaacccagcaatcccactactggttatatacccaaaggaatataaatcattctattataaagacacgtgcacgttgcatgtgtatgttcattgcagcactattcataatagcaaagacatggaatcaacctaaatgcccatgaatgacagactggataaagaaaatgtggtacatatacaccatggaatattatgcagccatataaaagaatgagatcatgtcctttgcagggacatggatggagctggaggccattatcattagaaaactaacacaggaacggaaaagcaaatacctcatgttctcatttataagtgggaactgaacgatgagaacacatggacacaacacacactggggcctttcggagggcagaggatgggaggagggagaagatcatgaaaaataacttaatgggtattaggcttaatacttgggtgatgaaataatctgtatgataacccccatgacagaggtttacctatgtaacaaactcgcacttgtacccctgagtgtaaaataaaataaaataaaaagaactgggtgccagatgttgaaggaaaatagtaagatcttaagaaaatggctttggccgggagcagtggctcatgcctgtaatcccagcactttgagaggccgaggtgggcggatcaggaggtcaggcgatctagaccatcctggctaacacgatgaaacaccgtctctattaaaaatacaaaaaattagcctggcgtggtggcaggcacctgtagttccagctactcgggaggctgaggcaggagaatggtgtgaacctgggaggtagagcttgcagtgagctgagatcacgccactgcactctagcctgggtgacagagcaagactccatctcaaaccaaaaaacaaaaaacaaacaaaaaaacacagcttcaagtttgtagatctatggtcattcagtctatgacactgaacacttcctttagtagctcacttgttgaataacatctagaattaaataggagaaaaaattttcctaatagaactataccaggctttacatgattggtagtcttcgttcttcacaaaccagtttattttaatagatatctcaggtagagttttatgaaggcctcaaagcaattaaaacttcatttgcaggaaggacaatcttatacttaccagaaaactacagctaacatgaatttctttgttagacatttgctatgaaggatctttgagaaaattctgtgttagaacccatgacacccctaacatagctatgccattatttttttcttcttaaatgaacagatgagttttgtaagcaaagtaggataccatgattgatagacctttttgtaaagtatactcagatttgctgaaagagcctacataattcagtctgggtgcagtggctcatgcctgtaatcccagcactttgggagactgaggtgggtggatcacttgagatcagaagttcgagaccagcctagccagcatggcgaaaccctgcctctactaaaaatacaaaaattaaccaggcgtggtggcacatgcctgtaatttcagctacttgggaggctgaggtaggagacttgcttgaagccgggaggtggaggttgcagtgagccgagatcatgccactgcactccagcctgggtgacagagtgaggctttccctctctcaaacaaacaaacaaacaaaaaaaacaaaaaagaaggagattacataactcaagaaaaccatactcgaagcctctctttttaaataatttttatctcaaataagggaaaaatcaaaatggaaagaggttatgatcagtttcaccattggcctacagtattgcttcagagaacaaaataaaagggttcttgcctctccccttgctggaactgggcctgccccagggacttggctgtagggttgcaggtactttccctgtcctttgatcttaatcaccaagggagcaattaaagttccatgtccaggaatcacttagtaaagagtcttgcttttagttagagagttgaaggggttgtgggcaatatctaaatatgctttggacattgtatttgatggggttgagaaataaaaaaaaaattctaggctcctaactaactgaatggattcccctcttggccaagggtgaaactgcctttgcaaaattattacacaaagagaaatctaacatagttgactccatcttgcttctgacttccaagctgtccttggtcattcctgggtgtaggccaagctcactttgggaggaatttagtttatagttttaccttaaaacaaagatgataatagcccttctcaaaactaaatcacctttgtaaaactaatggaaaggcacaaggttaaaattatgagagaggcccgaattctgataggataggcatagtttttatcagcccttacagatcaggaatcatgtgaccagaggtcacaagatttgtgaccttcccatttactcctatagttaacattgctatgttagaacccaagattgtattttgtgggggatgttttccagactgatcctacctgaacttgtgattcatgactcaattgatcctatggcctcacccagaggtagactcagcatacgaagactgttttccataccagtatgattccatccctaaccaatcagtggcacccattccctagccccctgcccaccaaattgtccacaaaaaccctaagctccaagccttcagggagactgatttgaatgataactccagttctcccacgtgagttagctttatatcaaatgaactctttctccactgcaatactgtggtctcagaggattgatctggtctgtgcagtgtacagtgctgggtgattaccagagaaactcgggaagctgagttcatggccttggcgggatgggaggttgaactagtctcactagtatgtaatcacttgtctcactgctgtcccctccccaccttttttaaaggaaaatgtacaaatagtaaacttcctgagaccctctttggaaaaaacagccatagatgcatctgtgacttatgtttttcctggacatgccctcaagctggctcgataaaccttgatgactgagatttatgactcagtcactcattttgattgtcacagtataaagggcctgctatggtctgcatgtttgtgtctctccaaaattcacatgttgaaatctaatctcaaatgtgtgggcattcagaggtggggcatttacaaagtgatgaggtcatgagggtggagcccttgtgaatggaattaatatccttctaaaagaggcccaagggagcttgtttgccccttctgtcatgtggggacacatagtaggcaccatctacaaggaagggtcctcccccagacacggaaactactgttggtgccctgaccttattaattatgattgagacaatcaaatatggtctggctaagagaagaatagtccataacattttgatgctgactccctaaagtctatgttttgaaatattgaatatttaacatgaagagcaaattacaattaggacgtcttaggtccatacaaagtaatattctatggactgcctttggaattactaggtttggtcttgggatcagattgaatgaactcagtatagattctgtgtcacttctactcatgaaacacatttactgatggttaatctaagagtatctttaggctaggtacagtgcctcacacctgtaatcccagcactttgggaggccaagacaggcagagcacctgaggtcaggagttcaaaccagcctggccaacatggtgaaaccccatctctactaaaaatacagaaattagctggatgtagtagagggcacctgtaatcccagctactcaggaggctgaggcaggagaatcatttgaacccgggaggcagaggttgcagtgaactgagattgcgccactgcagtccagcctgggtaacagagtgagactccatctcaaaacaaaaaaagtatttttatatatggcaacatgttgctatatagttatgaaataaagtgttgacaaaacttgactgaatgtaatcatagtgaagccaacgttatgtgtcatatgtcacctgtgcctgttttgtcacaagtgctctttacaaaccacttagcatcttcactttgaggttgtatgctcttatttaatgctccatagagttttgagattgttgtgagttttctattcaacattggcttctccaaagatttgatcattttttaaaacagctgtaaacctattcaaaatttatataacatatatttaaaatataaggacgctttctgatttcaaatgcatctcatgcagttaataaaattggtaattggtaatttagagtcacagataactctaagtaagtcaattaaaactgtgtaagaatttgaaaagaggatacagggcattgaggggattgacatttggtggccaagtcattatagctattgtttggaagaatctgatgatattcaaatgatcaaagcaagtattttgaagaaataaatgatgtgaaataactgataaagagatactttaaactgacattatcctacacttaaatataataaaaatacacagtaataaagcaaaataacagatttgttgtttggctacaacatcaagtcattctcaactacatattttgacaatagtgactctaaatattttctcaaactaagctttcctaaatattttcccaaaccaagctgtttctttacggactttatatgcattaattttatatgaatgactatttttctaacataaaaacaatctttacaaatattttgagaattcaggaataaaactaaagcattcaaatgaccactgctcagttgtacttgagagattttgcccaaaattatttaaaagtgttgaactgtagaaggccttaaaatagaacttgtagaatttcaatattcagaaagtaaagtttgttactatgggtcatactgttgtgaaaaagcagaaaaagaattcagaataatcaaattgaaactattttgctgatataatcaaatatgcctgatgtttgttgtggttttaaagactgtattttctctttggacatttctccatctttctttttttttttggtgtaaaatatacacaacataaactttccctttttaactacttttaagtgcacagttctgtggcattaagtacatctacactgttatgcaaccatcaccatcatccatctctggcactttttcactattcccagttgaaactgtacccattaaacaccaacttcctatttttcccttcctcagcagtcaccattctactttctgtctctgtagattgactactctaggtaccttgtacaaatggaatcatataatatttgtccttttgtgactggcctatttctctattgttttactaacataaaagtattttatctgttattaattttatctagtcagaaactggaaacactgacagaatctttggctgattaattacactacaattgacaaaatactgcccaaacataagtgatttactaaaatatgggacatgatgtttaaaattaaaaacctgatgaaactgtagtgtcagtctcaattgcagttgtaatatttttcctatagccaatgattaaaatgtgcatttgttagtgattttaaattaatttatattaaatttactattttcccatctaaagcagaattaattggtcatttttttggcacatgaattaaaacatatatacactgtctttggtttgctaaaagaatgaatgaatgatataaaggcatctcatgtagaaagatttgttcttgttaattagcaggtttattagaatatggtttctttcatctgaattttggagattggaaaaacaatctccaaaatataaagaatgcagagaagtgcaggagaagagagaatggtaagctaaaaattaccatcaaatgctaagtgtcagacctacacaaacacaaaatttaacatacttaacagtggcatgttcagtgaatatgagcaggagacatgagctcaaatctaatgatatctatgatgccagaaactttgtatatgctgaatttaatccttatgacaactctctgagtcatataatttccccatttttgcagatgtcaaaactgaaggtaagaaacggtaagaaatttgcctagtctcaacactagtcagtgtcagagccagaattccaattcatgtctacatttccaaagcccatgttgttcccatgacacaaaattgtagcatgccttacacttattgacttgggagagttttttttcttaaaaatatagtatcaatataattttagcaaatcttactgccattagaaattggtaacatttatttgaggatagacttcaaaatctttatgagacataagaaaatgaagttccagaataacaggaatttgaatggtagttttcacctttcagaggatggttttttgggggtggtaagaaacatctaagtattggttctcatttgggggcatgcttagaggcatcagtagtttctggtaaagtaagggtctttcaaaagaaagacaaatgaatgatactgtataggtgcagttacatcataggcaccacaataaggtataaaagtaaagcattatgactttcaccttgggaaagaactttgaaatgaggaaaacaaaattgcccaataaaggtgatattttataaccaaccagtgtggactagtggagcataaagtttctttaaagacacaaaatagctgtagcttggattgcacatgtggatacatcaaaataaatatgtgtcaatcaaaagtaatatatgagagtttctgctttggcacattctaacttggtgttatcaaccatttacatttttcataagctaaatagtacgaaataatctcatacagtggttttaatttacagttttctaatgactagtgatgtggagcatctttttatatgtttatttatcatttgagttttctcttctgtgaactgacagtgcatatgttatgcaaatatccaaccttcaatgtccaattttgaagtcttctaatagatgtgaaatttgtgtatagattcttttgaactctacctagacaacatgggagagacggagatgcttaccaaacccattctcttcttcccaggcacacagttacagcgtgtttccccatctctcagttgttttgccatgtgacggactgaattctagaaaatgtaatgtggacagaaatattgctatacctattccataaaacttcccacaactgaaccttcattgtgttttaccatttaccagctggttggagaggatcaggatctaaagggggtcacaggtgagacgagtaatcatgtgaaaggctgcacaacagagaactcccacattggactataatttgaatgggaaattaatctattgggttaagccactgaaaatttgaagtttatctgccatagcagctaatattgtcattaactaatatacactatgtatcgttgtgaataatgactattttgtttcttcctttacaatctctatactgtttatttcccaggagttgacattttattatgttttgtttctttcttttcacttccccgccgtgtcacctaggaactctagttcaatgttgaataaaaaattttgaaagtggccatctgtgttttgttactgaatttcgagggtatgttgaagtttctcttttaagtggggttttcttttcttttttttagagtcaggggtctctctctgttgtccaggctggagtgcagtggtgtagttatagttcattgcagcctcaaactcctgggctcaagggatcttcctgcctcagcctcctgagtcactgggagtacaggcataagccaccattccttaagtaggtttttcatacataaacttaattaggctaagaaattttccttaaattcctagtttactaagaaaattttactgtaaatctgtattgaattttgtcagatgttcataggcttgtattaacatagtaatacatattttttggcctttaatctgttaatgtaatgaattacataacagacttttccaatgttaaactatcgtacattcctgggataaatccccttctgtttttacatattattgttgtctaatattttatataatagttggccaatataccaatgtttgctatactgcttttatatcactgttattggttatttttttcattcttgatttacatggccaatgttcatttggttttacttacatatttaccagtttctttactcactactgtctctttcttctcactttttcctttgagttcagctttcttatttctgaattacagtcttcacagttcttcagctaatagcaaagttttaaagtctttttctgacaatgccctttttcattcttattcttgaattttagatagctgggtataaatcctttgaagacactgaattctattctgaattgtattgttgttattgaaaggttcttcttcttcctcctcctcctgctcttcctcctcctcctgctcttcctccttctcttaggtaatatctttgtctttgtttcttctttagatattctctttgtctttgatgttctgtgtttcaccaaggatgcactgtgtaatggctctagttgtgagtttctttttatttaccctatttaggattcttgactttaatcaaatcaattaaagtgtacttttctcccattcttttaatattctctatgtggaattcttatgagacatagattaaacattacttctatgtctctttttaacatatctatatacctctctgtgaatatgcacacacatacacacatatataatatatatatttgtatatgaatattacatatattttgtgtatatattatagataaaagtatatatacatgtgtatttatatgcatattgcctgtgtatataaaattaatcatatgtaagtttaatttctatataaattatatataactttaatttatagttaatttaattatataaagattacatatatatatttgttgtgttttgtttttacttgcagtgccgagaattgaggtaatcatgttgctcagttcatggcacactattgttatcagtgggtgtactatttctcccttggttgtttgtttaatcattcctctttattctcatttcccacttatattttccttctcccataggaatctaatgtatttgttagaataagcaacagcacagtaccacagttgtataaattaaaatatatacccactaaagaacattatgtatttttaaagtacctatttctcactttctatattcagcattctgttttaaagatctatatatgttgctgtatatttatctagttcactgcttctaactgctgcatcttaatatataatgtgctgtcattgcatttccctgattcactcttcagtgctggaaactcagggaacttccaacttcctgctgtgcaaacaatgatcaaataaacattcttttacatgggttttatagacccttttgagaatttctctgggatgtattcctaggaattagattgattggtcattggatagacatatttgagccttatcctcttatattttgcatcttttgctgaatttgggatagtttcattaaattgatcttccagtttgtattttatatgttttaaattttctgtatattatgatgttttgacatcttaaaaaaccctttcttgctgtaaagagaccgcccttcctggctctagccaattcttagagatagcaaaggactcagttaggagcgtactttagatttgcaaattaaccaagttgtgtatcttctgtgtggcctgtacacccccagggaaaaatatgcttgtgtcttaatcatcccagggccatgtaccaggcaattagggactatctctatagtttagagcctgcagttattattcaaactaaccaattctaagaagtttatcctgccctccctcacgcttcctgtcccacggaagctccaataaaattctagttttggttttcctcttacttctgtcttctgccacctgaccaaaacctggtgattccccggtaactctgtatggcatgtggtacccccctctctagaacctgtgaaagtaataataaactttgttttcttgtggctttcctgtgtcccctgtgctgcacctgattaaccatcacctaaaagaactcagaatacgattcatacattttctcttcatctgcctctaatatgatatttttaaaatgtaaatgattagaagctctatttgaggataatagattgagaaaatgattgagcagaaaaagtaaatcaaatgagaatactaagacccttcaaaaaagatatggcagaaattcttcatgtgttttacaattttagaatgtaaactcataatttgttttgagttcatttgaaagaatcacatttgtaccagtcatgagttgatcagaaaaacggatcgtcatgaatgaaatagaatagtggatttaattagaccttgtacaattggggaactggttaagaagtccatgtcaggctgttgctttttcatgtggtatttactggacctggggtcactgtagataagctggaaggcaatcaggaatgagagttggatttgaaataggaaagggcaaggacaaactggaacccacaaggtcagacgggaaccccagaagacaaaatggagcccaccaggacaaactggaatttgactctgtctctcatgatctctaacttcaataatgttagtgacctgcagagaagtttgaacccttcatcctgaagttgcacatacacttggcccaggactgaaggaagtcaaagaaggaaatccactggaagctggagaactgtgggtctaggtgcttctcagtgtcaataaggtgggttaatagattagtgacaacatgtgcaaattgccaatgcctggtgtcatatattgagtttcagagtataaaatggtggcttcttcatttgtgcccttcagttcccagaccaatgtgctttatggcctactccaaattgagaaacacacaaagaaataaattctgagaatgtaattccagtttagctaggttgacatagtataaaaccatattacactagtttagttgaaggtatgtatctacggatatattttgtgtttatttcttttaccacccttgaagtatctccagctttggattaattttaatgtaaatttttcattttggagctttctagaccaatagccaaacttaaaatgagttacttgacagtggttctgggttctcaaggaagagtctctatttcgccattctgaacagaggctgagaagacaacttacccagttatttccctatacctatgggcatattagttcacacttacgctgttatttagagtggagtttctctaggttctagactctggtggtctctgttccaactccctataggagtagggacagacgaccttatctcctgcctcacagtggatattaagacatcagcctctagattacctaagacagcccttccccagagtagacaaagagtcagatctgggctttactgctgtgagtttcagttctctattattctctgtcccctgaagagctatttattttccttctagttcagaaatgcattaaaaattaaaaaaaaaaaatctagatttttcagatgtttttagttgacattttcaggctaactactctgccatgttacctgaacagggagtccattgcatttgcaaccaagaacttaaatgcagagacctcttttacaaggatagggtgctttagcaaattcagatttacaggaaagaaaattacaaatatacaaaacagatcaattagagggatgaatttgcataacaaaaggactcgccataggactagttaaaatagctaggatctaacagtgaatttagagcatctaggaaaatgtgcattgtataaatctatcaggcctgtagttaaagaaatgcggggatgaatccttttgtaaagcagaaagtcctttttgtaatgtgaatgagtactctctaatttacaagtctgtaagtttgagaagtttgagtctttgtgtatctggcttctcaaataatagagatccagaataagttatttatacagagagttcaggtttaactctcctgagtatgatttttctatgttaatataaaataatcaaaacaatctgcatatttaaagaatggaatcatgaggtccttcagacgtttaatatgtgcatttctacataatttcccatgggtcttgttactggaaatatgttgaagacaaatgtttccacaaaatgaccgatttcttttgatagatctatttaagcacacagtaaaaaacatcttgaccagaaacataattgctaattcactgtgttggacattagctattgagttattaaccagttatctgagggcctaccatgtgctgatcagagagtcagagttccttagatatcaggtacccaaactcttcattttccagatgaagaaactagtgatgtcaaatgacttgataaacagtttcatggctactcagaggactgcatgaaacttccagcatattatactgctttctttaatagagtgaaagagtccactaaattaaagaggttgtcaactccatggatgagaaatttatgttaaggaaccatgactcaccccgaagggtgccagactgagtctgtggcccagtgcaaagggcacagagacatgccatcagacaggcttgtgcctgcatgtcttgcattgacgttgggcaatttattaacttctctgaactgcagtttccccatatgcaaagcagaaaattaatactcatcctgccatcctgaaaatgtattgttagaaaagaacattattatatgggagatatactttactgtataaactccaaggtactttaaaaatgtcatttgttatgattattgccatagctactctagagaatgcatatatcaaaagatctatgaactttcacaaatatttttgcagaataatcaaggaacaagttgttaacctttttctcagaagcaataaacaagaaaaatctagactagatgtttatacaaaaagttatttacaattcagagctgtgtccaatgtcatttgttatcattattcttatatgagtgaattaaatattttttaaaaaattaatacatggaaagcaatcagaagaatgatttgcacacaacaaaatgtatatgaacattggttattgttaattatatcctcatacttttctattcctcctgcaattgtgcaagccaaactctctcaactctgaattttattttctattgtttgaaatgacaaagatcatgggtagctgataattcaagcattgtttttgctcaatgggaagactaagatgttgctttagggagtaaaagtatggggagacattgtaacaacagctatagtgtcaaaggacagtgtgtttttaaatgtatgtatacattatacatttattcccacttagcttctgttataaaagtcctgagacatcttctgggctttgatctgtttatggatccagatggcagagaggtgatgagaccacaggttagagagaaaatttagtcacaagattggaaattataagccttttactgcttaattattcccttcctgaatttcaggatatggtcacctatgaaggttattttacttcaatcaatccttggatgaagaagacaataaccatagctgtacaaaagaataatgagatttaagtattgcaccgatttttacctacattctctaattgctcattacctaaggcagctcagaaatgacgaactggctcctttttcatggtcaggacagctgcttttatatgttacatacttgtttaatatgaacttcaatggtttttagaagaaggaataattagaacaggtacagccaggggatttttataactcctttaatgaatactaaatagtattttatctttaaaagggaccatggctgcccttaactgcaaccaagttcattaataaaaagttttcatgcagcagacacaaaacaatataaagaaaccagagaaaaatctaaactgagagctgtagttactatctgtgctaagtgaatcaagcctacttgcaaagatgcataattattttttaataaaaaagaaataaaagattttgctggcttaaccaacgataggtaatgatactaaaaatgacatgagagtaggatgctgtatactgattccagctgcttctctttcgagttgggattatctgaattggaaaagaaaatccccatttccccagcaaggtacagattttacaaaacagagatccatccttgacatggtaaatatctaatgaaaccacctcttctttccatttttttcccaccctgagccacatgctgtatattaaataaaggactcaactttgttcgtactggagaagttgtctgggctgctgcaggatggaggtttacctgaggttacctgtatgaagggtgaattgctcacgctttagagcactgttatctttctccccatgtactccttcaacagcacaatctacagtgaagtacttgtcagggtaagcggtgaggaaagtgagagcaggttgatcaataaaacatagactggaggaagcctcttccacaggaaactaacaatgcataagaagcatattcttaacaatgtttggcaggaaactcagcagcatgaaatgtacttaatgtttaacagaagttctggaagaaggcagctttacacgtgacgtaaagaagattgactgaaggcatgctggggtctctatggaaagagatttggatgtgaatagacctgggcttgagccctggctccaccatgttctcaatgtgggaatgtgtgtgagttcctgctcctccccttcctctgctgtaaaatgggaatggtaacacctgccttaccagactataagcaaacagtgatctgagatgtgtgaaagctttgtcaactctaaagcactattaaaatgcttcaggaaagtagagggaatttatcctggtcacctgccttgggaacagtcacgaaaccataatgtgttcccagtcctgacactggcttccctctggctcaaaaactgggtcttgcaatgactggctttcttctgattttcaaggttgagtgactggcagtctgcctgggcacacgtcaaagagcaccaccacatcaactgcatggctgcagtccctgtgcaggcagcttcctttgctccccagcaagtgcaggggctggcagaggctgcttcagccttgtattgtagggggaaataggtgccacatgctgttatgaccatggtgatggtgggggcgactggtgcttctacataccctggttctaagctccttttctggatctttgtagttacacatgggagtcaacagcccactgccttccctttatcctctatctaccccattgccttcttccagcttccccccaacccccacccccgtctaatgaaaaagaagttaaattcctatcttagcatcaaatccagctgtagttttttctcccaactaagcacatgcagtacggtacctcctcctgtaccatatacctcctccagtaagatactcctgatctctttctcctcctctaggctcactttaaggtccttgttgtatgtgaccctatgtataccctgaatgtggttcttattgaactgtactataactgttaacttgctttcaattagaatgcgaactcttcaaaggaaattcttactcaccagttgtctctccatcatctagcatagtgcttggcatacagtaagtagatgtaaatgattatcgaactgaattgatcagaccctaccactcccattgatttaaaattatacatatgcaaagaagggtcattttgagaccacagtgcaatcaagatgaacatgtctctaacttctgacttctctctttctgaatccgtctaccctagctcacccatctgtctctgcaagaagggccaagaagagcacagactcagtcaaacaaagatggaacaaaattggtcacaacttgaactattccttctttattttccatttctgttttgaccctttaaaaggaatttcaaaattttactttcttctggtgctactaacgtaaaatgcctaataatctctacatggatacacgatttgaataattatacacttgatggggttataaggaaagtttggaaatcatcttacaccttctagacatattccaagtcaaattgattaaagaaattagttctttctccttagttctaaatcatatgccaggaattccaggtttgtggatttgtcatttaattgcatattattgataaatagtattaaagacctttcctgaggactcactgttctgagtggtttctatagctctgtgacagatgttaccagttggccagtaaaatccattccaatttcctctctcttgcttgttttctcctgcagagcctggaaaaagctaagacacactttcccagtctcctgcaagttggacggtggctgtgtgacatggtctggccaatgaggtgtaaacctgagtctgctggaaagatactggaagaacttttgatatcctgataaaaggaacacacatctctatcattgctccctttccccttcctccatctgggaatgcagatgtgatgacagaagctgccatagccactctgcagtcatgaggcaaaaaacacaaaagcatgaggacaaagtgccatcatgctaaggagagcacagcaaaaagacagaaaggctctggtcctaaatggcacagctaacaagtgcccatttccatgcctcttgccaaccaacacaattcatgtccttatgatttcaatccctggtggtcaggttttggtcacttgaagctaaaagcattcctaactgattcaaaccccaaataaaaacattgccctaatgatgaaacagaaattggttactttggcctcaattaaaaaatgaaatgtagctaatctttaacaaattcaatcctaaatagttctctttatgcctactgtcaggcaggcccttcttctgtggctggatctgatttcctaaagccttaatttctaactcaacatagcaaagaggtggagggaagccatcgtgcccaaaccctcatgggggtcatgacttacagttgactgaggatggcctccatttatcacatagtctattgcaacttgaggttcctttaacaaatactaggttataacatttaaagctgatatcacagcttctgttacaagaatattattgtactagtttcctaaggttgttgtataaattaccataaactgggtggcttgaaacagaaatttattctcttatagttctgggggccagaattctgaaatcagtgtgtcagcagggcattctccctctgaaggctcaaggggagaatccttccttgcttctttgagcttctggtggctccaggtgttccttggcttgtggcagcatcacgccaatcttcgtcttgtctttacatggccttctctgcttcctcttctcttttgtctgtcttcttttcttataaaaacacttgtttgacttagggcctatcctgttaatccaagatgatctgatcttggatcctaaatgaattagatttataaacactccttttccaaataaggtcacattcacaggttctacgtggacatatcttttggaatgccaccattcaatctactacaactctagaaaatttattccactttccttatttatttttgttgggtctcatgaactttgatttttttaagctgtgtgaggaaacatttatggcaatttaagttttgtgttgcatcagaatttaaggttgtttcaggaaacacgtgttttatttcacattttaaagtaaagaattatttctctgattacattttagtctttatttctcatgttaaagtaaaaaataggtgacttcagatcagtaagtatatcatggtagtgatattaaagagtatttactaggcttagtataactcaggcaaaacatttcttgcaaattattcaccataatctttgacataggctggattattagttttaaggcatgaattactttctacccaggtcaatggtttttaaccctgttacacattatagtcacctggtgaacctttaaaaatgcatgcccaggacccatttcaaccaatgaatgcaaatatgtggggatgagcttgtgcataaaagtctcctaagttattcttatgtatagtgaggattaaaaactgaccttgactcttattagcagttgccttattcaacaccatttatttattcaatcaagtaatcattatgcacttttaagtgtgtaagtagttgcagtacatataaggacatataagaaatgcaggtttataatttagtagtcatggtgtataatattttgtgtaatgtgccatttatactccagggtggtagagccaaatgcttatagagaccttctctgctggtcactcttaaaaattcaaatcaatttatagaagtaacttgtatcacaaaaaattagccaggcatggtgaagcatgcctgtaatcccagctactcaggaggctgaggcaggagaatcacttgaacccaggaggcagaggttgcagtgagccaagatcgcaccactgcactccagcctgggtgacagagtgagactccatctcaaaaaaaaaaaaagtaacttgtatcattattgctttaactcctctgcactcaggtgcgtgtgtgaacacacacacacattgctggtaataatcagagcaaaataagactcctatggttgactatcttcagattacaccctttacaaggtcaggagccttttaattattttagatcccccttccgcagagtagaaaccaatatatgcttgtaaaaactcacgactggtagtgatccctattagtagaaaaagcttgagcagtaaagttgcctgtgccctggagaagtgctgaggactagaaattcctctagcttccagctatttgggaagacccttgggtgttgagccaacattggcaggtgcgaaagggaatgacactggggctgaggagaggatctggcagccaattagcagcgcttgttagagctcaccccagactgctgtgtgactgctcattcagacattcatagacacccctgtcacaaataagccacccagagctctgtagtcgtacaaagcagcaataggagtggagaagaaccatgtttgtcaggaaggccctgcatgcaagagagcggcagggcagagagcagagtagagcttggaggctatagttgtaataagctttcaggaaaagagaactgagcaccttaattattttatttttttttttgacatggtcttggtctgtcacccaggctggagtgcaatggcacaatcactgctcatttgcagcctgatctcctgggcttaagcaatccttccacctcagcctcctgagtagctgggaccataggcgtgtgcaaccatgctcagctagtttttgcattttttgtagagacggggtttcgccatgttgcccaggctggtctcaaactcatggactcaagcaatccacctgccttggcctcccaaagtgctgggattacaggcatgagccactgcacctgacaagcaatttaatccgaggagtcatggagtcttatacatgtgaagtcttgttgatgaaagataggaagatggagaggagctggaggagaacatgatattaagccaagtatttaaaaactactgatgagctaggaatcaagctgagtgcattcattcatatgttaatcaaatactttttgaacatcttctatgtgtttcaggtgttgacagtgcagaggtgagcacgtgttctccagggtgaaggacactggaggagatttagggttataaaaacaaacagataacaaatgcacatatattcagagtaacatgatagaaatagatggtcaggagataccacctcagtttgggcgatgaggaaggccttgacccaaggaggtgacatgatgtgagctgagatgatgtggaaggtgttggggcttagaaaacaacaccccaaaatgaaggcctcagaagcagcctcagaagcaaaagtttttctctgaccttctcctgccctcctgtttctcagtcccattctctcctgaggctagctatagaaactaggatccctcttccccagggtgggtcatagaaaccagaccccttcttccccaaagccagccataaaatctaaaaatattactctaactttccctccacctttctatgtgaaaactggccacagagaaattatctgacttaccttgtttgactgtaggtcgtaatacccccattccagagagggtcttgcccaacacagagaaggaaggaatgcatgctcaggggggccaagaagaatctagacagacaggccttcctggctttcttcactcagtctattagcattagatcagaccctttttttggtccaataatatttcggcacagctgtccatactttgttgaaacgaagtgtaaaaatggacaatctccccagtatttttgggtcttcatcctgaaggctcccatgtttacatgctaaataaatttgtatgccttttctcttagtaatctgcttgaatgtgaattgatttttcagcaaacctttagagggccaagggcaactttcttcttggccccaacaaaggagaaggacggagatgcatgtaaagcggtccaggcagagggaagagcaactgtaatggccctgaggcaggaatatacttggagtttgcaaagaatcagatgatatccaggctagaatcagagtaagggcatgtctggaaaaagtggaaaaggcagcaggggttaatgataagcacgtggccatggctgggcttcgggaagggtgaggcttcaggtctttgtggtttggtctgaaagcgactgaggttccactgggtgagctgctcagggcacatcctgatgcagacagcctgttggctctgacagcagctctcccatcctcccagctgcaatgactgccgagttggctttgctttgagtattccaatcacacagggcctgcacctctctgcattccctgggggtgattttgatagtttctctgtgtgcacagtgattttgaggcaggagatacatgagcgactgcagcagcataagaagtcagtggtgtcaatgcctgacaactaccatgactgaaaaagttagattcctgaagtgacttcatttatattgccatatcctgacagaatctgaggccactcttggtatatgaacacagtatcatcttatatatatggaaataaaaaagaatgggaggtttttttttttcttaagcaaaaggaaaatattaactcaagacccaaactgttttattcatttgtggactcccacaataccttccttacacagttatttcactgattctagaacacacacttttcctcatttaccatctgtgaaatgataatgcatcttacaatccacagtgcctcacaattgccatcacatggttgtcatagcccatacccacatgcttggtcatagctgttcatgtgttgagtataattggcatttaaactgtgttcaaaatgattacattataatttggcatcagtacttggaaagatacaaatacagtagggagaggataatttgatatttgtgaagcaaataacttcactggagaagagactgcaatgacatatttcctttaaaagcagtaaccatgtgcattgtgggtctgaaggaaggaagatatccacaaatgcatgaggccttattatgctttgttactgcaatatatgaaaaagattacatgttacatgccaaggaactcaacaaaggcaggagtaattgacaaagccctctatatgaaggaaatgttcaatctgtgtgaggctgtgatgggtttatgtgttggacagaatcaccataaggctctgtgtcacagattaattggcagcacttgtttttcttttgtaggaatgcataacataatgatgcatcttataatagatggtatttctaggttccatgaaatagagtggaacaaagtagatgtttttgtcgttagactagggctatgcaaatactagacctcacttatcccatcacgttcaaaatgtctctgcagtttatttacatattaccaaagagctgtccacttgaaaacttatagtcagcattgtgtctcaagccaaggtaaaccaaactaaacattcttatggcaacatggccaggcgctgtggctcacgtctgtaatcccagcactttgggaggccgtggtgggcagatcacgaggtcaggagttcgagaccagcctggccaaaatagtgaaaccccatcttgactaaaaatacagaaaactagctgggtgtggtggcgggtccctgtaatcctagctactcgggaggctgaggcttgaacctgggaggcagaggttgcagtgagccgagatagcgctgctgcacaccagctggggcgacagagctctgtctcaaaaaaaaaaaaaattcttacagaaacttgatactcttggttggtgaactgaattttatcaaaagcatctatggcacacaggcagatgattgtagaatacatggccttaatgaaaaataagctaactgcttaggcgattatttcaaattcagtttaaggaagtcactgtgttttagcgtctgattttgaacatcaggactaaagaccctgaggcttttttcctttaaggtactatcaggtcagtgtgaaaaagctgtttgccaggggagccagttggaaatgaatgaaataatttacattcctgctgtgggcaagttgtcaatcattatgtgtgaagcctgtaccatcatttttctcctatatctacacaaggatgctgtcttaaggatgtagtcaagtgccgtgacaaatagcaggtcaatagctgaggacacgttgcctggtgtgtggtggtagagaaagggcacacctctattccccaaactccaggccggctgcttgatgtaatagcaggttgtaaagtgaaaaagcttctgcatgaaaggatagcctttacatggggtacagagcgcagaaacgttttttggccacacattggtttttctcagccatggatcataatgattatcagtagaatcatttgttttaaatgcagagaagagctgaaatgcttctatgtatcattgcttctggagatttctagaaatgtgtgctaggtagttcaatttaccatgtccaaatggaactcttgatttctccctccaaattttccctaacaaatattcccaatctcaagaaacctcaggccaaaaacatttccaccgatccttaattcctttgatttatctacaatcaatatcacattcatcatctctattttccttgtaaatcctgactcagatattctcaccttcttcaccacaccactttagtacaaggcaccaccatctcttgccccgactactaggtgaatgcctcagtaggttttcaatgacctccatccccattcccacagcagccaaagtgagcctttcaagcataaaccaaaccatatctctctcctgtttaacacccctctgatgctcatgctcacatttagattactatgcaacccctctccacagctcacaatacctgatcctgggccaccactgtgacatcttttctatcagccttttccctggctcatgctactacagccacactggcttccttgctggtcctcaaacaggcacggtcctgccgcaggggatctgcacttgccgctccctcagcctggagtgctgatctctgcatggcttcttcccacacttggttcagatctctgcctaaatgaaacctccttaaagaagtctttcctgatcaccctcctgaagatctggtcactgtctatcctcttaccctgctctatgtttccttatagtatgtgccactagctgatatcatattacagacttatctgttacctgcttattgtctttgtccagctctagaatgtaagttccataagagcaggagctctgttggttttgtttccaatgcatttctagagactagaacagtgcttggcatatagtaggtgttcagtaaatattttcattcaatataaatactacatatacttcttcatatgtcgtcttcccagttggacactttctaggcatactgggccctcacaaagatatatagagtgtggactacctttcaactgaagcattttaccggacatgccaactgatggcagcacccagggatggcaatgagatggtgtgtgcatcacccaagtggccctccacagtcaagtaggtcgctgaagtctgtctctgatgactttgcctcccacgtcttcctctgtgtctttctttcccattcctcccctggcagcaattcattcagtgggtatttttaagcacctgctttgtaaagggcattgtgtgaacatacagctgagccctccgaagtcaggtcttcaaggagtttggtgtctggtggagaggcgcgatgaacccacacaaatacaagggctggtaaaaggtgaagtgtcttgccccagtggaataaggaactagaaactgaaattggctcatctgactctgagtccagcctctcatccactctgctgccttgcagcccacccaagcctgccttccctctggcgctcctctgcagtttgtttgtttgtttgtttgtttatttatttattattatactttaagttttagggtatatgtgcacaatgcgcaggttagttacatatgtatacatgtgccatgctggtgcgctgcacccactaactcgtcctctgcagttttaatctttgttctaaatcctccttttccccttctctatattcaaagcaccaaatcctgcccttctaggtgaagttatacatcagctgatgatcagatcagactagttcacagtaagtgagaatgactcatagatttagttctctcaggtggcgtttgtattgtagtttgtctctgctgcagccagtcacaaggagatacatgtgtgggagtatctgtttctctatttttggggggactgcgggaaaaaggatgccacctggggtctgcttatttactgtaagtctttctaccttaccctgcctcttgggcttccataatgaagtaggtctggccatgggtctttctccttccttagtacaatttctaaagggaaggcaatattccatttttggcatttgggaggtggtgaaacaggcaccctctctgttctctctcactctttctctctctctatgtgcgtgtgcgtgtgtgtgtgtgtgtgtgtgtatagtggtactacagggtcatttataccagcacgcctcataagttgcacccctgttcgtcttgtgcaccatgtgccctccagtggctgccacgaagaagaaatggaacttcctaagtcagccatcctgacagacactgttggaaactttctctgcaaggctgagaacatgagggaaagactgcggatgttcattctgttgttaaacgtatctctgttgcaagaccagcctagtgtaccgcctttcatgacacaatacatctgtgaatataaaataacaggaactggtggcttttctcatcaaaatccaaccagttctcttcagacacttcttaacctgtaaaatgggaatggcaacagtgtgcatctcatagggttcaggtgaggggaaatatatcaggatatatgatgtatatatgacatatatgtcagacttagaacactctcacacaaaagtgtctttaggtcaatcaacaggtatttatttgccacctccggtgtgctagaaactgttctaggagctggggatacaggagtcaacaaaataatctatgccctgatggggctgattgtggttaataatcatgatagcaaaggcatagccaggatccaaatccccgcagtctagctccgagtccccagtctcctccatgactccatagcacctcttgttcactgagcaagagaatgcgaataatacacttgagatgacgttgtgagttgagagcctggacctcagggataaagacctgtacttggcagccatctactttgagtctgctagctgaaacctgtccaagaacataacactggggaaaggaggtttgagaaaaaattcttgagcaagattgacaattaacgaaggggaagataaaggaagagttactaaaacaaattcccattattgttactactattattccctgtgctcatctagaggagtcaagtaacctaaggaatcaaattcaatgaaaaaatattggttgcacacccactctgagcgaagagtggatgtgcaacaaatatttgagcaaggcacgaaaatgatttttcattagacagatactttgcaatttaattttctaaaatagctgagtttgatggtcaatgagttcaataaacaattttccagctttttatatatctagcaattccatgatcacacagtgtgtttatcatctatcattctccaattactgaatattggttggggttcctgtcccccagttttccatacatttaggcctccttgcatggtaccctatccaggtcatttttttccccccggtgagcccccattgatcatcttagattttctgagatggttttgatttcacatattttgagtgggggcttacaaacaataataagatcatccataattctaaaatctctcttcttttctctaattaaaacctttgtgggccaggcacattgactcatgcctgtaatcccagcactttgggatgcctacataggaggatcacttgagcccaggagttcacaacaagcctaggtaacataaggaaacaccgtctctacaaataataaaaataaattagtcaggtgtggtggtgtgcgcctagtcccagctacttgggaggctgagaagggagcactgcctgagcctggaaggttgaggatgcagtgaaacttgattgcaccactgcactctagcctgggtgacaagtgagaccctgtctcgaaacaacaacaacaaaacaaaacaaaacaaaataaaacaaaaaaacccataaaacaccaaaataaaacaacccccccaaaatctctggggtgcactgattgcagtaatggtcccatttcttcacccttccctactctcaagctatttaccgtgtgattttgcagttgctcctattgagaggtgaactatatcctcccctcccaagctgattttgagttttccatatagcttcctttggccaagtgttggcagatgtgatgtaagtagaggtgtaaaaaagcgcttgctcatttttgtttgtttgtttctttctttgttatgaagacatgtctgcgatagcatactagagagtggggcacagggagtcccagctgtttcagctgagaccaccccaggtcagtcaactctcatatgccagaagactagagccaactgccagatgtgagggagccagatgagatcagaagaaatttgcagccaagcccagcctaaatcgctgacccacaaactgtaagctcagctaaacaaatgtctatcgctttaagccacttcattttcagacagcttgttccatagcattgttgaggcaatggataactgataatgcttcccataaatcttaggaacttggaagctgcccctccatttgccctcctttaagcaaaaaattgaatgctatttgcaaagcattgtataaaatgctttattagattatcttattgaatcctgacaacaatatctagcagacagatataatgctattatccaaatttcagaggcaaggaaattgaagcttagagaagtttaagtgacttgaccaaagtgcttttagaaaagcagagattctacaaccagtcttctaaatcttggaagactgcttttagccacggctgcctgccatttactctttggattctccattctacctgttctgctgcctacttctaccacctaattaggagaagaccttgtgttcccatttgggatatagatacccactttcatactgggtttacccctaatatttctctccataccactcatgtagatggttgtcttccgcattaatctggaaattttttgagggtaaagactaaaatacttatatttttatccccacaactctatgcagtatttttttaaaaaagatcatagtcatgttttaaggtagctattccataaaacatataaaaaggtaaaaaatactctcctagagaatatatgcatatttaaaaggacactgttattcaaattaatctaatttgtggaatacacagtagagggttttccccattttgttaaatagttttagttatatgttatttgaatgtagtgtttgcctgaatatctacaaaaataaaactctcttgactcatttatagattaattccagaagcagggattaatacaaaactggcagtgaataatttctgttttgcagttagtttctgcatttaagaaattgctttagggttcagtaacttgccctggacttcaggtatgctgccaccagatggcagcagggtgccaggcataaggcttgtaagcaaagaatttgtgtgctttctgaggctcaaggtaatagctctttccttaagttcaaaaagattttcagaccactgatttccaatttagcataatacatttctttacaaaaataggtaaactaaaactctaagccaccctaagacatctttagaacagatataaatcccaagctataaaatcacctaactcattattacttctcttctctagcatctaattatttctgtaatggcttatacaccatgatggcttatacgaatcttatacacctacctcagtgatagtgttaaccattataatttactttgaatctttatgatcaatctctgccatggcaccgtgtatgttagttttcaaaattctcaatagtttttctccaggtaaaaaaaatctatctggctttcctttcatctgtcttaagagagcagaggtttatcttttcagtattatctgagatcttctcttaagaccaaaagtatttctccactacagtggcatgaacagtgtttatttgcatttcgtgtatgtatttgtgaatatggagtacttttgcttttgtattttctatactatataataatctactagaatatttcccctctcaaagctcttggaagcacagaggcagtttaccatactttaacagaaatatagctggattaaaattttttttttttagcaacaggctctgccctaaatatctcaagaaaatactttaaagaacaaaaatcttcatgccaaattagcaagatacaggaaaaaaggtaagtgggcaaaatacagggaaaaaaagctaattcaccctgacagttgttacacaaagctgagagagtctttccctctcacatttacaaagtccaggagcggaaagactttcagcaggagtaagccatgagggtttggacaaggctggtaggggaaaatgttatctcctgggcatactgggaagctgagagtccagggcaggtgaatggggttggagatgggaatgagggaggacagcatctgagcagtaaatcctggaactagagttagcatatcaagcagggctatctatgcacccaaggtaagttctggctgggagaagcagatggcaactaagctgtgaaaataggctccaagggaccagctcccagcgtaactctgggggagggatctggggaagtacaaaaaacatagagaggcaaaagacaaataaaataggaggagaagagaaagggatggatcatagaaagctcttatttgattttgagtctcacaggaaacccatgaagccagcagggcaggtattttttatcctctatttacaaatgagaaactgagtcccagagggggtaagtgactttttttaaggtcaacataccgaggggcggatataagattcaaagtcaagtgacctgattccaagctaaagatgaaagaagagagggcacatttgaaaccctgacacacacactgtatgtcctactctttgctttataaacagtaagtaaaattttcaaataatggaagcttagtcttttaagggtcaaacggaagcagctttagccactgttgaaaagcatttctgaaatgtattatatttgcccttgcctcctttgaaaactgactgtaatctactctcttcttgatacatgggttataattacaaaaatttactatatttatgaacttctaattcagtagataccctcaggttctatggaggcacatgtgttttttaaaaaattaattttttttgctgccccacctaatacattcatggctagaaatagctgtgtagcagaactggctgagtcagctccttcttccctcacagccagctcttccttcttaagtgtgtctgctgctggtccctatctactgcttctgatcaggtcattccgcttattaaaatcctttagtgactccctctaaccactggttgcagtagtttgcaaaacaggctgcacatgaaaatcacttgaggagcttttaagacctcctgatacccaggtgccaacacgaaagatttcaattcaattgttttagatatggggccctcacctacagggattaacataagtagcatgaactcttgcttctggccaagatggaataacgggggctagatttatctttccaatggacacaactaaaagtccagatgaatatattaaacaatggttttcaaggcaacgggcatgaggcattgaaggacagtgatccctgagagatggaaaacaaacaaaatgagttgcatttgcctgcaattgcccctgagagaatttctaggccatgcagcagaaaggaagaattcagaaggagtctgcaagactccttaaatagaaaagatgaagcagagaatccaggtagactagcgtggctagagtttgccaggcagagtattagagagcagggagttctgatcagtacatgcatgtgaggaaatggtataaaatcaaatgaaaaaccagctgaaaagatgagtaggaatagtctttaaagttcaaactggactggtaaaactgagatttgaaaactattcaaattgggaagccctgaaattcaaagagcattggtcaagtactcagaagggtattgccctcgtggtggggaagtattgtcaatagactaaacaatactctgccttgcctaaccttaaaagcaagacctgaaagatcaaagactattcaaagaattttcctgtatcccagagcaatacccaaaaatatctgtaggaataaaaaaaaaatccagcatccaacaaggtaaaattcataatgtctggcgtgtaataaaaattaccagacatgcaaaaaaacagcaaggagaaaaatcaataaaacccaaacctaaactgacacaggtgttacaattagaagacaaagatattaaaccagtaactgtaactgtattccatatgttccacaagttggaggaaacagcatgtttaatagagacagaaaatataagaaagacccaagtctggccgggtgcggtggctcatgcctgtaatcccagcactttgggaggccgaggcaggcggatcacaaggtcaggagatggagaccatcctggctaacacgctgaaaccccgtctctactaaaaatacaaaaaattagctgagtaaggtggtgggcacctgtagtcccagctacttggaaggctgaggcagaagaatggtgtgaacccaggaggtggagcttgcagtgagcagagattgcagagattgtgccactgcactccagcctgggcaacagagcgagactctgtcttaaaaaaaaagaaaaaaaaaagaaaaagaaagacccaagtctaacttgtgaagatgaaaactataatgtccgagataaaaaatacactgcatagtaacagtgacagattagctattctaagaagaaaagatgagtgaacttaaagacatagcaatagaaacaatccaaatgtgtcacagagagaaaaaagactgaaaaaaaatgaataggacattggtgaactgtagtacaactttaaatgacctaatactgatgtatttggggtttccaaatgagaggagaaataaggtgagtaatagaaaatattctgaggccagatatggtggcttacaactgtaatcccagcactttgggaggccaaggcaggtggatcacttgaggtcaggagttcaagaccagcctggccaacatggtgaaaccctatctccactaaaaatacaaaaattagccagatgtggtgtcgcatgcctgcagtcccagctacttgagaggctgaggcaggagaatcgcttgaacctgggaggcggaggttgcagtgagctgagattgtgccactgcactccagcctggatgagagaataagactctgtctcagaaaaacaaaaaaatttaagagataatgactaaaaaatttccaaagttgatgacaatgataagtctcatatttaagaagctcaaaaaacttcgcacatagaaaacatgcaaaaaatgataccaatgtgtgtaataatcaaattgctgtaaaccagtgaaaaagacaacaccttcagtgcagccagggggaaaaaaactgacccattatgtatagaggaacaacaaaatggcggcaggtttcttgttagaaataaagcagaagagaggctggtggagcaatatctttaaagtactgttcgttagaattctatacccagcaaaactatgtttcatgaatgaaggcaaaatgaagtatttttcagacatacaaaagctgtgaaaatttatcactagcagcctcacactatagaataatgtcaaagacagtccttcaggtagaaggaaaatgacaccagatggaactaagggtctacataaaggaatgaagagcttggttggcttcaagggtgtgtgacctgtatggttacacaaggtcctgcagatagaagggccttgtgctagctttaatgttttgatgttactggctaaaaatttttaataatttttgaacaaggggccctatattttcattttgcactggtagctggtcctgatgaagaatacttagtagtccatagaggtggaggcagaggctggaatgccgagcttggctctgaagatccaggccatatgttcaggcatggaatagggaagagatggaggtggcttcttcagaggaaatttggaatgttttaattttaatcacgagaagggtgaatgaacagatgtccactaaaataaaaattttaaggtagcaatttctgggtaattagaacacaattttcctttctgcacagagatagatcataaatggctataattagagagtttcagttttttctgaagttcatttgttgcggagtgttcaaaactgtctcttcaggccaaaatgccttgtttattgtgtgtgtgttttactatttctgatatcaatgctttaataatgcctgttctgtaatattggcccagaggtactgcaagagtgtaaattcactttacatgaaaaagaaaagctatattacttccaatgacattttagtgattaaatgcattttatttgtagtataattctatcccagtttaggtcaaagctccgaagttgagagtagtataataagtgtggacatgcaaaagatgctgaaaggtagtagaaataataatgtcagatctagcccatcaccaccctccagaacatatatgaaaggattagaaatcaatgttaagtgtgtatttatttgggagactgtccatcctaaatgaggacaaatgtcagggtgcttttcccaaaacttgggctggctgagggaagcttcaagagaatccctggaacagcttgaaatctggatgcagggggtggagttggtagagtccagaagctttacctgatatatgcctggaaaagtctaaagctcagaggtggtatctagctgtcctgaaggcttgtggggagccagctgtactgtatataggtataaatgcaatgcttaaatccacagataatttataaagttcactctacacttgaatactcacatccagtcatttagttgaagccttcggctttgattaaagttgttaatatttgaagtgctgactgatgtaacctccctggtatggaaatatgaatatttctcatttattatgtcccgtggtgaaagcataaccttttacttaaaataattggtttgaaaatggaattagaatattcatcctccccattcctcccctgcaatttgtgaatttagtaattattcttcttggttatgagcataagttaccatttacctttattcaatatgtacacacgcacacacacacacacacccacacactctcacagaatgcaaaaaaaaaattaggaaataaagttatcgcaactttagcaatgagagcggggtagacagaagtgtgagtttataatgctgatcatgaaataaaaacttcaaagcaagcctaaatctgatactcataggatgatagctctactgcatttaaagcaaataaagttacatttctcaagaattaatgcaaaattagaaagtttcctttgaaaatctcttagcacatctccaagtggttagctttcctgggaaagctggaaattaaatcaacaacattgaaagaaaaaaaacctcacagtcctaaattaaacagtcatgtaaatatagtttccaaagctattaggcaagaagcaaatgattttctaatcaatttactgttgcaaaaataatgccagattattttcatggggcatgtgaaataatttacatgggacacacgtggatattgctaccttagcaatcttatctagttctacccaaaggtatttaaaaaacaaccactgacgctgaagttatttgtaatcatatcagcagcctatctcctcatcctccattctcttcccctccaccagctgacttttgtatcaaaggcaggctacccttgcacttctcttttcacttaacatagaacaacagttactggagcaatctggttcccttaaaactagcgactcattacaatggttcaggatgtgaacttccctaaaaggctttgctctaaatcaaggtgactgtacattcccttttaggctagaaaacaacaaactatgcattcttagtataggattattcagcccatatattatatgagactacctcatatttgggtacctctctcattagttgggataaacaagtcttgaatttgagataattcaaaatctttgtaagccaaaggcatgcacacattttgcctttttctcattttaaaacccagtaacccaaaaccatcacatgaactacccaattctattgggcatacaaattttgttttctgatttccaagtctgaaggttcaggtcaatatttgtccgtaattaacatggacataattaatctgctgagttaaatgacatacaaatcctcaccaccaagagtgtgaacttgcccataaagttgtcacacagaaaattgaattcaatcagcttactttaaggaaaatatactgagttagtggtagacacagatggcatgcttcagaggattttggccttaaggtctaagagacagtgactatgttttcaaattttgacacaatgcttgtgacaggcacttctccctgtattgaagccagaaaactgttaagagccaacatgggtggaaaagaccagttttctttttttctttttctttttttttttttttttttgagacagagtcttgctcagtcacccaggctggagtgcagtggcgcgatctctgctcactgcaagctctgcctcctgggttcatgccattctcctgcctcagcctcccgagtagctgggactacaggtgcccgccaccacgcccggctaatttttttttttttgtatttttcatagaggcagggtttcaccatgttagccaggatggtctgatctcctgatgttgtgatccgcccgcctcgacctcccaaagtgctgggattaccggcgtgaaccaccacgcctgactagaaaagactaattttctgtctcaagtcaaggctgattggcctcatgggtggtggtggatcagtccctaagccccggcagtaaagccaggggccgtgatccccatagtcactgcagctgtctacaaggtctggctgcagtcactaaacaaggatctctaggccacaggtacccccggcactggggaaagtgagtgcccaagcttacatcttaaacactagttcaggcctttggattttgagagacatagagcctcacattgtaagtgatccttacttcagtgaaaacatataatagagtcctattgaaatccattctttacaatgggagattactgctaatgctagctaggtgagtgattcatgtgctacctattgtaagtattaattcttcattaggtagcagtgtgattcagaaaatgttacatagggatatttttcaagctattccattaactaattaactgggatgcaacttaagttggaagattgtttggttgatgtatggaaggtacccctttaaaaaatatctatgagtagccatgtgatgagtgtcaagttcttgacagagaattgaaatcttagcctgctgcgaccaaaaagcaatactgtttcagttagttccgttgccacacagactgaatgaaattaaccaaaggctttatgttagacaatgagtctcttctgaaataatgatagcttttgtgagggcataagaagcagaaagttaagaaagagttacttatggccatacaatcacattaatttgtctatttaatgtgacttttagattcaagaacaatttctatacgatgttctagaaaagacattattttttcagaaagacttttaaaagcaaggaattaattagttactaataataaccatcatttaaaataagcaatggcatgtaatgtgtagaaccgggacttttggcgagaaagtgacataaagagtagaacagagcacttttgaaccagcagaaacttatttgctttatctcttagttcataaatgccattttcctcaatcatttactataaaactaaaactattctttaaaaacctaagtgatttctcattgttactgttaaaaagaaatgtgtgctatgccaaatacaattcaaatgaatgaccattttatgttacattttcatcttattccttcatttatgctagaaaataacaaaagtaaaaatgcaatgagaaaagtatcaaagtcatgtatgcagattcagttgatctctttgggcttgactatttggcaacatatgttggccagtttttataggaaatctatgctaagtgtatgaataaaacagagacaacgtaagattagacactagcttcagaaaataaaattttgataatacagcagcctatttagtaagaataaaagcagtctcttggagtgtgggatttgtatatgtgattaagaaatagagacaaggggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaagaaatagagacaaggaaacatgatagagatagaaaactaaaaaaatgataatttaaatctttaacagtgaatatgagcaaagatcagaataggaacctatttattatcatatctatatcctataactgaaaaaatttcctaaaaaggagaacacaaaaatgcttggaagattttcttggataatgcaaaataccctgggagttctctctttacctcttagttcccccacatttaaacttcaaaagacaatgactctggagcttgagagagatcgatatttaaaacagaaggcatatctataaatccccattggatgtccaaacacttataaaaaaagaaaattaaatttcatttatcaagggttgaatagttaaggtgtcactaagagaccaacttacattaataagttcaacctcccagatttttttcaacaggtccatcgaagtgtagccattaattagaaaggctttggtgtagtcgcccagttcaatggaatccagccactcagctacagaggtgggatggtagccatcatgcccaatgggtctcatctgtaataaagaaaattacattaggattaaactgtatactttgtgtcccaacaacagaatgcagatttccccttgaaaatttatttgacatgaagaacagatctttctggagacggaaacaaggaaaaagaaaacactttctgatgtgttttcacaattctaaaacattaataattttcacgctgaataggttttcaaaatatacacagaaatttccaatttagctgctagattaactctatatttggaagagctaaacatgtcaaacttctgtcatagacattattggcattctggtgggtggaattaaaaatgatgtcagttgaatggcattaaattcgatgcgaaagtcaccaggaagtgcactttcaacatgtagatgataattctcatatgcacagcaccaaagcatgtgaaaatactgcatgacttaagcattcaaagggaatttgtgcttatgcaagacatgtattggaggtagtgcaaacacgctggagaaacatactgctgcggtgaaccagtaaaggagaggcctttgggtattttaagaccatgtgttctgcatcgactctacagtatgttagacatgaatagagaacttgctggcagacaggcatctattttttgtcagctatatacagatttttaaaaaataggagaacaaagaaatgtgacagcaacataatgtttctgagtttaaattggagtgtgaaagtaatttaagcaagaggaacttctgggtttaaaattttgtatggattattctggtcctttagcttttatttgaaattgtagctgaatctgtggttcttggttttcgaagtgactcacttctaaaacttgggctgctttgcatgccacgccgtatatctaatacttcagtttttcaggagagctggcacctcatcaacctgatgggggccttcggtaaaattcacgatggaaacagcaaggctgggcaaaacacaacatagattttcctctttctttgattcaaagagataaatattaatggaaatttatatgattctgatttgcgagcagagaaaagattagtctgggaatcagggattcagattttaatcttaaacatggtaagctttctatcactatgcatggttctcatttttgagattctccctactccttcattttaaagttactttttctcttttccagttgttccgctccccattctagtttccatttcaaagtttaaatgttctctgttttattttattttttttgaaatggagtcttgctctattgcccaggctggagtgcagtggtgtgatctcagctcactgcaacctccacctcctgggttcaagcaattctcattcctcagcctcccgagtagctggaactacaggtgagtgtcaccaagcctggctaatttttgtatgtgtctctactaagagacagagtttcaccatgttggccaggctggtctcaaactcctgacctcaagtgattcacctgccttggcttcctcccaaagtgctgggattacaggcatgagccactgctcctggcctaaatgttctctattttaaagttagagtacaatttattatttacattagagtctgaacttggtcagacttttgtacttcacttttacattgactgacccattttagctactcattaaatatttgttcatgtaacacttaactctgtgtttattatgtggtagctacaaatgtaaatgacaactcagcatttgcagaatgaaagtcagtggcattcacaaatccctggatgttatgtatgtataagatcagaggctaggacccaaaagggaggctcatagatattcggtagcttcatattctatagagaattacaaaaatattggggctgggtacattctccaggcctcgttaaaaggtggttgaactaactctgttaacctaaataatcactctggccccaggaatcttcctgactgccccagtgacatgaaataagaaagaaagggaagaaagtgagaaacactaaggttgaagttaactgcttagtagggaggtcttgccgttggcccatccataaagctgaccactccagcagcagatactcgggaaaagcttagggagtcttgatgactggatttgggtcaaagtcagttgtctcataccagtgaactgtgcaatggggttaccacaggttacccccaagcacttacacaacactcttttgaggaagcaattagtggccatctgacacacagagggtgttgatggtcggtggtggccaaagaatcagggaacccatgacaggactgcaaagaaaatctaggtaagtacaaagatgtttgcttgtccctccaatccccctttcttgtcccaatgccagaaaatttagaatcagaagagagaagtgccagtcccttaggggaagtctaaacttgggggggggggaggtggtgaggaaaataaaactggaggtttcaaataaattggaactgagccttcaacattttacatggttggaaagttattggaaatgtctgagatgatatttataaatagtaaagggagggtcagttgagcttggttgaatgattggaaaataaaaaaataaaataaaacagcaaccatcatatcaggattgcacggaatgcaggctgttcagtggtctgattactcctgtaaggcaagttctcctagaccaatcttaaagaggtgagagggagggaaatatttggtgggaggatgaaagacaagggcagggtagagagcacaactgaagagaccttggaaatgggtatgctgaggtgtacagggcagtatcatccgcccactcattcaataaatatttaatcaatgcctattctgatgaatgttgtggaaatggtagagaacaaaacagtcatagtctctccctcatggagattataactcttaattaaaatatgcaaacagatgaccaataaattatgaaggttctgcatacctgaagagaggaaaccattagagccaaatgcagttacaaaattaacttgacacatatttaatgatatgcagaatagttactgtgctgcacaataatttcttccaaagcaatgatcccatctgttcctttatttctgtccctactgccattaccctgtttaggttcttgttagtgcttacaaaaactaacacaatagccttctacatggtctcccacctttgatccagcttgtatcttgctactacattagtcttcctaaaagtcagacccttaagtgtacctttgtataaaagcctgtagtggctccttctcgaaaaaagtccaaatgtcctattccagcattcaaggccgattgagattagcctaatctcccactcctctgctattgtgtacccaataaatgtaactagacacgtgtatgtctaaacagtacattaaatcgctaggcattccctgaaaatgacctgtatatgacacagtcaatatctttgctaatataacttcccatgcttggaatgcttttgcccctgcttctggagtgatttcttcaggactggcttctcttcttgagctctgagatgcaaatttctaaccatttgtaggacatctcacataaatgtcctataggtgtcaccaacataagtcaaaaacaaatttaactcctttagttcaaaaacaggctctcttcctctttttttccatttcagttaagggcaactattactccactgcccaagcagaagcttgggagttatcttactttcctctttctgtttactatcatatctaattaggccaacatggtctatcaatttgatttctaagatgactctcaattcatttctcttcttccaaaatggactttggaatatgacattcccagcagtgctacgtatttgttgggtgatctttggcaagttactctttcagcctgtttcctcttttttagaataagcataataatacctattccaagtgttgttgtaaagattatatgaaatagggaataaaaattgcctagcacagtgatttgaatataatagctattcaattataactcttagttctcttttctccccattgccctaaattagacccatgcttattttgaaattgcataatattctgccattggctgctagtcttttcagcttccaatcaaagctctcctctctcatcccttcctatttcctctatttccttccttctttatcttgttttagaaatggtttgcatctgctaacatctttacccctctccccttcagccgacagttattttttagaaacatatctaacgaggtcactcaagtcgattgaactgtttattccaattcttcgttctcttactgtattagaattatgcccctgtgccctttgccaagggatcaacattatgtctcagtgtggctggagttacttcccagtctcatcaatgctggccaatagaatgcgtgaagtgtcagtgtggtggttagagacgaggtctctgtgctcctgtgttctactaatctttcagtgttcatatgctctctcataagaatagcaagtgctgagaagttgcataactcctggttctaggagaaagatgaagactcgtggagcaaacctaaatttaacccaaagcttggaatctaccctagctcgatggggctcaggaaagtccagatgaagttagctgaagcacagcagacccgtgagtaagaaaaaaatattttttgttgttgttgctgtgaactactgaaattttgattacagggaaaaactgaatagtcactccttgtttaaaaacccttggtgtttatccattatgcctgtggaatataaatcagaccttttagtttatgaatctattggcaaatgcatcttcatgagactgagaaagattagggatgctgaataagcaaacatcagtatccttcccaagctacctcactgtcatgcagaaactctgcatgccacatcttttttttttttttttttttttaagacagagtctcactctgtcacccgggcacccaggctggaatgcagtggtgcaatcttggctcactgcagcctccgcctcctaggttcaagcaatcctcccacctcggcttccctagtagctgggaccacaggtgtgcaccactacacccggctaattttcttttgtatttttagttgagaccagggtttcaccgtgttgcccaggctggtctcaaactcctgagctcaagcgatctgcctgcctcaacctcccaaagtgttgggattacaggcacaagccactgcccctgccctatatgctgcctctttattaaccctaaactaagtaattctttattgtatgagtttgatttttggggcataatccactgtacatgtaatatacctccacatcttcgctcatgccattccctctgctaggaatacagtttctactttttctcctaatgaaattctatctatccttttttttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaattctatctatccttaaaaggtcctgtttaaacgttacctcctgtgtgaatctttctctaatgttaccattattccaccgaaaaatcatatcttctgctatatttctgtagtattttccatagagttctattatagtattattaaagtctgctttcaataatagagaagtgagtatctgtcttcttcattggactgcctaccccttggtgaagaaatgaggtgttaatcatttttgaagtccctaaatcgtccagcagagcatctcacatatggcaagcatatgctaaatgtttgttaaattaagtgacttaatgaatacatgaagacaaaatgacaaattcatttcagtggcttggtatccatttgtgggagagatttgtattttgtactccatgttatgaaaactaaggttatctttttctgcctaacaataacattcataactatttaaaacctccatatatcaagaaccagttccagataggatattgtgttacagaatgcaatggactttgtttccatagcacagaagacttgattctattagccatgtagccatgggcaagtcacttcatctctctaagcttcagtggtgtcagctataaaatgaaggtattggaccaaggatctcaaagctgctttgtaattcctaaattttgcaattccatgactcgtaaattaattttaaattagtaacctatttgtttacccaggaaagaaaaaataagcccaaagacaaaactaaaattcatatatatatatatatatgataggacgtgtagactaaaggtcagatggcattcacatttctttcatgtatcttcagcagtacccacagggagcactgtgactgcattctcaaattagcaatgatgaaactttttttccagcgggaacatctggcaagacagggctaggaagtgacagctccatcggcctgccaggccagcagtgctgctaagcatgaacggaagtcaggctcactctataatctgagaggcagagtggtgagcaggcagcaggcattcattacagaggctcgcaacaaggcaatttgattcaattagttgaattccaaagtctggaaaaacctaagctgagacagaaattcgagatagcagtgaagctttagtcttgggaaaattgagatatattaacatattttttttttgccaaatgccttccttgttcttgttccacccaaatgactttcctccaggagttttttagagcatacttggcctcagagagagtatgctgttaacatcacaggtggtacagcaggcagagaaaccacaggacagtactctgtggagttctgggtttgagggggtcagctacggggcagctgaacaacccatgctctgagactgcttgatcgacttcaaccagagtaactcttattttatgcgttttatacaagtaagaggaagaaaggttttctcggctttaaaaagaaatgtttgaaaaccacgaatctagaagacttttgtaagattacatgaccactatgattttattttctcttaactttttagctttatttgaaatattatggatctgttatatatatgtggttatatatatatatacacacatatacatatatacacatcacacacacacacacacacacacacacacacacacacacacacacacatatatatagagagagagagcctgtcattccatcattctttctctttgcctgaagccagcattttctgtgcagataaggataatatcttatgagatgacggagccacaggatggaaggtatagcaggaggaaggcaataaaaacaggtaaaaaaaataaaaagagagagaaaggtgatatacattataatagctttgggattaaatgagaaaagtagttcttgatgggacaacttattaacctagaattatgatattggcatggtatttagaacaagaggataaggaaccctgaaaagccaataatggattagacaggcatttttatgtccaaaagtgttagaaaattgagaaaaagactacttgttgttcccttaaacttgtcctctcttcttccacataatggggttaaattgggttcatgcctgccggactagagacaagatacatcagctttttttctggttgctgctgtgaaaatatggttgagcctgtggaatgctaatgaaagtgttgcatgtaactttcaggtcacctctagctaaaagaagttcctcgacctagaattcctcttttttcttcatcttcctataagctggaacatcagtgactgcagttcagctttgactacacaggcaaaacaataccctggagtctgggaaatgcttctcagacctcaacgtgcttaggaatcatgcagagaatcttattagcagacgattctaattccgttatttggagggaggattggagattctgcatttctaaccagcttcctggtgatgctaatgctgtcagcccatgaaccacactttgagtagtagtgctttggaggatgacagaacaacaaatagaaggtcctcggtccttccacaattgcatagagcaaagccaccttgtaaacctgcactgctcatttcaagactattatatgagagaaattaatattcgattctttaaaccactatattatgaatgtctctatttcagtatcatagcctttccttgaatacaaacataactaaaaataaggcagtttcatgtagaacatttaaatgaagcctgtacttccatttgacattacattgtattatctcttgttttgtggggccgtaagttttcacatctgttatcgttaaagaagcttcatttcctttaactgtgtttgttggcatttctctgtcaatcacagcatcatccctttgtaacaactatgcaagggataagaggagaaaaatgcagggaaaccccaagtttctagcttggatatctgggcaaatggtggtgttaccaggtaaaagagaaaagaaaatagactgggatgacatgaataattttgagacatgagaaatttaagatgctatgctgtggaatggcactttaaatttggagaagtctggggagacacgcggccttgggcatcatcaaagtacaggtaagagtgttggcaactccacttattagctatctgacctcgagcaaatcactcatacttcctaagcatccattttctgattagtaatgtgaaagattaaaagaatatctatcgctgagcgttgccatatgtattcaatgaaactacacaaggagaatttagcacaatacttggcacacagaagcactcaataaatctttgttattttttttctgacagctgaaatcatgcacaggtaggactgcagaggtgactttgtagtgtgagaagagaagtggcctgagaatgaaccaacactttcaatgcataaggaacagataaaaataatactcaggagaccaaagaaggaatggtcaggacaagaaaagaaatgggggaaataagagtgtcaaggagagtgtggtcagcagtgaggggatgctgcagagacgtctaataaaatgatgaaggagaagggtttgtgggatcacaaataggtcatcggaaataggtcaccagacaccttattgagaagagcacagaagctgagctgccctaggttggggagtttgtatgggaagaaaagggggagatgagattttagaaagcacagaggaaaacacatggaaaggggtaaagaaatgaggactcagggttgagaagggtcagagtcataaaacagttaagttccagggtgcagtggagattgcaggggagggcttgccttttgctttgacactttgccctcctttcttgaaattacggatctgacaaggatggttggagctaacttcagggtgaatactctgtgttaaaacagtgcgagtgtttggaagctacatggtttagacttggtgagagctggatgcttgtacgtgaagtacctgtgaccttctggtgaaggtcctcacgtgggcaagagctgtcgcctgtgttgtcttcactcctcagatacaaacacagcaacctatcatttacatagacccaccagtgccgatatccctgatgtgccaggctcagctacttaaacttgcctaggaagctgccgtggaccgtggcttctcttttcccacctggatgtactttgtacactcagatttcctgcctgatatggcttttgtaatacagatagctgatatcgtcaggtacttccctctattctggctccttgttctagactcttctgctctgtcctgctgctacccaagtcttggactaacagcagtcctgaaaataaacgaggacaagcagtgctagcagacagtgtgctgccaagtccaaatgcaggtctatcaagtagtgtgaggatcaaatctacaggctgtgagacctgggcttagacatcactgtgctgtttcatcagtggctcttaaaaggctgattgaacataaaagagaaaggctgatcttctgaccacgaggccccagaaaaaagtctacctatcaccatctgagtgctatctacggcagtgcaactttgctgggagggacgtctccaaaatgctgagcactgttaatgataagaacatcacttaacaatgatgtgggactttaaagagcctcaagtgatttcacgcatgtcacctcagttgtaaagtgttttaggtgatctttaggaagacaccctttaaggagtctgagagcctgagtatcccatataattatattccttctgtgggaatggaaaggattaatatactgtgactgttgttggaaagcaaggagtgataaactctctgtgttgtgcatctgtagcaagggaggtatacatgtacaaatacgtctgctacttgcagctcctttgtttacaattagactctgttatggatacaatttctataaaagaataaagagaaacataaaccctcagaagtaagaaaactgtgtctgatgtcactacgaactcacagctacagaaagtggtaacccctctattatttttcccaccactgactgagccttactgatttggggttccttgagtgttcagatattgaagactcccagctgtaggcataaggcagaagcagtgaagaagtagtatctggatattacttgatactacatttttgggaaataaagggaaaggaaagtgctttggactagacactgtctctcaatgttctaggttttctatttcgtgaaaaagagaaatgaattaaggtctattccagagagggcctgaggtatccctaattttgaaaagtcttagatcatggagtaaaatagaagtgaagcaatggacagcaatgaaggactagatttaaaaatgttttcaagacacataggggatcagcttccaacagcacagaatagcctagaagcactagactggccctgtctctagtcatcagggataggggcacgccctctggacaaaggcactgggaagactacaagttaaaggagttaagttgccaatgcagccaagttctataaagcatccttgggaaaaaaggtcaaccgctacagcaacaactacaaaacaatctgtcttatttcaagccgtgtgtgagagctactagtcaggcactgctctttttagcttcatctgtgcccagggagattaactctatctgtagcagcacttgagaaatgctatctgccatgtaggatctgtgtgggatgcagatgaaaagaccagtagagccctaacacagtagacatataacatggtccttggggttgaattattttattgaatggttttgttgtacctctccctgaagctttgcgtaaaagaggtgtttttaaaaatttaataagaggaaatgtttttaccatcttttcatttctaaaattcttgttgaggtaatgttgaccctagagccttttgttaaacatcgttatttgttttgatatgtttccttgttgcaaagctttttttatgaagcaagagttcagattaaagatgaacagaggatttactgcaactagaataaggcgctgaacaatgttcactagcattcacatttccaagctctactagtgatgtgaactatatttagaaaaaagacacggggtctctttttttctctgacagtacatgttttctgtcattcatgcagctatttggtggttatatagtacactgctttgctcttcaaacagaaactttaaatgctactattaatcaggaatatcatttgcatacttttagtctcaactaaaataatttccccaaacttgagtcttcagaagataatgaatgccctgaatgtcaattctatttatttgatatttaaaaaccatgtcctttctcagagcctccaggcacatgcataataacataatccacagaagtacttcaagcagataaatgtaccacacaaccagaattagcagtacacaaatgaatgacttatgttctacctgggtagagcagtacaaaatatgtcattcacatggtggtcaaacaggagtatactcacgttcacttagggagttacaaaaatgaggacctaccatccattccattcatccatccatccatccatccatccatccatccatccatccatccatcccatccatccatccatccatccatccatccatccatccatccatccaaccatccatccgtccacccacttatttactcaacaaatactaacagtatgtttgctatattctaagcactgttctggatgtgtcagtgaacaaaacatatgaaggtgccagtccttgtggggtttaccttctaagtggggaagacagataataattaataagcataataaataaagtatatagtctgttagaaggtgataagtgctgtgaaaaaagagaaagtgcagtggggggatcggaagtactggagtgtgtgtatggtgtggcaggtgcagtattaaatagcgtggttaggggaagtttcattcagaggagaagatttggacaaagatttaaagacagtggattggctgggcacagtgactcatgtctgtaatcccagaactttgggaggccgaggagggcagattgcctgagctcaggagttcgagactagcctgaacaacatggtgaaactctatcgctactaaaatacaaaaacccagccaggcatggtggtatgtgcctgtaatcccagctactcaggaggttaggttgaggcgcgagaattgcttgaacccaggaggcagaggatgcagtgtgttgagattgtgccactgcactccagcctgggtgacaaagcaaaactctgtctcaaaaaataaaaaagtaaaaaataaagacggtggattggctgtgttgagggtgaagatttcaagtagagagaacaactagagcaaaggccctcaggaaggagggtccagcatatgttcaagaaataacaaggagaccaatggggttggagcagtgtgtgtgcacagagaagagagggaaccaggggccagataagtgagggcttataagacctggcaaggattgcctttcaatctgagggaaatggggagtcagggtatgcatttgagcagagttgtgacatgatctggcttacatttcagcagaatcactttgactgctgtgttgagtaaagctaataggtcttttcagaggctgtggaagtaattcagaaggaaggggctagtggcttggataaggtactaaagtaaaggcagcaagaagtagttagattctgggtatcttgacggtagaccagcataatttcctgaaacacaaaataaaatcatccttgttctctaacatggatcaggaatctgtcagtttggtggttgcagctgtgtgtcatgggtctcagcttgaagaggactgtattcgttcatcgtgtgtgggaacatatgggtgactggcagggacaggcttgcagcagtctgtgctcagtgaggattccaggggcctggaaagactctgctcagagattcaaggaataatagatgagtatcagagagaatgggtgattctgaatgattttaaaatctggcactctgactgtgccctggccagtctcccatggaccatcccttaagatgaagaggtttcaattaaatagctgtatcatgaaacatttttggacattgagaacaaaaggagtaggcagaattagcaccagcaactttgtcagcaagaagagatggtgccatattgcagatattggtgccctcaacattgggcaccagcagttggcaatgatggccactttggcaggcttcagtggcattggcagaacattcagttggcattggctaaggtgcccttgatgggaagacactgggtatcatagccagagacacagacatcagtacctttgacacattgggcacctgcagctctgaagcagcccttggcattcattagtggcagatttggcaccttcagtgagtatgaagaggactgagagcacttttggtaggtcctggtggcactgtctcaagctgtggtgacagaagacatcaccacaataggctagagcaagagaggcagaaaagggcagatgtctcatggtcagcggtagtctagttaacagtgcacatgtgacaggagacactttgaatgaatcattagaaggaatttcagtaaggcctagaatatgcagagaagtgttgctctatgattgttgctgttatcctattttgaagccctggttggagttcctgaaaaccccttttatatttatagttaagggataatctaagaactattccactaccattggagtgagaacagcagtcacaacaaaaaatagcttgatctttaggaaaatgtttccagcctcatagtctgttgtatgtgcgtgtgtgtgcatgtgtgtgtgtgtgtgtgtatgtgtgtgtatgtgtgtttgtcagtctagaatttctaattatctcagacaatggagtgactaagaatcttcagctctatttatgggaatccccagtagagtcactcttacaatagttttagtagttattatttatttaattcaataagaatttttaggcactatagtgcatcatatgtataacatcattctagatattgtatatctaggacaatatatatataacatcatcctagatattatataaatgcaaaagggaataaagttcctaccttccaggaatatgtaatttccttgggtatacatttgaaatacatgcaaataaagttctgtgtcacttaacaacagggatacatcagaatgtgtccttaggtgattttgtcattgtgcgaacatcagacagtgtacttacgcaaacctagatggtatcacctgctaaccatctaagctattgctcctagtctataaacttgtccagcatgttactgtactgaaaactgtaggcaacttaacataaattactaggtgatggaaatttttcagctctattataatcttatgggacctcttatatatgtggttcatcactgacccaaatgttgttatatggcacatgactgtatacaaagataagtgccagtttttataagttctagaaaaaaatgctagagtggattggaaacatttgggtgaatttcttttatagtttctcttggggttaatatatggtgaagtaagtgattgtatgtgtgcttgtgtgtacatgtttgtcagagagagggatgcaggtgggaggggtggggggcagagagagagagagagagagacagagagagagaaagggagggtgaatatggacatccatttctctttattgtccctagtcctagtcctagtcctagcaggcacaggcagcatcctctgtctgaagtgactccttcaatgtcctagttggctaaaaacacctgttcattctttgagattcagttcaagcaccatccacctgcccaaaaagctttccctgatccccatgcatttagctcttctctcctcttgtagcattttccacatagtattctagtttttgacatatctatctctgtctaaaatgcaggcagaactccttgaggcagggaccaagtcttctccatgtttccattcccatctctggacttagcatagagctgaaatgaatagacagtctgattgaatggatggacaatgagcaatttgctaatgaatgtctgtgcatggccgtgtgggtgtttgcagacgttatgcctctggagttgctctagcttcctttcatctacctctgagcctgctgggtctcgggacacaaggtaattgttactttatgtctacatcacgtggcactcagaaaagtgatctggctgaagtgcatgataatgtaattgagtcccagaggtgacaggcagggaaattgatctctctatatttactgaaataatctcttgtacatctgtggggaaaatttcacattcaaaactttcttatgatacatttacctcttagtatttagaaaattgtaaatacaatcctttgccaccaagcagtagcttccaagtaaagaaggggttgagggttaaaactaatataatgcattgaagaaaaagcttttaacctgtcaggactctgtgattcataaattataaccttagaaatcatttaaagtgtatccatttagcacttataccttcatgaattcatggaacaacaagtaaagctaaaatgtatttcctcttgaagacatgaaagaggaatcttgcagtttcttgggtactcgtttcctttgataagggcagtagttatctattaactgaatgtctatttactaaaatacaaagcaatagacttgtgtgaaatagtaaaaatggccagtcattttttccccaagatgagtaaattgatgggtgattccacagagtacagagacggggcactccagtaataggaagtagaggaaagcagttaagggcatagactctggagccagcctggccagtttcaatcctgactctgacacttactagtggtgtgacctcaggcaagttacttaacttctttgagctttaatttcttcacctgcaaaatagggatttaattttgagatttaaatgtgttaatttagagttaatctgaagtacttagaatagtgcctggcacgtaggcaattttctatttaagtgattgctattaacataggggtttggcccagaatgtctttctggcatgctgaggaacatcttggggaacgtgtattctttagatagagttcactatggatccacagaagaccaaccatcaggctagaacccaaagccaaaggataggtggaaggactactggtttgaagtagaaaatctcattgattaccgcccctcctcatcccccacaaaaataaccacaaagaaataccacgtaatgaaacagtgcttagcttagggaaggaagaatagtaactatgtcacttgtttagcctgcttcattaagctcactataggtatttgtttgggtttgaaatatttgactcattatagcttgaaggacaaagtgatgaatgaaatttatagctggattgatggcactagctgtatttcagctgtaataaccagaggatggttattacgaatgagaaaaaatagcatctctatctgcctgttagctaaacatatgctttggatcactttttgcttggagtgtcatgagttatcacaaacttccacaacaaagaagttttcttttttaactttgatctatgtattatttgtttttttagagacagggtctcattctgctgtccagactggagtgcagtggtgggatcatagctctctgctctctaactgctgagcttaagcaaagctcctgagtagctaggagtataggtgtgtaccaccatgcctggctaattttttaatttttttggagagacagggtctcactatgttgcccagccttgtcttgaagtccttccctcacgcgatcctcctgccttggcctcccaaagtgctaggattacaggcataagccaacacgcccagccacaacaggtaagttttaaaggtacataggaatggctttttgattcatctgtctccttctccaggaacctactcctgattccctgaacagaagagaccttcccttttacttaacgtacaaaacttgttatttttactcctattatagcttgtttcatgttctgacttgtactatattaagatcatttgcatattggtctgacttcctttgctagactaaaatcttcttgaaggcagatactgtgtaatttcatcttatttttctccttgcactgtgtcttgggacataagtaaatgctcaattcatttgcagacataacttgaacagaaatatctcacttgaatgccattgatggaaaataagaaatatagccaaattctattcaacaattaagttagcacttatttcaattgtatggtaaaggcaggtgacaatgccttattcaaaatggcgaatatgctgttttacagttttcgtgtaaatgcacacagttctgcttttctgtgaaatcacaatgcctttagcaactaaatggaactacactgtcaagatctgactgctcagcttctcagttcacttccattccattctatgctatgtatatttatattgagtccttgcttctaagagatgcagacaggaagatctctctgtattaggcttattcatttaatctctctcttttttttttttttgttttttgagatggagtctcactctgttgcccaggctggagtgcagtggcgggatcttggctcactgcaagctccacctcccgggttcaagtgattctcccgcctcaggcacccaagtagctgaaactaaggtgcgcgccaccatgccaggctacttttgctatttttagtagagacggggtttcaacatattggccagggtggtcttgaactcctgacctcgtgatctgcctgcctcggcctcccaaagtgctgggattacaggtatgagccaccgtgctctgcccatttaatctcttaaatagggaggcatgagttatgactttaaacaccttctcttctagcttctgatggactaaacaataatctttaaatacatttcaaaattatcagtttagtagatgacaatcaaattggaaagttttgccagtttcttatctagaaaatgaataactgcactgtgagaaacccactagctcagagtagaatgttcactatgcaatgcagtcatgggcatttttagtcacggactctcttaggtcagtaattgagttcttttctgttacttcttggctccaggcaaaagcaacatcaaaaatgtattgatttttgttaatttagggagaatttattgaacaaatgcaagtggtcataactaatattgagttcctctaaatgtcagaaacttcatatgcatttttgtatttatatctcacaatgacctaatgtgataagttccactattatctattgttttatagataaggacactgggattagagaatttaagtaacttggccaaggtgacacaagcagtaggtggctaaactgggattaaattagatttaactaaaagctcaagagagttattttttgagcccctgcaagattgcaagttccttaaagatgacttaagtggattatttagcttactcatctcattatccccttagtatccttagggtgctttgaagtacagcgtttagacaatacagtggggtggttaagaacctctgttaagccgcctcagtatgaattctagtttatccacctaaaacagcattcacagattcccatcattttctgtccatttcttgcttaatagttctccatagcatttatcattacctgaaattatatagttttacttctttttttctgggtccctcactagaatttaagctgcacgaggacagtgaccttgtaagtcttgcttcctaacaccaaattctcaatagctagtacagtgcctggcatgcagtaagtggtttaaaaatatctattgaatgaataaataaaaggagatacattttgcttaccgtttatgcctggagtcgtaattttcaatacaattaatgggccaaatgaaccctaccttttttcttggttcagcttcaaaccttctttttaaaagtgtatttaatagacactaatatagcacatatgctttggaaaactccattttatgtgctttacaaatattgacccatttaattctacagagaaggtgaaatcattacatccattctaaaggtgaggaaccaggcacagaaagatttagaaacttgcccatggtcagacaattaggcaaagaatggagccaagattcaaactcggatagtctgaccatgttcccaaccattccattatgctgcttcctagattaatcccataaaaatgtcatttccctggagtttaatgctctaaagatgtgtctttgctctcttagagaatgaccttccatcttgcctatttttccttcctctctacccagattaagaaggaaaataaattaagattattttacttattgaaacagcacagtatgctatcagtgaagcttctctcaggctaccttcaaggataaataagtgaatgaccccggtggctgctggacagctcacatggcctatatctgcttttcttctttttcatatttgtctttttcttgtatttctagagctcttggattcctgctgcaacccttccttctagccttgagaagggagttcagtggtccatggaggctgcaaaaactgccttttaagcctgaaatgtaaaaggaaggccgattttataaatgattcctgttcttgcttttagtcaattggttctttcatttcctgtcccttttcagtttctttcacaaacacacaagcaactcacagccttgggtctctgatatagcaccatattcactcaggaggcaattgtcatgagcacagatatctgggatttagttccagttcagttactaaggagcaatcttccttggggcaagtcatttaataggactgggacttagtttcctcacctgtgaaatgactccagtgagaggaagagctggagatttaaaggtcccttccagctctaaactgtgattattctttgacgaattatgtaaggaagggaaagtgctcagatatctaaagccctatttctctcactacagattgcaggataactccaagggagccactgttctttattaaatgggggtgaacttctcagaattgaaggatgacggctgctggggatagcaatagatcagaacctattttcctgcctaattccttccctatttctctgtaaatatcagaaggagattaggagtaaaagtgatatttcagctctgtggtctacataataaacgattccaagataaattcttaaaaaaaaaaaaaacactaaaaagttctgcctctttagcttgggaagaatgtagtagccatcttgctttgtgaaactgcacaaaaaacttggagcagagcatgggtaagtatgtttgaattgcgtgctctcacgcccagcagttgtttaaaaatctatccagcccatacagttattgcgattttgcattttgtacatatggggctttgtcatttcaaagggtgcaaagagcttcatgaacaatggccattccttctctcgatgtgaccccgtagaacagactagttattggtcatcacttgtaaacaggaagcatgaatctcaccctaggaaatgcaggccgccagtgctgtcatgcttacatgaaggacatgccttatccctttgtaaaacatttaaaaataaaggcactcagtttggaaatatctttgagcatcctaacctgacccattcagaactgacctctaatcagcatttttgtttggctcagtccagtctaataaatattaactgggcattactatgttcatgatctgtgtgctccatacctaggaaaggaagatgaacatggccaagatcctaatcttgagtaagagacaaattagtcaacaggtggtttttatgaggtgtaatgggaacacagaagggttaaatcatctatcccagagagaagatgttgtaaagatttctccaaggcttaagtattaaggaatgaataggagttacccatgggaagaaggatgagagttaaggtacagaaggagatgatgtttctggcacagaatgactagattctcaggaattctatcacatattcctaggaagagagataatacttcttggcctaatttgcagtttaatgagggctatgaacctgaatcctggtgaatcaaatgtgatttaaagtaagtgatgcatttcctgtcctggcaatagaacatcccaagtgatcttctatgttcctctctaccctgctgtcatggcagcccacaaagaactccaggatggaagggtccatgatggaagaagccagggtccctgaattactggttggaggagagctgcctgacccacactggacttagcatgtgtgagaaataaatttaacagtgttaaaccactgagaatttggagctgtttgttacagtggctaggttcattaccctgatcatactgtgtgccaggctaaggaataataaaagggatctgaatgacttgctgtcacttcaacatttatatagcccaaataacttaggtttttgaccttaacattgattactctttcttcctttctcatccaatggcaccaatgatttctttcttaaaaaggtgatcttttacagtctttcagcaagtcaactgctcctcctgagtatattatcagcatcttgtgtcttttaatgacatttgtctattgtatataattatataacattatatctattattatatctattattgtataacatatataatatacaacaaaaaatgtattatcgtatatataatatatgttttatattatatatactatacatttgtattataaaatatatatcatattgtatataataggttataataggaatataatatgttaatgttatacaatatagcatgtatatataatgaaatatcatttcaaaggtatctctatataaaaatcaatttttctcattagaatacacattttatgagggcaagggcttcatctatattactcattactgtaaccctagtgctaagggaaatgactagtatatagtaagcactcacagttattttcagaatgaatgaataaagataaatataatagaatagaggctgggttttttaaaagaaatggacttcagctgtgttcagatgtaggcgttctgaaggcagaaagagctccaaacccagacgagggttgacagttgctcatatgaaggtgatagcagaagctatgcaggcaaatgaaggcgcctcaggagggtaagggaaggaagaagatgagagaattaaggctgaattttagggaatatcaatgtataaaatagactaagtataagcagctaatgaaacaatattagaaaaagtaaggaaagtaaagagagtattgcggcacagaaacagaactctgtaagaatcacagttttggggtcagatctgtgagtacagcatattcaataaacacctgtctattgattgaaataagtgctgaacactgaatagcatatagtcccatgaagatggtcaaaggggctgactccttttctaaaagacatatagccaatgtcatccctgttaattatacacatttctctgggatgacatcaggaggcttgggttaccctggggcctttcactagtctgataaagtaggctatatttctgatctgagttcttccctgtttagaagattctcagaagtatggaaaagttcttaatctagctggatatttattgataagttacgggtcagtaaactatgcctacagtctaagcctggtctattgcctgtttttttaaataaagttatttggaacacagccacactcattcatttctgaatcatctatggctattttcactctgcaacagggttgagtaaccacaatataggacatatggccagcagagtataaaatatttatgatatggcttttcacagaaaaagtttgccaacccctgagcactgagcatatctgttttgcacccccggcaaaaaaacaaaaaacaaaaatacaaaaagcaaaacaaaaaaaaccccacaagacattttcagaactgagtggagcttgtaagaaccctgggaataccacagcctgtcttactaaggactggacctataggaaatagaatattctgtgccttcggtgagactgggtcccgtcatgtatttactttaggttaggacctccatgctaacagtgcacgtatgtgggtgtgagattctctttgaccgtgtatctttaactgatgtccactgggtggtaggccaacactgagtggcagtgagtttaagacatgcaataaaaagaataaaaagaaatgcaagtgaaaagaatgagggtagatggagagtgagtgatgggatgggagaatgaaaataagtcgccctgtcaaaaggtaccatgagagcatctatgcctgtgggctatattttgtcattgcccttctgaaaaataccagaagaaataagaacaagtttctatcatttttctaagtgacagggaaataagactgaaccttcctttctagacttttaaagaaataacattggttgtacacttttccgctaaagcgtacacacatctgcgtcaaccatcaagcctagaatcaataaacatctgaatgttaaggacttagagagcactagcgtctttaagagaatgactctgttctcttgaagatgctagttctttcaaggtccttaaaattatcttcatagaatgtctctgttctcttaaagactctagttctttcaaggtccttaaaattcagatgtaacttctttgaaagaatgtcacattcctaatactcctttcaaaggctgaaataacctgtgatctcatcatattaagacatttctagagtgattctcttcatctatgacataggggtagcagagtgacacctataaccaaatctggcccccaatgctttgttttgttaacaaagtgtttatgaaagaaacccacagtttttttggggggtgaggaggggcaggacttctgctctccagtgtgccacagtttccaccactccatattgtcttttctttaaaagtgtttgagttttcaatccctacaatctctgcccacaccattttgagggggccaactgttgctttgatctattttcttcgttcaggcctaaaattaaatgaccacttgtaactttctagctatgttagtttattagaacccgttttatttgctaacattcttcaagttttgtccaatagagtttagtagactcactgacctaatatatatggtaaaatactcttttcagtaatgaggcaacaatgaagaataaatacattttaagaaactgtgctgttttatgggattactgatttgtgtatatcacttagatcagtgatgttcaggttatgaagtgattatgtacaatttgcaaatatctagtgtccctaacttctgtattatcttatatcatgctacattatacctaactctacagaccagagacatgtgcctcttttttgagtggcagtagcaaaggtggctcttaaatcatctgactgtgaacaatacagtcccaggaagatggcccaaggaaataaagggtgtttttttccttgtagtttttgacggattattccattttaactacaaatgtggacaatggaaactaggctgtaaagtagatcattataaaatgtacctggccaacttctaagatgtaccccaccctgcccgccctaccccatggtccccaccgtctggtattcacgcccttgtgtaaacacctctattatgtatgaactgaatctggtgacttgattgtaatgaatagaaaatggcaaaaagatgggatgtcacttgtgtgattaggtagcaaaagactgtgacttccatcttgctagcactttcttgtcttctcacttgcttgttctgttgaagctagctgcatgttgtgagatgctctatgtggtgacaaggaactaagggaggcctcagccaacagtgtgtgaggcactgaggcctcagtccgaaaatccctaagagcctgaatcctgcctacaaccatgtgagtgagttaggaagtagatcctcttgacttgagtcttgagacagctgtagctgtctgaaagatccagagacagaggacccaatcaacattgtacctggattcctgacccacagaaattgggagataataaatgttgttatatgccactaaaatttggggtaatttgttctttaacaatacagaatataaatcatctattggaataacagcaaaaatttttttagccaaagcctcaaactgaggatagagaagggggtaatttaatccattcattcagaggttctcagtgccattcagtgaaaaaaataaatatatgtagctccaataaatattggttaaactgagcagaactcagaagtaaagggccactaaaattcaggtgttcattatgtagtaaagtaacagtagcaatgaacaaaagtgaataccagacgtcgcactaagatcaagagtcctgtgataacaatatttactagtcatcaaatatttttgggtttgagttttgaggaactccaggatttaaccgaggagaatgagtaggcagagagacaacagcagagatgcagagagtaactacgtattgtggaagccgaaagaagacaatgttaatagtgaaaatttgccccatggggttaacaagaatccttgagcttgccttgcaagaagacagacgaagaaacagcttgttataattctctctgcttgcaacaaaactggctgactggctgaaactggctggaaccaataaggctgactggagtcagaatggcacagaatagactcgctctcctggggggtgacgttttgatgtcacagcctgaatttccacgtcatgtttcagaccagttccccatgaatttgcacaggcaacccacggaaaagcacgaagggacaactgcgcatgctcaacggactttccaaacttcccattcctttctgccaatcactaaccaaccgggaagccccgcccccagaatctctcccttaaatataccgctttaaggctggtacagggcgacggatttgaactggattcctgcctccttgcttggccgccttgcaataaacctttctctctacaaaatccagcgcttcagtgtttggccgcaattgtgtgcaggcaaatgaacccagtttggttgataacaataattgtcaatagtatcagagtctgctgaagtcaaagtagggtggagataacaaagggcttatggaatttctgatcttctgcttactggtgaccttagcactggttgtaggaggtcgcagcagagaaacaactcaagcccttgagggattagtggagcaaaggaaatggggagacgttgagtatagacaactactaagtaattccaaaaggtattataaaactggaaagcattagaagaagaaatattgaaaaacagcgtgagcatacaatataaaagttgcttatgtgctgaaatatactgtcaactcaggttgagggatatgaagagagcagatgcgatatgagccttgacacaaagtcctgcaaacctttaaaatgaaaatcctttgaatgcctgaccttcaggtgttatattatcaaaggacagaagcgtttatgcccttttaaaaaggaaaatgtattagaggattatccaaagacttggccacatacaattcttttctggaaaaaactaagttttatgttgaaaataagtaatcaggtaatatccctgtgtccaaagagacagaaaaagcacaataaacttaacatttctaggacagtagaaaaaaagccattttcttgtggaactttgggtttgtttcctttcataaaaagggaaaaaggtgaaatttgatcttcaagaagtccaggaaagcttttagagctgagaaaagacagagttggggttggtgagggaagtagactctgggtgaaaacggataattaagctttacaaaaggtcaagcattgcaaaagacagcgagaaagatgcattctatgtgttgaatgtatcaaatgtagttgagaagatgtaaatcttcgcattggtgaatatttcagtattaaaaaagacatattaaagaatagctattcttacaaaaggaataaacttttttctttgaagcttgacacaacatatacaaataaaagcatgaaaaatatgctttgaagtgtgctaacacatcaagattgtactgagcaaagcaccttttctctgtttaggaacaatctcactaattccacaacacaatatgttaattaaaggatcccaggtagcaatcatggaatatttcttctcatgacagatgaagaatacaaatattctgaagactgaaattgtataaacaaaatgaagagacattttgtccgttttctggcagtgcaaagttaaagtgaatgcagatgaatgtgctggcaataaaatgacactattaaccatctgaagatcgggctcattacctaagaaggcaaagcatcaatttgtggcattacaacattctatttgtgctgctcaatgtgcgtctggatgtttttatatactctctactaatttgtgtgcagagtgagctcttctgcatcagcctctctatagaagcttaattttgtattgtttctcttatattattttctctaatgagaatgatattctgtattagaaataaacacttcatttattcttcaaataattctacgttcagtttctcttgttttgcattatcaagtggtgtgtacaggattacagatatatcttaaaattgaggtgctctgattaaaaatatacatttgaatgacatgtgaggaaaatattcattcactcagtcactcactcattcattcttaaaagaatgtctatgtattgggttaagcatcatgggaaattcaaggatgttgcactgtctctgccctcaggatgtttatagcatagaagtggctgaatgttattagtaccttgagataggaacaaggacagggccataaaatctcagaggaaagggaaggtcagtgtattttctcataccacaagtattacttgggtacctactatgtgacaggtgctattctagaggctggatatatagaaaagagaataagacagtcaaggtccctgaccttatggaccttgcttcctgagggtgagatggaaaataatgaagaaaaaaagcaaataaataatataacttcagatcacactaagtggcatgaagaaaaataaagcagagcaatagcaagaacagtgatggtaagggaaggatgtgaattttagctcatgaaggcccctgtgaagatgtcacattcgaatagagatttgacaatgtataggagcaagtgtatgaagttctgaaggaagggctttctaggtagtgggacctttgtaggacaggataaagactttattctaagtgggaaggaaattcactggagaattgaagcagggtatagcatgacctgatttatattttagaaggatcattccagatactgtatagaaattcaattatagaggggtaagaaggtaacctggacagaggttaagcatctgtgaatagtccaggatagaggagaacaatgagaacttgattcatgtagtctaaccaaggatgacagactggaatgcactgtggtagtccatctagatagaggtggttggtgaggactaggttgataattacttagatggtaaggagcggttccattttgaaggaagttgcacaaaggaagtgatatgatatgataatatctgagttgaactttaaatgaatggcagcatgtgacaaagcaagtagtcattcatggatttgttgagtgcttatctatttttatgaaccaggcactgtgctaggtgctatagatacagcagtatggaagccattgctgaaagtgagaacaacaaaacttgctgagaaggtaatattttaagtaaacatacacaagcagagaggtgaacaatatgctcataggaattacttcctgaattggttctaaggatgttttattcttttccatttagtgtagaaaattatgtgattaaactcctttgtatatttggctcagtgaatttgcaaaaggagtaagtgtctatcagtagaaattcaattcactgtcagttgggaaatttcatcagacaatttccttagaaatagtggctaatatttacttttcccacttagggagggagaaagtatagcctctctagaaagaataggaggataggagagtacaaaacctaggacaatctcaaatatccaggtgtatctattacagttcatctgccacctgcctccaatctgccccacagtctttttgcaaacagatgacccaacttcaactttccctccttctaatcccacttgtacactgcctctagaattaactggcctaaagtagtccagtcatgtccattccccagtgcctacagaataaatttcaaattcctcagcctgacacacactgacccaacctactttttctgctttatctctgactacacacttctcaattgttttaatcaccttgaattttcttcctctttttaaaattattttttgaattgcatgaatatgttatgaaatacacataacataaaacttaccatcatcgccatttttaggtgtatatttcagtggcatgaagtacatttgcattgttgtacaaatcccattggattttaaatgtctatttccctcatacttccagcaatttgttgcctgaaccaaatttgtttttatatggttcctggggcctcctgaaatgccttttcccatccaagtactaaccagacccgaacttgcttagcttccgagatcagacgagatcgggcacgttcaggttggtatggccatagatctgaaatgcattttcctttccttatcaattaaaatcccacatatctgaaagattcatgctcagattttgcctcttcctttaggctactttgacaccttatctggaaacaggaggtcaactctgttgctaggtaacacactgcttacagtaaaaatgatgcctggttggtaaattgcatctggactaggagggcctatacatgaactataaatacatgatggggatgtgatactttggacttccctgagtaatgactcgtgtaattaggtcccttgtagggaccatggaggataagtctatggagttgttgcaggagatatcgtctcttatggggcaggaggcttttaagccagggccattcctgcacccacccaatatgaatctagtcttcttgaacctgagctgccacctggggggccagaactgatatttgtactgatattaggactctcactgaagagaaaatctgaagcttccctggtggccagcagtgttttctgtatcacatttttctaggtaaatctcaagctaagggttcatgcctgtaatcccagaagtctggaaggccgaggtgggtggatcacctgaagtcaggagttcaagaccagcctggccaacatggcaaaatcccatctctactaaaaatacatacacacacaaaaattagccaggcatggtggtgtgtacccataaccccagctactcaggaagatgaagcaggagaattgcttgaacccaggaggtggaagttgcagtgagcctagatcataccattgcactccagactgggtgacagagagagaccttgtctcaaaacaaaaaaacaataaaacctcaagccaagtgtggcccatagtagtctcataagtctgaatgtgcagttggacctaagaagatctgctcttgaggttgcatcaatatgtagaactactgtactaaatacaaatactccttgcatgcctggactcaaaatcactgggaaccgtacacaggactagggcaataaaagtattgctcacctttggaaggagctggattgcctgtagaattctttgtctgtgcccagaattaaggattccaatttccaacaaatcctgatcttccataacattgcttccctgaaacaaaacagaaatgttacaagttaaatcaagcatttatactgtggataaataacaaggatttatttaatacagagaaaaccagtgagtgacctgatttttatgaacaaagacatagagtcattcttccgtgagggtgagggcagagtcggtcaccttgttactgatgtgaagtctaggagaaagctcccctcccctcacaaatatctatcgtggcttatatccacatggggttatctgcactggagattcattcgtgtgacttaaaactttgtttctgcacattgtgcacatgtaccctaaaacttaaagtataataataataaaataaaaataaataaataaaaaaagatccaaaaaaaaaaactttgtttctgtaaaaatgtgaatgcttctagtaagagttgccatttaagattatcagtgacttacacattgatatgaatgaatcatttttccccccttgatgacagattttgtgcggaaggctgatagaaaaattgacatatattaggcaggttaaaagtgagagttaatacttaatttcaaaatattgagtcacaatagcaaacacatagaatcaacctaaatgcccatcagtgatagcctagataaagaaaatgtggtacatatacaccatggaatactgtgcagccatagaaaagaatgagatcatgtcatttgcagggacatggatggagctggaggtcattatccttagcaaactaatgcaggaacagaaaaccaaacaccacatgttctcgcttataagtaggagctaaatgatgagaacacacggacgtagaggggaataatacacgctggcgcctgttggagggtggaggatggaggagggagaggatcaggaaaaataactcatcagtactaggcttaacacctgggtgatgaaataatctgtacaacaaagccccatgacacaagtttacctacgtaacaaactgcatgtgtactcttgaacataaaataaaagttaaaaaaattattgaatgccagacaccagatcacgatatgaagattgaatgatgaatatgatgcagggccctacccacaactgcctttattccttccagtcccgtgatggaaagggactgttcaaaggcagttaggtaggatgctgagactgtgctatgatggtgacacttgcttaggagtccagagggaatccagggtattttttcagagaaaaggacatctaatcagatataggaaaaatgggtggttaaggcatagcacctaaaagaggaaggacaatggggaaattatgtgcaaagacctgtgagtaagaaggaatgtagtatacttggaagcatcatgttctgggataatatggagagaggagcaaacggtaaggctgaatgagtaagcagagggcagaccatacagatattgcatgccatgctgagggcttcagactttatcctgaccataatgggtagccatggacagcttttaagaaagagagttacatgctgagattccaaatttagaaacattattttgatttctggggctgggcctcagtttccctacctataaaatgataaagttgagcccacaatgtccaaggaccagttcagtcctaaaattctgatttcaatggttattttaaacctgtgattaatatttgaatgcagaagtttacatattgctcattttatccctagattttaatctttcacggtttgtaagacagagtttctctttaaattgaggcgtctatagaggttcaagaattcagatcactattttttttgacaaatcaaactctgtcctacttatgtgtaacacaaaaacgcaagaatagaaatgacagaatatccatttatttagtgatgagtaccattagacactcaaagcaaaggagaatgaatttgaaagggtgattctggggcatggagaccactgtggttgttttctagaggcgctgtgggcatagactaacgtagtagtcacaggagcaaaaagaagcaggtggatttgcaaactatcaggaagtttgacgtggagattgaacatgtggaatgatgcagaaatgtggaatacacaaaaattcaaggcttgggcagtgagtggaacttgatgccttttcctgccataataaaggaggaagaacagccctggtggggcgcaaagtgagactaacatctttccctggacagggacagaatagatgcatgtaaacaacttaataatatcagactatgctataaatggataactggctgtgcttagaaggattaaagccactggaatggcacaacagctagggatttaaaacgggcattcactggacaaaagcattccacctactcatagtgtcattcttatgcttaagcaacaccagccatctcggaggaagcagaatgatccaggtattcagcagcatgataatgaaaagcctaatgaaaaacaaataaagccagtcttggcaacatgccacaggaaatattgctctcaagaaattactcagtgcacacaacagagcatggctgagaatacaaatgacttcatttagagaaagcgttattatttccagaaatggactagtatggcatgagcgagatatgtgataccattctgacttttactctttgaggagttacctggcccttaagaaaaaatctttcgtcatctttgtgctagaacattaccaggttttccaggtcctaacttaccaacccacaacttcagcccatgtagaatagaggacctggtttttttgcagaaacagaaagcatacgaatatcccatagtgtgcatagctactatctctaggtaatcctgacaactggatttcagtgtttgaatactgaaatgttttggtaaattaaatcctaaagatcactgttcttcctctacacctccaatatgctattttctgtatctcagtaagagaggagtccttttgaagaattatagggaagttagatatttttaaagaaggtgttgagtacataagaacatctttttgagccaaatttcctagcatataggataattgccaaacatttttgaaaaatgaaccaaaattatgggaagcacaagaaaaatagtgaaaatgtgtcaaaggggaaatggcactaattgggaaatggaaaggaaaggatttactgtccccagtgaggcatgctgttagaaattttctattttatctttttctataatacatagggatgccaaaaatatcctagtacatcattcagccagccttttgtccaaacactaggggacttggagtctgcagaactgggtttggatcatggcggggcaaacttggctaagtcatacattctttgtaggcttcctggtcctcacccaccaaatgaagcagtttaatgaatatgtattcagtttcaaaatgctatgatttcagccatgtttgatttttggttggtatcattatatataaatatagattgtatattttgaaattatgtttcagtgtttcagaatttgtaacctaaaattagctttaagaagtgattaaagagaaattcaagaatatatatttttttttgacaaatcaatcttggtatgatggacttataaaatttcttattaaaggaaattataaggtaacttatttttgtagtagtacggattcttatagcttttcagggaaaaacaaaatgtttcaaaccttataactatctaaccatttctttggcacctgggtgacagttgtgccatcaaagacaataaacattcccattcttcctagggagctggaattaattctcactttatcacttgcctttactaaatgctagcaaatctcagtttaacttctgttttttttttttttttttttttttgagatggagtttcactgttgttgcccaggctggagtgcaatggcacgatcctggctcactgcaacctctgtctcctgtgttccagtgattctcatgcctcagcctcccaagtagctgggattacaggtgcccgtcaccatgcctggctaacagggtttcatcatgttggccagggtggtctcgaactcctgacctcaggtgatccatctgcctcggcctcccaaagtgctgggattacaggcgtgagcaaccgctcatttttctcaataaaaactgaacacaactctagctttcttcctcctccatcatttttttttttcacataacttttaggtcaatgatttgggggcagagctccgtcatgtccatcttctgtttagtcatctactacactgcactctcaatctcctttcctacccagtacactccagtcccatgttttcatctcccattttcctcctcaacccaccagaataagctgttcccccccatcaactccatagaacttctctgtcaaatgttaagaatgacccctcaattgccaaatatagttgattcttttaaatcttgatttcaagaatttacttgccatatgtaggtgatggccaccatattggacaacaaagatacagaacatcgccatcattgtagcaagttccattagacagtgctactctacagttagagacattgaaactttagtcaaatcacaaaaatggggcagtagcagggaatcaaatcagggactcaaaaatactcatgagtttttctcaggatgtagttattcatgtgcctcttagtcaaagttcatgaacattaagtttaggatctttagcaaattctcttttaattcttcagtcaccaaaagaaattagaaggttgttctactttcagcaacatttctttatggtggggctataaatctatgctatgaaaatgacaagtccaatcactaaattatttttgactttcttagcatccaccaatcacactgcataaggtgtttaaataacaataatcaataaataaagttgtttagttaatgactttctagaatgatcaaagacccaaatgcagtatttttagaatagctgttctttgcctgtcaagaaatgtctaatgcagggtgtctttattgatctcttaaatcatggaatggaaaaagtcacctaatgttttatgcactaatagctgaaagtggaagtttctttgaccacggggagaatatcttaggtactgaacttcttcagctgtgataaactgttaggatgcccaaatagaatgaaaagcagtgttttgtatttaattattcattagaagtaaaacagctatttaccaaaaacatctcaaaaatatctgtactgatggctctgtctctccaaactctgcatttaaaatttcttgtagttttttaaacttaatacgatatcttattcatttagcaagctttccttcatattatatattgtagaaaatgttaggaaaatatatttaaggaccacagggaactggcttattcttaatataaacttgagttggataatgttatttattctcttccttcatccagtccaagactaaaaaaatcaagatgatactgttgattggggaaacttgtttttgctctataattagctaaattagattcttctccacaatttatgtgaccttaaatatttaaaatagaatcactgtataatagaatgacagcaagatcttacaaacttacacatagaaaaacatgtactttagtttgcttttaatatttagccttttataacataaatagcatggtagcatgaaactgtacataattttcttggaataacaatgctacctctctgcttctataaaagctttgagtcaatttgatatcaatttacaagtaaacccaatgcatgtcttctctgcatgattatgataatggttattgtgctaaataccagatttattattcctctgtcagtgttggaacaaagctttatttagcttatcatatagaaacacgggtgactataactgatcagataatggatgatgtgcttcttccaactttaacttcctctctcacattaatgaaatggcagtggaagaaaattctatagtacactaaaaaatccctctaccctaatcctccatttaaacatattctgtctaccgcaataaaatttcttgcatacaacttaagtaaattttcatgtttttagcttatgaagaaagctttctggattcttcagactatgtggactattgattcaaaaaatattacatcactgaccaataagacatcatcttatatgtgcaagctgtgtattttaataaattatatcttaaggttaagatatagtttagcattatatatttaacagctaccatgattacaatgaattttctgtcaccgattttttcctctttatttttgaaacccaattcccctttgaaacatctgttgtcaagctacagagaaagagaaggaatttaagtaaccaggtatttatttgttaaagtatcgagcaggatttggtgatatcataaattataaatgtaattcacttgagatgtgttcatgtaggttttagaattatgtgtatttgtaaaagagtgcaaaataatttatacagtaatttgtactgcctttggtcaaaaattttatagctatgagagaaggagcctattcttcatttttaaggatgctaacccagagctccttcaagtaagaagaaaagttgatgtgaacaaaacttttttgtatgctcttacttctctccagatgcatatatctgtataaatataaagctgatgaatacctactgtcttccttcaactttcacactgatagcagttggtgttcattagtgtaaagtaaatagcacacttactgtgtcaggcactgttctaaataccttccatatattactttatttaattctcacaataactcctatgaggtaggtagcttgttcccatagctgataggagactttctcaagacttaccctatactacctctagcaggaatcatgcaggagataaaaggttgagttaaaaaaacatggttagatccacaccatttatatttttacttcagagtcatctgaaattcacatttgaaagcgagtgttccaatgcatttatgtttgatttcacagtaccgaagcaacaatgaaccctctctatggaagagaacttggagagctgtctggcctaatcttccctgctttgctccagtcctttctgttcactgaatcctggaatcaggcttggcagggacctggggggtttctagtttctagtctaaacgttccctaactacccacaaagcttcaacttctcttttgaagtgtggtgtctcactgggttgacaccatccccagagaggtagggaggatattaaatgctttaaatggtctttcccagcagctgagtctgagcagggggtgcggctggggttggggtggcacctctgtcctactcttttagctcccactgtggtacagaccaagtgttgcaggagagctatctgaagaagaacgtgccagaagcggagatgaaaggaaaacagttagcagctgtcctgtgtccttttgtaatcacaagctgtgaagctgaaaaaaaaaaaaaaaaaaaacttccttgggtaggctgtacataatcttggcagatatctgagtgttgttcttctgtctaatatgctgaacgtttcccagtgcctcacaagagaaaagtgagacagggttaggtgagtttggacaccttgctccgaacaggcagggaacatggcgcccttgtacgttcatcaagctcttgcaaatgccctgtcactgtagatgctgatgcagagctccaaaaggaagggctcctctgcaggagaagcaaaaagaatttgctcctgggtattcccaacacagccacatataatgacgcagaaagaagtacctaaaaagattaccagccattacattcactgtgtagcaggtacttcacccaccttatttataaaccttacagcactcttgtaacataggtggtattattttcatcttatagaggaggaaactgagtctcagagatgtgacactatggagtcaagttcacaagataagtataggatggatctgggatctgtgttttatttggtcagactctgatgctgatgcttccttcactacataaaaagaaccaaatgtttagtaggggacattttctggatggagattccggtccatagatatgtaacgttaccaagaagttactcccatgaccctattttcacacacacaagcttacatctatatttacagaccatagggagtgactgccagagtttctccaacacattgaatttcacataaattatttatcttctgaaaggtcaactggttagttctccttctaaactaccttagtgtattccagaaccaaacatgttaatcaaagtgacccaaggtgtttgtggctaaagcactaactaacttgccatgtttcctgctgtgaggcaggaagtatcagcatggcattaggttgttgtgagagattcagctcttctgcagtgccttgtcaaacgacctgactggtcaactgggaaaatgaagttctcagggccaacatcgtatttgggtgtttttcttttaggtctgtatcaaagccagatttaagaaggagggtgtctacaaatgaacgaaagcagaggatgtctggggacaagctaaggacatttgtgtcccacactgcatgtattctgaatccagagaaaagagagtgagttgcagtctcctgagaaggctatccaggctaaggagcctgtgatggtgaaggtggataatttagccctctgagaagtgtagacctgtcaaaaaggagattcgttaattcttcaaagatatggttgtcttcaaagaacagacatccccagatttaaggatgatggggtctcttgacactgagaactacattcagaaatagccaaacaagaggaaaggagcaaagaggaagagaaagggagggaggaaatgagaggaagtgtttattcttaagggtgaaggtagtggtgaagggagtagaatttcctgataaaatacagaaattcaaatttaagtggcatcatgtatttttattcacttaatctggctgccttagacaggaggtcactgaaatctggaaatgagctggcagagtccagtccagagctaccactgaggcaggcattgtcattcattcatgtagtcagcatttgtttgttcaataaatattttttgagcatttattatgtgccaggcactgggctgtggttgtgagatacaatgagatcaggacagacaaggtccctctacctttagaatttacagtctagtggagaaaaagggaaacagtggaataaaaaaatagataaataattatttagcaaagttttactatataccaagtatttactgtattagtagggactattaagcactttgtcttgtttgttgttcatgataaattctgatgttagtatatacaattattatccttatttacagataatagactaagaattgaaggcacagaaaagctgataattagtctaaggtcacacaggtagtaaaactgacataaagggaatcaatggagttctaaaataaaaaataaacaaataaataacaacggagatctatgttagaaagactggtgaggaaagtctctctgagaaagtgacatgtaattaagacctgaggggattagaaggagcagcctaactgtgagaagagctgttacaaggacattccaggcagaaataacagcaggtgcaaaggcactgaggtgaggaaaaaggtgaggcatgttttaggaacaaacagaagcctactaagaataaaatttagtgactgagggggacgaagacctgggaaagaaacgcaggaaataagacaatacagagacttgcagactctgataaggactttgattgtattccaagtgcaatgggaaacattgaaggaaatatactaatttgcatcttcaaatatactctggattcggtgtggagaatggatggagaaattgggaggtatggaagttgagctcgacaatcaaaattgaaataacagcctagaaacataaataatctaaaggaaatgtgatgaaatatgaccttttgggagactatgggaatgggtctcactggggggggggtcaagtctccaagccaaatgcatcttttatttgaatcaaagagaaaagccatatgacaaggatgaaatcagaatagtctttgataaaggttctatgtggatacaactatgaataaagatttagcagtacctacgaaaatgaaaatgttcagactccatggacccagcaattctgtttcttggtcgtggcagacattgctgggaggctgagtcctttccctctcactacctcccactgcagaggctggataagctaaagttctcagcttccctttaaagcaatggttgaacatgtgacagaagttgtcattggggaacttctggaaaagcttttgctttcctaatgaaaagggaaaaattcacctgctacccttctgtgcccataagaaaggactctcctcaggatgagtggctaaacagttcagagaaggtgacagcgatgggcccacagtccttggacctccaatgatagatatctccattggatacctggaggcaggcaaggataggccatggaagggttagttctgcataaaaaacgttatttaaagctctctccatcttttgcatctaagttgctctgactagtgtttatctgtcagtgaaaataatgatggggatgtgtactgtggcatgtaattaatagaggttataatggaggcaacaggatatttactatttattttaggcagacaggggtatgataacataaagaatagcagagaagggatactaggaagaatgaaagttatcagatccaagttggggtgtgtgtgtttgtgtgtcaattatagcattgcctcttctcattttgacttaacgttgtgaatttctcataaaaagatgacttgaaggaatttctttactctggattttggtttctattaaaaactaaaacggatgcaaaattgccaaagtgctcatgggactaacaggttctaaatctgggagtgggtttcagcttataattgaagatgacaggtgtccagagattgtatgaagttatggttctaaaggaagtacagttttacataaacctggtattctacaggaaaaaatgttactcttgaaatccaaacacattataatcataacagggcagaaacaataagaacatttaggggtatgttaggttgaccttagtgtgtagctcttccaggaactcttgagaagtcagagtttttatttaggtcctttgtaatctggaatgcctttggtgggcagtgaatggcgattattgaaagagttgactgatagaatattcctgacttttccccacatttatttttagttttggttttggtcttgaagacatttttcttaagatgtcttcaggaaaaaaaaaaatttttccacattgaaaactttgttttggctttttcgagtttaaaattcggtgatgggaaaacttgctcacatcacaacaatgggattaagtgtgaggagatgatcgctgtgggcagacaggcaggaggctaaccccacgaagggctaaactaaaagctgagtaagagctccactaagaagagctctttgaactgttctgggactggctagggccactaattgtccttgggttgtatatgaagggaaaatttgtatcagggacacaaatatccttgtcctttgtatagcatctatatcatgaaggatattctcattttttaactccattttcttcactgaataatattactcaacctgaaagaaatacaggggaaagaaacggagggacatgcattctcacagtgaatgtaattaaatgtcctcctgtctagtttttcaagttaaaggttctgagttttgtttccagaatattcaactggtactaaaagcatcatgaagtccctcatatttaattaaatggtgcattattaaaagggggcacactctatctaggttaaagaggtgataaacagctatagaatttcatgtttctttctacttggtattatatgtcttgtttcctttactggacagcaaacttcttgggagaaaggatcatgcctgaagcatctttgcatctcccctaacatctgtttgctaagtgttgaataaaataaaagcttgaaagaatgaatctgtaagtaaaaacatgagttttttagatttattaaaaaacatttagtctaaagatcactaagtaagtttataggaaaagcactgaaattttgagctggaaattctaatatgcaggatgcctgatgtgtttttcccccctaattgaaagaaagataaagatggaattgctggtacaccataacaccaaaatgttcttaatttttttttcagttttgcaaattctcatgatttgattttcatccaggactgtcagttgagacatctgataatctaaaagcattcagagaattaggatcccatatggctcgaaaatatttcctatccggcaggaaaaagagaacataccatgaaaataatactggtatatccttcaatttatgtgtacaaggagcataaataaatttaaatcattattcaaagtataataattataatgatcataaggttgattataacaaccaaaataaaaagaatatacagttcttcataatcatgtgacattataaaaaatcagaagtatacttcaaatcaatgatagtaatagagttgtgtttgtctaacagaagcaacagtcattagaaatgagcacgggattaggagtcctggcttatcactaattaactgtataaatctgaaaaggtaatttaactcccttaggtcttaattttctcaactgagccatgaaagggctagaccagatgttcccttttaacacggcatctgttctggaggttctaacaaggagtacatctactcatacactcctattgcctgaagaataattaattcttcttgctttgggggaaatgtcattttcttcagataagtgttcagtattgagaggtgcacttacataatggtgagggagcaaggagacctgggcttagtcatctaatttcaccaacaaaattattactaacaataacaataacggctattcattgagagttaactgcaggccagacactgtgcttttatcctctgaacaattctataaaatagatatcgctattatcatccccattttacagatgagaaaatggaagcataaagattactaggaacttggctgagatcacacagtaagtggcagagctgctttggaaatgaagatgggtgttggaatcaaattcccctcaccccactggcttcccatagctttgacaagtgtcttctgcatggaattgcctcagagatctgatggatggagtctttctctgccagcccagtcgtctccatgaacctcctttcctacaatttctacccagggattgaggattattaataaaaagaaaaggaattgagtgctcctgggttcaccttacagctctgcactttaatagcagtgtgactcaggatcagcaatcctctttctttgtccgtacaatggggataacactaatgcttatcttttaaggatatggtgacataatgtttatgaagttgctttataaactctaaagtaaaattgctaaaaataaagcatgcctgctaggaactactttttttttttttttttttttttttttttttttttttttttagaacatagcactgtaaatcttctagtttcatgttgtttttgctggaaatagtctattctgaaagaggcagcatgtgtgatggcagaaaaattcagggttcccccccccacccccagctctgccatttacttagctttgtggccttgggaaagtcacttgatctggcatcccacagggtcccatactctacaggccctgcatttggggtttaatttctgtggttgctgttttgaagttcttcctaatttttttctttgagtttgtgtgttataagtgaagtctgaagggacaacggagcatgcgctgggcttggcaccttagatcatgggaggtcttgcttcctgctgcatctccaggatgggttctgccagagaccctcttcattggtctctctatctttagtcctgcccaacctccctttctctgttgagtcctaaaattgctgccatccttcactcctagcaggagtctgggtgccggcagagggagggcttgggtgggtcactcaaacccatggcaccttggggccgagcatggcatcgcccatccctgccctaacaggtagcagcattccaaatcaaatgggtgaccagccagaagctatcccaatccagatatcaagcatgtcctgatgaagagatttaaaaatcctttgcggggtgggggtcccctgtctgctatggatggaggtaatgtggcactggataaaagagatgcctggttagattttctgggaccctgctctatccaggacactgtggtagtcaggagagtgttgggggcctggcagtggggcacctgtgccctgcataggaggcacggtccagggtgcttgcatggggctgcactctcactacaagtgtcttgtgccttggaatgctcctttggctagctccatgcctggagcattctccctccttctaaccgtcctgggtttggcctgtatttgtcttttttgaccagatcaaggcatcctttggataaaaacacaaaatataaactggggaatttggtattccttcataggagttaaatgctttaatattttcatctaaaagtaacattgcacaatataaaaatgaatgacaaaattcatgctaataacataaaattttaatgtttctttacacagaacattaaatagtaaacaaaaaacaccatgacaagtctaaagagagaccacaaaaggaaggaaaaaggtttgtacgtatttttaatggcactctttcccctgccttttgaatagggggccccacattttcattttggactgagctccacagattatgtagctggctgcgctcccaggatgtaaggtttgcataatcacctggtccttgcttcacttcacaggtatatttgcagcagctctgcttgtagttggtaagctcagttaagcaacatagttggactgacttaagaatagcttaccatccaatgatctgtggctttatctttacctttccaagtgggtagaaaaggagtaatgggagccattcccttggaaactactgaggtcatttaaccctaacaaggatgatgcttcactagatgttaattagagatcatttccatttttagttttagttctagaggttgccttaaaaattatgagggcaacaggaaacactgaacttgcctagacttctggggcttctttattcattgacttattcattcacccattcaatcattccctccttcactcacactatcatttcacaacatttactgaagtgctatcatgctgcccacactttaagtatggagaattcaaaagtgattgaggcagtctctctcctaaagaagctcaaagtcactgggggaggggtaaggtggaggtgggatcagaaggcatataaagagattatttttattattgttttgagacagagtcttgctatgtcacccaggctggagtgcagtggcatgatcttggctcattgcaacctccaccctccaggttccagtgattctcctgcttcagcctcctgaatagctgggattacaggcacatgccatcacgcccagctaagttttgtatttttagtaaagattgggttttgccatgttggccacgctggtctcaaactcctgacctcaaatgatccacccgcctcagactcctaaagtgctgggattacaggcgtcagccactgtgcctggtcaaagagactatttttttgatgcagcacatacaatgattatggctgtacagagaaaagattcctgaagtacacagctttggatcaggaaagacattttgggaagcggaacatctctgctacctgctaaatgatgaggaaaagttaaccagaatacaggcaatgcttgaagcaagagagagaaggcactgcgtggatcggttgcagcatgaacaagggcaatgagaaaagaaacggtatagtgagagtgaaaaccagaaagcagtttacagttaaccaggtggaagaaacagggagggagagaccaggtagccagccttgtaagcgatgatgtgaagtgggcttcatcctgtggttctgggcagttggcaagttgttttatgcctggaagggagatggctggatttacaatgtagagagcaaactccagtggctatctgaagtgtggatttgaagggctaaaactggaggttggaagcccatttaaagagctcttgcagccataatacaagagacaatgaagatctggactaggacagcagcagcaggaatggtgatgtattaaagaaatactatagagccaaaactgactgaacttgattattgattaaatataggtattggtagaagacaagtgttaagaataactgtcagcgctcttgtttgggtaactgatggttaaggagtcaggtgagaaatagactttcagaggaggtagagggtttggaggtacagtgttttgttcttgtttttgagacagagtctcactctattacccaggctggagtgcaatggcatgatctcggctcactgcaacctccacctcccgggttcaagcaattattgtgcctcagcctactgaatagctgggattatggatgtgagccaccatgcccagctaatttttgtatttttagtaaagacagggtttcaccatgttgtccaggctggtcttgaactcctgatctcaggtgatccacccacctcagcctcccaaggtgctgggattacaggtatgagcccctgcgctcagccttgaggggctgtgttctgtttgggacatgcttaggggcctgtggaactggaaggaggggatgttagcagacagtgagaggaggctgaagtttggggagaggttcaggctaatgttgtagatttggggatgatcagggctgaggtggtagctgtatgaaatggataaatgcagcactgagaagaaaggggaaatgccatgagagaaagaaggaaaagatgaagttaatgaggaaaagagggagagtgtgtcgtgtcagatgccaagagggtaacgagtttcatgaataaggatatgaaccaactgttaaatatggcagagaagtcttaatggaagtggaaaaggccctttggtttggtaaaatacagcagctcatgaggaccccaggaggagttttccattatgggtacaaaagccagattagaggattgtgagacaaaaggggtggagacaatgaatgtagacgattgttttgagaaatctgaatgagtaagggaggagaaaatgtgcagcacagctggagaaggaacaggatcacaggaagttgctttattttcttcttcttcttcttcttctttttttcactcgtaagaataggaggtgactgggtgcactgggtcatgcccgtaatcccagctttttgggaggctaagataggcagattgcttgagcccatgagttcgagaacagcctaggcaacataggaaaaccccatctctacaaaaaataaaaaagttagctgggcatggtggcatgcacctgtagtcccggctactccgggggctgatgtgggaacatcatttgatcctgggaggcagaggttgcagtaaactgtgatcataccactgcactccaggttgggtgacagagtaagatcctgtctcaaaaaataaaaaactaaaaagaataggagactcttagctgggcatggtggttcacactgtagtggtggccacctgggaggctgagatgggagggaaaattttttgaggtcaggaggttgaagctgcagtgagctatgatcacatcactgcaccccaacctaggcgaccgatagatatgtgttttgaaaacataacgctcagagcaggttgaaaccctgtctcttaaaacaataattgaaaaaaaaaaggagacacttaagcaagtttgcaggcagcaggtaaagcactagtggagagggaagttggatccacaggagagggaaaggaaaactgctggaggtaggaggggtaggcctggggtgagataaagggcctggaagagggaagcaaggatgggtgaggtgtagaatccttactcctgaagcccttcactgctgatacttctgctatccttggcatgtgacaattcctcaagctgaggtcaatgccactgtgtcaattgcatagcaattctctttcttggggattcctataaaaactccctcataacaattccccaagtctctagtcttaccttgacgcccctcagtcttacacaattccttgctattttgactagtttgaggttacccatcatgaactccttcgacatctctcctatcttgatttatatactcttcttggtctcattttttcctgcaatattaaaaattctactgatctttcaaggtccaactcaattgatatcccttatctatgtctcactttcatcttacatatacatttttaaattacttgatgtcttttatgttatcttataagctaatttaaatacttcttaaaacaaggaagggattcaatcaacctatcaatcgtcatgataccctttcctatctcatcttcttttcatcttcttcaactttttgactcatttttatatcattcctctatgaaactattaaaccccttaagggcaagtaaatgttttttgcacctgctctagtatgacaatacattatacataatacctacctactacaattaataaattgtaagctcctggaggacaagaatttaggagttagctagctagatagagatgaatacacatgcagagatatatttacattctctcaagtataccaatttaatctaatacttactatatacttgctagcaattagagatatataaagataaataaaacaaaacacagtctctgtcttccaagggtgccaatccagtgtggcaatcagagaatgagagggcttgaatgacatgctgataaaattggactgtattctgctaggtttcttgcagaacttagggcagaggatattaatagatatgtgttttgaaaagataatgctcagagaaggatgaaggatgaatttgaaaagaatgagattgagggtaggcagatctatgagggggcttttgcaatagtgtagatgacagataataaagatcaagtgagggcaagttggttacagatgagatattgagtgtatatgcgtgtatgtgtatgttgggggagtgaggttgtggtgcacaagaataagtgtccagaagttatttgctaatcttactttttaaaagacattaaatggtaaatagtagtaataactatagcttattacatatcgtgtaacacattcctctagactggccttaggcaatattgagatctgttccatttcaccacttaggatcctctaggcccgattttggcactttattctatatgatcggctatttgttcttctcttattacttcaggtctcaagttttgatcatcctatgagcccatatatccttcagagcaagacaatgtgaataggcatcgttgcacttggtagagggttaggcaaatagtggatgccaaataaatccttgtggaattgaatggtattacctggagttccctgaaggttgtacatcctcttactccttggcctttggaacgtccttctctatacctggaattcttcctctctctctttacctcctctgactactgtctctttacctcactttgaccttcctagttctgtttatcacttcctctaagagttgttgcttgatgcccctgcactgggttagcagattttgctaagtggtccacagaatcacctacttatgtgtttctctgccagctctataaagacagaccagactaccttgcggtaatttgttcagtattttatccccaggttgagcacagcacctggcatacagtagacattcagtaaatatttgttaaatgaacatggttttgtggggttttatttgtaaatctgaacattttgaaatttgaatcttcaaatagctggacataaagtgctagatccatccagacgaaagaaataatgggagaccatctagaaaagtattttgttctttatgctattaaattcagtagaaattagttattatattttttgaggactgttatgcaattaacactctggacaacatgaagacagttcagatttcacctttctatcctgccccccaaggacatgcaaaatatctgcttgggtacccgttttttcatgtgtacacactagcatcttcagttgataagttcctgtggggcaggaacagtaaacttctcagaattagaaagcaaaagtgacagcaaaaacacgacaacatcagaaagccagattctatgtcagaaagtcttaggagttgtagctttagtgttctgcagacaacccaatgtcacaggaaatactaattcccttgctctggggcatttattaaaaacaaaattttttgggaggccgaggcgggcggatcacaaggtcaggagattgagaccatcctggctaatatggtgaaaccccatctctactaaaaaatacaaaaaattagccaggcgttgtggcgggtgcctgtagtcccagctactcggtaggctgaggcaggagaatagcgtgaactcgggaggcagggcttgcagtgagccgagatcatgccattgcactccagcctgggcaacaaagtgagactctgtctcaaaaaaaaaaaaaaaaaaaaactaaaactaaaacaaaattttacttcctactgcctggtaccatattatgcagtagagacagaggggttaaggaaatcaggcatagtccttgttctcatgtagtttgtagttaaggagtgagagaactggcagtgacctgattttgaagaggctgattcaggtcaagacccaattttgaagctggtctccaacaagaagagtggtttctaggaatatagctctgcacaagcaaatacatatcccttagacagtctgtgacatggagtgaaaaaccctccctgacagatcctttactagggatctctgcaagggctcagatctctacttcaatagaaatgctcattggtactatctgaggacgatttttccaagaggcacaaggagatcaattactactggcagcctaatttgcaagataaagaaatttcccattattctagtatcttcgcaaccacagtctacttcagcatcatcagccgacatcatggcatagtggaaaaaaatttggaatagctaaaaagtcacagattagaagttctcatagctgagatgctgctatgtgcttcttgttaaaatccagggttaggacaagggtcagaggattcttgtccttctacacttgagtggcctacagccatgtattcttctaaatcatgttttgaatttcgtcttgaaagataatgttttaagagtgctaagcttatatactcatacaacagaaataatatgtgtgataaagttgggcaagaagtgcttttaaagttgtcggtttctaaaggtgtctttttttaaatgggtacttaatagttatacctatttatgggatatatgtgatatcttgatacaagcatacaaagtgtaatgatcaaatcagtatccatcatctcaagcatttatcatttctttgtgtaaggaacactccaattctactcttttcatcattttggaatacacaagaaattgttaatcatagttgccttattgtgcttcaaaaaagttgtcttttaggttgtcttaaaatttggttacgaattgataacactagtcagaatcatgatttatattctgtagatcatttttttccatttagctttcagttataatacctcacagaataataaagcttgataggttaagtgtcttggtcctgactatcttgagaataatggttggagcaagaactatggtccagacgtctgctctagctgcaatgtttcccctccctactccattacaccacaatgatggatgaatgacggatgctgcagcagaagtaattacagtaaactcaagatataaaaacaattaatatagtgaaaatatataaattaataataaatataaaatacatgcatctttaatattaagatgtaatataatttataaattaatatagcaaatacagtaatatctaatggacagtgaccccatcaccccacttttacacgtgcctctaagagccatttcttatttttgaaggggagcagctacaccctcactctttgggttgcggtgccgtgtagaagtgatgagaatgggaaactgatacactcctgcacagagaagccaatctgaatgccagatgattaagtagaaacctccaccatgctgcctcagacttacaaatgaagtgcaaattaaaatgttagatagacatactcaacagcctgtaacatcacaaggactgtctttggggtatccatttctataaaaagaaaatctggcattcctttttggaacattaggccaaagtagaggataatgagaacagaaatgccttatgcagtcttaataatctttctactcagaggattcagtggaaactagtaactaaaaaagattagccttgcatcaagaccgagctatccagaaatcgcccggcctgggatgcagattcagtcacttaagtgagttgtaacacaggctcacttgtaggtttgccacaattttcttgcaattcagttccttcctctgtcaggctgcaataatgagatgaattcctgcaagaagtactcccagaaagacacagggaggtctgagtagataactaacacagatatctagagaacagaagtgctagacgaagagagaaataaacacacacaataattaaaacaaagatttttttaaaccatagcgacattacacttatctcaatctttaaaatccaggatatctatatctttgtgtatttctcactgaaactttccctgggcctcccaggaagaacataaagaataaagaataggttcattttcttacagattaagagatgtgaggctcaaatgaccttatcctggtaacatagctacattactgcaagagcagcatctttaatccctatgattcctactccagtcactctttaccagtgaaccatcaaagtaggtgatgatgctgaaagaggtacagaagattcagcttgtgaagataagccgaatgacagaaaatgcactttgtgcaaacctccatgcagtgatcacaatgcattttagccagtggttcagttctctctctgtccaactagactatgtaccttgaggatagaaaccatctgtccacctaatgtccccagtagtcagcacagtaactaacacatagtagtcaattaatatttgaagaacgtataaatgaatgaatgaaagcatgaatggatctggaaaagttgccatcaggaattggggccctgaagaaagaatggggttcataaataacattcagcaatcatagtcactgaattgggtactaatattagtgaaaataatagagacagtaaaaccaattataaatagataaagaaggtagtgcttgttctgttttgtttcataaaagattgacaattttatttatgaacacaggatttgagctaaaaagagaacagataagaaggtaggtgactaaagaaatggttgccgagaaaaagtatgaaacagagtttagaacagagaagaggatacagagataattgtaaaggtgtttgacagaaaaagggaaaaggagaaaagaaaaagctttcagtaggacactttatgggcataatagggttcttctttagggcatttcggaagttgagagagcaaagatgagaactcgagagacatggaatggacaaaagagaaagggaggtgagatacatggtactgatcactcacagggaatgaggaagggaagtaaatggcctcaaagaagtcatagctgtcatcgagcagcaaatgccttctgtcatgcaggtggaattaaagcttaaatgtgaactgatggtccatcttcagcttctttctcttctcgctctgatacctgccctcaaggttgctccctggctggtcagggaactcacactgagctgtagaatgttcccaggctctggacctttctgtactgttattcaaccatcagcacttgctagcttctgtcctattctctcaggatgcctgtttttattaaatgacaaaggaagttaattggttcatcaagtagagcaattcctattgtgggcttagctggctactagttaccttgcctattacatataacagcagtgaaataaacataaaggaatgaatgggtgggctttcattacgtgccaggccctgagctagatgcagcagagtatggcagaacaggacatgggctttggagacagacacacccaagacagaggtctggtccataatttcctagctataagcttgaggaagttatctcctagggttcttggattcttcatctgtaagatatgaagaataatttcttcaccctcaatttcctcctctatgaaatggagataatgttgcctacttcgcagggttcaaaatacatataagtgataataatgttatttactatttattcatttatccccactttaaaaaggaaaagctgaggcacagagaagtaaggtgtgactaaggtcacctagctgggaaattctagagctggcatttaaatctagcatttgtctttatgcacttacccaacatactatgtcatcttaaccaatacactaaagcatcattagatgtttccatctacagcctcttacagtggggaaacagtttgatattcaccaatctcatttaaccctcacagcacctctgtgcagtactaacatcttgctttaagatgaggaaaggaaagctcagagaaggtaaccgtggccaaaactcaacataggcccagagaagggaacaccagccaaaactcaaagagctaattagtgacagaacttgaaattagatgtagggtttatgaccacaaatataaatataagaaagagagccaactctgggcccagagtagatgcccacatctttactagttatctaggtggtatttctacattgcttttaaagttctctgatagcaaagctgaaacctggctaggtgttgtaagatagatgagaaactgcaagtcaaggtgtgagttcaatgagtggattttaactcctaacttcaggagtactggtcaattatcctttactgagtggtgctatcagcccacggtaaaataaattagatttttaagaaggtgcagaattgccactataaaatcagataagcctactgcagttgggaataaattctatcatagaaatacatcttgcctgatatcaaaggaagccaagaaaccatgccaagagttggatgaaaactgacattttctgctgtggagacagaagtggtagcactgattggagaattatattttgaagagttctaaaatatttatcatcattctaggtcatttattcatttacccttttaatgctcatttcttttgtgccactaggtcgagcttaaaagcaaagaatgaaaattcactgtgtttttatatattaatatgaagcaggaagtttctctattgcttggtttgaaaaataaaagcgtttctgagaaatattagaacactaaatgttctttcagaaacatggcttttgtcattaataaggatgctgggtgtatctaagcgtgttatgaatttgtacttttttttgtttgataacttcctgtaacttgaagtatttcaagaagggaaaaagctgataaaaactactaaaattgccattgcttcactgtattgattgccccattatgtttctttctagacttgactcaggcatctccttctccaggatgccttttctgctctccattctaattaagatggccttcctctgtgctccaggagcatttacacaaaccactatccatcactgcccttatcacactgcatcgaagctatctgcccgcacatctgtgccccctggaaggcaatcaggacaataaccatggcttatattccacctggtgtcctcagcacctggcatggagccagaactcagcaaatttttaccaaagaacaatgaattttaaaacctgactatagaatggcagaatgctccttctgcctccacgaaatttactttcaagttgaacaattttattaaaaattccattttctaatggtatcagagacctgcaaagctaaagaaaaagcaagtcttatttccaggtcagaacttatttcccaggtcctcactatttggcttatataatattaaaaggtatttttaagagtataatttctatttctcaggcttgaaggatacttttgttagtgtcctcatagctttctattttggctttgcatccagagaaatgaaagaggcttgactcagctgccgcttaatactgcacaagcctgagagagaagactattatataagctaatgtgtattttaaggtgtttttttttttcatagccaatacctaaatgccaccttccaacctcatgaaagtgctgaaccccagtgtgtgggaaagcgaggtcccctacacggctctgtattccttataagtataaaaaataaaagcagttgattaagggttagcaattttcttttctttctttacacgtacttgtaattcatttaatgcaggaagtgggctgagttttcttgttctttccaattcaactctcagggagctttcttgccagcctgctatggttaccatggcaacaaggcgatggtggcagtaatatgatctcatatgccttgtgtcaatagcatcagatcatcacgcttgaggataattttgacaataagcttcagatatagattcaggatatattaccatttgattgatttaccagaaatactgagcaattacagccttaaacttctaataaaagcatgttcacaaaggttagcgtttttccctagatgacatattatatggcattctgaaatttgtaaattgctttcatatatctgcttcaattctcattaggcaggacagatataatcatccccattttatagaagaggaagtaaaggcccgtgcaatgtgctgtgtaaggtggcaaaagcaactccacagtgaagctgaaacttcaacttgaggcttctggcatcagaatcacactttcctcatgcctgtgttaagaattcatgggtattatcaaaatgttcttagatgcataggttagaccctggaatgtctgaattaaaataatgtaaatgtatctgtgataaataactactagtttgagaatattagtattttatatttgggtgatgcttcatacattttatatctcccattacaccttcctttcctaaggcttttctgatactagatgcacaaatagatgcttatctctttctcccactgatcaacatcttgtcttttttgttgttgttgttattagtgacatttatttttccattgtgagttccttgaaagtagggatcatgttattcattcttggaaggtccctgatcctggcacagtatgtatggatctgttatgtatcaggtactgtacataatatgtaccaggtacataacagatacaccataaatgcttgttgcttgttaaactgaactcatctgacacccacaaaccccatgaggtaagtacagctggcattatgatccactattttaataaagtggaaatagaggtcatggatatatcatgggcaatttaattctttccactcccagccatgtgctctttccatgtcgtcctgtttgctttattctttcattgtttctctttcattcattaattcatcaaacatttattagttgctctttctatatcaagcattgctacagataatgggttacaaagataaataagacacaatcctcagcaccaaagggctcacagataatgcagataattttctgcctaggcaagtagtaaaataaaaccttatatggaacttcgagtatgcattatattatttcccaactttattggctctttaaaatgtatcttgagaatatgtttcaagtccctctttaatgcagtgttttagaactggataagccttgagccattgccaatatagggtgatactaattctgcatcttcgttttttttcttgggcataaaatcagcatttccaacatcccacagaatccctaaacttaacgtgtcctcaatgaaactcagtatctgacctgaacgaatgggaagtggcagaaagaggcagatggtcagggtgagatgccagactctgccgtttgatatgacttagggtcagttacaccatctaggggtttcttcattagtatctggcacgaaacacagtgttcaaaatacttcttaaatgtattaattaatgaatgagttgtcaaagaggatgaaaaatgatgacataaaatagggatacctgaagcagtgttagcattagcaggtactcaataaacatcttttaaagagtggactaaatatatacgattcaattccccttcctgaaacatattaaattgccaagacaaaacttctaagttatctttatgtctctttccacatcatagagtcaggtttatttcacctctgcaatgtcttggacttgtgcctttctcttcatccaatagcatgatttgatccaacccccaccctttcactagtagactctcagagaaggcccttgactgaacttcctctctttccagggtctcccattccaccttactggtgaaactcttatttttaaaggataactaggagtgtataactcttctggccagagattttgtattgatttgtatattctaattaagaaactttttagaatggtaatcaagatcctctaaaaggtgatctttagttatacctatagtcattcctttccatatactctaggttttagcttcccctacacacacttttggacttttaagctttcttcctgtattcctagttagtggagtaataacagctttgtaatacttttgcacaacactttgcaatttgtaaggaactcatatatgtttataatgaaactttgtgataacctcagagtaggtggatatgatcattttcatttcaccaattaggaaattgaaaatcagagagttaaatcatacagattctcataacctttatgagaattctattggaaaatatttgtgtctatgatgattgtttaaccatggaatacttgaatcaaactctttaaattaacaactgtgacttcaaaatgctaacgattgacatttgttcagctcgttagcccagaggctaatcatgatgcttttcttctgcatagcaaaagaaactatcaacagagtaaatagacaactacagaatggaagaaaatatttgcaaactatgcatctgacagaagtctaatatacagcatctataaagaatttaaacagggtgggcatggtggctcatgcctgtaatctgagcactttgggaggcggaggctggtgcatcacttgaggtcagaagtttgagaccagcttggccaacatattgaagccccatctctactaaaaatacaaaaattagctgggcgtggtggcatgggcctgcaatcccagctactcaggaggctgaggcagaagaattgcttgaacctgggagatggaggttgcagtgagccgagaccgtaccactgtactccagccttggtgacagagcgagactctgtctcaaaaaaaaaaagaacttaaattcacaagaaataaacaaataactccattaaaaagtggcaaaggatataaaccgatacttttctaaagaagacatacatggagccaagaatcatatgaaaaaaagctcattatcactgatcattagagaaaatgcaaatcaaaaccacaataagataccatctcacaccaatcaaaatggctattattaaaaagtaaaaaaataacagacgctggtgaggttgcagagaaaaggcagcacttacacacgatgggatcataaatttgttcaaccattgtggaaagcagtacggtaattccttaaagagctaaaagcagaactaccatttgactcagcaatcctgttactgggtatatacccagaggaatataaatcatcctcccataaagacacatgcatgcgatgtttactgcagcagtattcacaatagcaaaaacagaatcaacttaaatgcccatcaatgacagatggaatgaagaaaatgtggtaaatttacaccatggaataccatgcagccacaaaaaagaacaagatcatgtcttttgtgggaacatgatggagctggaggccattatccttagcaaactaatgcaggaacagaaaaccaaataccacatgttctcatttgtaagtgggagctaaattatgagaactcatgaacacaaagaagagaataacagatacttgggcctccttgagggtgatggttgggagaagggagaagagcagaaaaaataactattgggtactaggcttagtacctgggtgacaaaataatctgtacaacaaaccctcgtgacactagtttacctatgtaacaaacctgcatatgtaccccacaacctaaaataaaagttaaaaaaaaaatgatgttcttggctgggtgcagtggctcacacctgtaatcccagcactttgggaggctgaggtgggtggatcacttgaggtgaggagtttgagaccagcctgactaacatggtgaaactctgtctctacttaaaaaatacaaaattagccagctgtggtggcgcatgcctgtaatcccagctacttgggaggctgaggcaggagaatcacttgaacccaggaggcagaggttgcagtgagccgagattgcaccattgcactccagcctaggcaacaagagcgagactccgtctcaaaaaaaaaaaaaaaaaaaaaagatgctcttaagctggattgcctgtgtggaatcctggctctactatttcctagctgtgtggtcttggatagattacttaatctctctgtccttcaatttcctcatcattaaactggggataccaatagtttctattgtgtaggattgctgcaaggattagtgaattttatgtgcgtaaagtgctaggataatatctgacacatagcaagcactcctaaatgttgctacccttaaagacacaacctaagaacttctttggctagtccctggtctgagaaggaaaatcaattccttcctcattggtgctaccttgtttgggtcttctatactggggacactatagctgcctcagggtgttggctcaggatagattcagaatatctgaatctacttattgggagcagtcactgagtttctctaagcctcattcaccatctgaaaacacctggataataacagcattttacatcataggattgtggtgatcattttattaactagtacatataaggcatctagtgcttggcatggagtaactaatcagtaaaatttagtgactattactgttacataaatgttttgcccatgatattttgaccttcttgggttaggacctgtctttttcgttatctttatgcctatctttgttgcttcttcacagtagatttaaaaaaaataaacatttaaataaaaaagattttgcttatgagtgtcttggctatatgggctcttttttttgttccatatgaaatttaaagtagtttttttctaattctgtgaagaaagtcaatagtagcttaatggggatagcattgaatccataaattactttgagccatatagtcattttcactatattgattcttcctctccatgaacatggaatgcttttccatttgtttgtgtcctctctgatttccttgagcagtggtttgtagttctccttgaagaggtccttcacatcccttgtaacttatattcctagatattttattctgtttgtagcaattgtgaatgggagttcactcatgatttggctctctgtttgtctattattggtgtataggaatgcttgtgatatttgcacattgattttgtatcctgagactttgctgaagttgcttatcagtgtaaagagattttgggctgagatgatggggttttctaaatatataatcatgtcatctgcaaacagacagtttgacttcctctcttcctatctgaatacgctttatttctttgtcttgcctgattgccctggccagaacttccaacactatgttgaataggagtggtgagagagggcatccttgtcttgtgcccattttctaagggaatgcttccagtttttgcccattcagtatgatatgggctgtgggtttgtcataaatagctcttattattttgagataagttccatcaatacctagcttattgagtttttagcatgaagggctgttgaattttgttgaaggccttttctgtacctactgagataatcatatggtttttgtcattggttctgtttatgtgatggattatgtttattgatttgtgtatgttgaaccaaccttgcatcctagggaggaagctgatttgattgtggtggataagctttttgatgtgctgctggattcagtttgcctgtattttattgaggattttagcctcgatattcatcaggaatattggcctgaaattttattttcttgttgggtctctgccagattttggtatcaggatgaggctggcctcataaaatgagttagggaggagtccctctttttctattgtttgaaatagtttcagaaggaatggtaccagcttctctttgcacatctggtagaattcggctgtgaatctgtctggtcctgggcttgtgttggttgctaggctattaattactgcctcaatttcagaaattgttattggtctattcagggattcaacttcttcctggtttagtcttgggagggtttatgtgtccagggatttatccatttcttctagattttctagtttatatgcatagaggtatttatagcattttctgatggtagcttgtatttctgtgggatcagtggtgatatcccctttatcatttatttaaatacaaaagatttttcaataaaaatgattaaagtagcaggatagaacaatctttgcagagaaaatcccaaactctaagtggatggatgctgagactgtatgcaaaaacgctaaattctagaaagagttaaatttgaaaatatctattcttattacaaaatattgatctagtggttgttgggaaaatataaatgtaccatataataaattgggtttggattattaaaattctattaccttgtccacaatggaagcaagaatataaatgactttataaaactaaaaagttttaaattttcttctgtacattggcatatctcacaaaggaatggaattggttacactgcatatgagaacattttgatgcagtataatcttttattgtgcagctttatatagcaccctttcctgaaagagtgactgtacagcgcctggtgttctaaatccagtcgctaactcaaaccttttcactttcataaagaggttttgggaatgaagttaatattccatttaccaaactaaaatataatattatgtgctgcaatgctgtgagcccacccacccaccagactgcagataatcttctattcatatgctcaaatcaagtactatgcatatttctagctcactatcaaaagtaactgcacatatacacaaagaaaggatagaagaaaatgaatgagcagtcaaaaatgactgcaggcgactttaacaatacaagatcagccatttttgacaaatatttgatttgaaattcactgatcttctattaggactcaagggctggcaggagtaacgaatttcctgagcttctcttatgtatgttcagaagtattggatcagtttttggtctcggggtaacaacaatagcagcaaaacagtaacagcaaccaacatgcactgagtttacttcacaccagcactcaggcagaacttctgcttcagcagggtgaataagagcccccaaaggtatcagatcctaatccctggaacctgtaaattatgccttattaggagacaggaacttgcagttgtgattaacttaaggatcctgagatggggagattaccatggattatctggatgggccctaaatacaaacacatgtatcttataaaatagatggaaagggagctttgacagacaaaagaggaggaggcattgtgaccacagaggcagaaattggagtgatgtgggcacaaatcagggtatgctgacagccgccagatgctagaagaggtaaggaacatattaccctctagagcttctggagggaatgagcccctgctgacaccttgattttgcccaagtgatacttattttgaattcctgttctccaaaacttggagagaagataaatgttttttttagccagcaagttcatggtaatttgttacagcagccatgggaaactaaattaagcatccaaccattgaactaatatactaatatattgctgaactttggttcattccttcataagcctcccaaattcttgatttctttgttctgtgggggctgctgctggtaagagtagagctattaaagcatccttccatgtgaagcatcacctgctgacatttttgcagaatcccttccattgtcagccctacctacttacaagttgaaattgacacacaggtgcagtgagtcaaggtctgacttgaatgctttgcttttctctcagtagattttcttaaattcagcaagtcctcacttaatgtcatggataagatcttggagattgcaactgtaattgaaactatgtataaagaaaccaatttgaccacagtcaaatcaatataaacaagagttcagttcctatggtatatttctggtcaaagaaagtaatcaccaaacttctaaataaagaagcaaatacttctaatattaaacatcaaaataaatgggagctatacatacatttaagaaatattaatgaaaaggaagatgatgatttacccaattattccagttcaaggtcgcctgtcccggcaactcagggcaccaggtgggaacgcaccctggacgggacaccctcccatcgcagggcatactcacacccacattcgcactcactcagactgggaccatgtagacttgccaattcacctagcattaagcacatccttgggccgtggaaggaaaccggagtgcctggagaaaacccatgcagtcatggggagaacaagcaaactccacgcagacagtgacccgggctgggagtcaattttttttcttatcaacatcataaggaaacagcattacaggaaatggtgtaacttgaggacttgctctatagaactacacatgccattatttcagtatgtttcttttcttgtttgatctcattcatttgcacacttgaatccaccaataattaaaaacatctgtgaatataatcaatacataagtaatgaatttattgtttctttgggccagaaaactgttaagaacttgttatatgcaaggcattggtttagaaaccagatattcaatgataaattcttgacctcacttaaattcttattgagatgaaaagaaatattatcaagtcacaaacagtacaaagctgggtgtgaaaatgccataaggagaagatggagacaacgctgacattcagatttctggcttaaatgactgaaaaaatagtgatgccatttactgacatgggaactgcaggagaagcagcagatttgggaagagcagtggatttgaggtccctggggggcatccacgtggaaaaacaggcctgatgttaaggagagagaacttagaggttttgaaattatctgggcattggtgataattaaaatcctaggaatggaactcattgctcctggacattgcataatgggagaagaaaagagaggcttagaaaaagtacagggctagtaaagcgtatcgcatattaagagaatgatgactaacctaatttgagatttaaagggatctgataggagataaattaaaaatcagttgggtctatccaaagaggataaccctatatgccagcctccaaaatttagactttttttttttttggtcatatgtattgagtcatagttagaggttttaatttggggactagtaggattatagctatgcttataaggtaaatccagggtagtgtgtaggatggacattagagagaaaagacagaggctgaagagttgagttggaatgttaatgtgatgatctagaattagaggtaatgaaggcctgaagaactgttttaacagtgtgtgtatgtaggtatgtgtgtgtgtgtgtgtgtgtgtgtgtgtgtgtgtgtattttccccccaaatatactaaataaaattggtatcaacatttcttatcaacactatagggaaacagcattaaaggaaattatgttacttaaggtacttgaggtttgatgttcactcaaacacttttgagtatttatttctgcattaaaggtcttgcatttcatacatacaggtgaaaaaagaggaaggcaagatgtcaagagaaaaaaatgtggcatatggcctgacccagtttatttgttgagaactttgtggaagcaggatcagtaggatgcgctgcgatgtatcctggcagtggagaggaaagttaataataaccatagccacgggatgaacagtggctgctcactgagtgttgctaagggccatcaagaggtgaatgaaaagaattatccttttgttcccttcatggagatgctggcaaatgaactgaatttaactcaatgaaccacaaagcctaagggtaactgttttcctttgtggtttgcttattgaaagtcactgctgagctgatacgggtgttggggacaatgtctttgaccttggagttcttaaaaccatcctcagactcaatgaacagttggtaaggttttaggaatgtcctagcaaaagcactctggattctgcaggcaagtgggataattcctgaagtattattttaaaaattgtgtgaaacagtggaaatacactatttggagtcagatagatgagggtttgagtgccatttctatcacttggtgatcctgagaaaatcagtctccttaagccttaggcaaaatggggataatgatcgattttgtgaaaatgttaataaaataatatatggaaaaataatatatttgaatttatagatgagacttaatagataaatgtgactgccctcccatacttaaggtcactaaaaatattaattaagagtatgttgaatagaagaatttggaaaagaaaatcaagctagagagaatgggagaaatttccttaagaaacaaaacataaaattttattaggactatttgatttgcttaactgaaactctatcaaaagccattttctggtttttacatgaatcttcaaatatttctaatcagcagtttttctcttaactgccactcagcttttggttggatgatgcagagatgtaggtgtttcgagtaactaatacaattcccttctagggtatgttgcagggtgccttaacttactgtgtatgcaaggtaaataactcctaatatgagacaacaaacaaaatacatgtctaatcaattcagaaaaatgtttaggaagctccataaacatgttttcataaacgcttgctggcagccaacttgcctggctttcagagttgctataacaaccagcagtcctctcagcagccttggcactctgcattcttacatcttttaataagaaatatcattatcttgtctgggctcattagctcaattatttaaagcatggtactagtaaagccaaggtagagggttcaaaagtatgcattagcaagaaaattctatccatgtgtcctttgccaaggcgacttgttcattcattcattcatttaaaaatatttattgaatgtctgccatgtgccaggttctgttctaggagctagaaataaatcagtaaaattaaaaaaaaaatatatatatatatataaacatgtatataaaccaacaaaacaacaacaacaaaaaaccaacaaaaaaaccccaaaaaaacaaaaataattaagatgccagttttagtgatgtctatagtctggtttgaggggcaagaagggagacagatgctgactaagcaacaaattaatatacatgtagaaatacatgtagagtgagaacaatgaagacaaagcagggaaaggagacaggtgctgtgttagggtgaggagaaagtgcctcttgatatggtgacattagagcagagatttcgatgaattgaataagaaaagctgtagctaagtcatggaagaacgttttaaacagaaggttagcagggcacaagctctgaggtgagagtgtgcttggccggatcaggaccagccaggagacctgtatgactggggtattagtcagggttctctaaagggacagaactaagtggatagatgaatatatgaaggggagtttattaaggagtattgactcacaagatcataaggtgaagtcccacaataggccacctgcaagctgaggagccaggaaaccagtccaagtccccaaacctcaaaagtaggaaggtagatagtgcagctttcagtctgtggcctaaggcccgagagcccctggcaaatcactggtataagtgcaagagtccaaaagccgacgaatctggagtctgatgtatgagggcaggaagcatagtacaggagaaagatggaggccagaagactcagccagtctagtcctttcacgttcccctgcctgcttttatcccagccacactggaagttgattagatggtgcccacccagattgagggtgggtctgcctctcccaacccactgactttggcaacaccctcacaaacacacccaggaacaatacattgcatccttcaacccaatgaagttgacactcaattgtaaccatcacaattggagtggagtgctcaagggaagaacagaaggtgatgaaatcagacaggaagagatgatctgtccatgcagggtcttggaaaccactgtaagggattttagattttattctgagtgagacaggaaacgaatgcagagttctgagtaaaggggtaatataatctgacatctactttaggaaaaattgctttggatccagagactctacgtaggggctcaagaaggaaaggggatctgttaggaggttattgcaattaaacagaggagaggtgatgacagcttagagcaggtgccaaggatttaagaaataatcagactctggatgtttttagaggtagtgccagtgggatttgctgatgaaataaatgtgaagtttttctcttgagcactagaaaaatgaagacagcatttccgccctggggaagactgaaaaataaaagcatgcacaaacttatttgtgtgcatgtgtgtgtgtgtgtgtatgtgtgtaaggcagaatggagttgtggatgccttaatgttgagatttctgtgagacatctaagtggatactttcatctaggcaactaaatgtaaataataaaatctctttatagatttcagagttcaggagagatgtctgggctaaagatacaactgtaagagtcatcagtttatagatgtaatgtaagccacgggtctgaataaggacacctaggaagtaaaaatgatagagaatagaacacaaagaactgagcctttgggtaatacaatgttagacttgggaaagataggggaggggcatccaaaaggagagaatgagaaggaatggcctgcaagatggaaaaaccaagagataatgggggtattggaagaaaattaattcaatatgaaggaatttatcagttaagtcaaatgctgatgataggtcatataaaatgagggctgagaattgacaaattcggcaatgggaaagtcactgatgactgtagttagatcacttttagtagggtggaaaagagaaaaatttcctgttaaagagagaatagaggtgaagatggtgattacaagatcttttgggaggttttgctataaagtgagctgaaaaattggacagtaactgggggtaatgtagggtaaacagaattttaaaaattcaaatgaggacttattgtgacatgtttgcatgctgatgaggataatcgacagagaggggaaaattgatgatgtgcgtgagagcaggggtagtgaagcctttgagtagacaagaggggccacatagtttaaatgtgggaaatttcattcattcattccaaaaagttaagcaaacatctaccatgtgccaaatacacagctaagtactaggaacacagaaatgaataaaacatggttcccattatcaaagaagtcatttctttgggagggagaataagcattttctctaattaataattcacgttcaatgcagtgatggtaatgtcagagaaatgtacccagggctcttttctgggatcttttcattacagcatgctgaatcttgggctgccatgtcattagaagcctagattcaagaccttcatttccatcatgcattgacatgttctgggctgtactactgatgagactgatttaggcaagagttctgggcatgaattggtgctgtggctgcacagataaagtcgaggtgatagatttgagaactgtgtgctaggtaaatcagcaatcctggtgattggttgacttgaagtaaggtaaagaagagggaggctcaaggataactcctaggtttcccatatttagttttatcctggaagcgaggatgctgataaacagattcctaacaggtagcgtgggtggataagaagaagaatctgggcccttttcttaaaaaaaattaaggtctgataaatacctgatactttcaaaaatatttgaaagcagccagatatttctgtctataaaaagaaaaaaaaaatagacctgatctctataggatgtcacaaacgctcaaaaaataaaagataggaaagactaataatacaatgctagaacactttttgatactacctaagagacttaagaaaaaaaacaccaaacccccaaaacacagagttcttggtatgatgtatttgtttttccatagaatggtttgagaaattcagtgaaaattaattggaacatgtggttgtcattcacatggttccagactttatgggcttaataaaaacattatgaatagtttttggagttttgggagaagcgaacatggctggtctaggtatctgcttttaggttaatccctctacgcaggaagtttcacagtgtcatacagtgcttttcaatttttcccactcaaatgctcccactatcagagggatgagaatgagcttccctggatggcagaggaagaaagggggtagggtagtctgagggtgtaacttgaagtttcaagttgcaaacataaagtttcctttaagtctagtatttcaatttaacagtttagcaaattttctgtgcaattccgtaaaatattcatttctttcatatagaaataatagagtctccccctccccccaccttaccctgctctgaatcactgagtaaaacctatgcatggcgaagatatgtcatgttttatctcatgactttgattgcatccttgtatcctgtcacaaagcaggggaaggggaaagacacagaaccaagtttcaggaggcctggactcttctacgccagttcgacatttattttttaattttctttgcactctacttatttccaagaggagttttggagttgctgtaagacttttagaaaatataaatgatctgtgccttgatttccttatttctaaaaacaaagaagttactctacatgatctctatattcccttcttatcgattaagagtctacccacttttggtccaagcaaaatgttaacagggctagtggatggtggtaccaaatgtatactggtaaccgatcaattaacattttggaaaaaatggaatattcagctaagatttgagtcatgatggaaaccttgaatttaaaaaaaactaaccttgggagattattagaacttagaatccacatatttgacatgtgctgtaaaaagaggttatttcttgagaagtagaattgcaactttctgctgaaaaaatatcaatcctccaaggcatcctcagtaagcccacaggcaaactcccacctcagcagactgaataatttgcctataaaatatcacgttgaatttgggaggctgaatatggtgggaaaagtttcatgtaggagaggacctgccctggagatgctcgctgaggtggcaaaggcaactggactctcaaagtagtcctccgtttaacaacatccctttctcaggtacttctctcatctgcccgattacttttttttttaaagcctgacaggaatgatgcttccagattctgagatggtaacaatgatctaaatagactgtcatcatttatcagcattcacaaagagaaaacagctatgaatttccagtgggaaaaaaaactttagaatcaaaaaagcaaaaggtacataatgctgtatccagtgaaaacttataaaagtgtaatgttcgctttaaacacaatacaccaccctgagagggttgccttcagtaaggaattgttttcctctgggaaggaaatcactggcaataccaaatctataaggagtgccttagaaacttggctgcaccaagggccgtgtagttttgggaaaactcagcctgttttctttgtctctagacattttttagacttgataatccctcacatgggtgttggggtgtcttcaaggtctccaactctgtgctgtacttcgatcagcaaatgcttggggagaatttctgttttgattgcatctgccatttgcctccacaaattagacttttttaaataaaatgtaatccttttttgctgagacaaggatgaacacaatttattttgaaaagatacataaaatgtattataaaagacacaatgtgcaaaccagaaattgaaaactaaaaacgaacatcacctacacagaaaattctaagttcttaaaccagttggttgaacgaccttgggcaagttgtttaacttctttgaatcaatttcttctttatctgtaaaataaatacttataatcgtttcaagaaagtttattgactagaatccctggagccattcaaacagattcatattagccctcagcgtggctaatggcttcatctcaattctaagtgcggcacatactttcttgaaagtattgttaagtatttattttatagatgaaaactggttaaaaactacacagtagctgcatactgtaatggattctgaaaaggcctagttcaaactctgaccttctataaataacattgtggcctgccatatgaaaagacagtattgctagtgtcctgttgctgcatgggtgatgaaattaggacacggaccatgaatgagttgcctgattctgaatcagactatcaggcagtacagaaggatgccttcctctaagagttcattatttcctattagaatgctgtgtgtgctgcacatagaattgaggtggagcccttagccacactgatggctaatttgaacctgtttgaatggctccagggattccagccaataaacagaaacttgtctgttcatctgtacattcctctcaaattggttgaaataaatcctcaacacttgatgtttctgacctggttcacagatactcaggagcagcctgtggtatagcattatgagaaattttccagtctgttgagtagaagtaatccaatcctgtcactgtttgtggtagaaaggagagagaatatagagatgagatccaagaaaacaagaaaagttctgaggcctagaagaagtggaattctgtggcaaaaagtctggagaaactgaatttgagtttatggaaaaagccaaaagacagaacatcctggagaatagagccactctttgactggaagcttggaggatgattgtgagtagaatggcctatgtctaattctacatgcaggaggatggagcaggtggggccgtttcagggccaggaaagggtctcccttctactggactgggatgaaacaagagccaaggaacaaattgagttgcagtagcagatagaggaggtccagtctgagggtaaagcatggtgtccaagtagcattcagcaatggcagagcataaagtagatagttccaactggtagcccaagataaagaagcattcaaatgtatgcctgtggatggtgttcccttcccacaaggcacagaggattctgggtcaggcatcactcagagttccagagggaagggtatacatctgtcaatgcatagcaggtctcagttattcagcccaaagcaaaccattggctaaaacctttgataaaaagaaatgtgacatgtagcatggagggtggggcaagactgaggctcaggaatgggacagggcctgtcagaattaccagaagtgaggcagcaccacaagactagatcagcagcaagagttatttgaggtgcagtcacaaaaggtgagttagaatttaaatacatgccactttgggtctgatttggtcttaagtgtgtaggccaaggctcagtcttgaggtagagcatgatctcatttgtggtaagttgagagtatgctgaaattcagcatgaaaatggagatcagagatcctccaccttgctgtcagtctagacagagactgaaaaactgggttaaaactttaaagtctttatatcttggatatggagataaacaaggtaatactgcctggataaataggggaagaagctatcaaaatggtattgatctttccatttaagactatctattaccattcatctcttcaacatttgaaaagatgttcagtataacattgggattttaagtgatgattgtatcaaaaaatgataagtttaaaacattttaaacttatcagtgcacaagaacgggatgaatgcttatccagtatttctttctgtatttattatttgagtaaatcatgagtaataggttggtcccttatttaaaattttagttatggtcaattttaagaggaacacaataatctttttttttgtcttctgtacagttatatcaattttagcagtttggtgtctagttttaccaatgctattttatgatctttgccatttgccatggtacaatgtgtttaaatggcacatcaaggtatactgatggttgccatttgcttaataacttaaaagtaatccagcaatttcttccacttttatttcttaacatatgattttgttttgtgaaacatgaaagatgagtcttatatttaggaaccatttggttgggaagctgggagagtaaaatttaattgattttttttcttctgcagctcttgaagaaatagcatgtgaatccagattaggtggcatcatgtatatttttgtaaaaggaatttttacttgcttaggctgaattcatccttataagcctccctcagccatccttaattcctccctttctctcactcctgaagtcaaggattactatgttttattcctttttctgctgcaatatcccggactcttctctgtccatcactatagccacatcagctaataagctcctcttcctgtgtccttcttccctctctactcatcctctatagtgccatcaaagtcagagtattaataaacaaatcctgacatgtcagtgtgcttactccccacattttgaacggattaagttcaaatgcctcacaggatggcatttgaggtgctgatcctaatttatctttctaaccttgtttcttgcctctttcttccattcctcacatgcaaacactgaactccagtaacaccactttgtcttctcaacatactctgcactattgtgtcttcatgccccttggtacatgctatttcctctgcccagatattcttcctgggcttctgtacctgttgaccccttcaactcatcctttaaggactggttcaaagaccacttctgtgacatcatccctgattcccacagagttaaacaagacttctatgacacgccacagcatctgaaatacatctgtgctggaaacttctactatattgccttgtaatgatttgttagtgaacctctctcttccacttggtctgtagctccagaaaaccagtggctgtttgttgcctactcgtctttgctttattcttccttctgcctgtccacctgctctcccaacatccaggggccaggacagtccctggcacacaatgaacacccaacaaacacttggtttaagcaatgaattattatcttgcacgagatttcatgagtctctttagttttgctttcttaacttacttaatgcttattaagatgacttttcactttcagttcttcctgtttgattccagttcttagtcatgtcttccccttggcacaaaactgattgagcaatatatgctgaagcctcactcttcaaatttcatgacaaagtctgagggtcccaggactttggccaagcacaaatagtaagtgtctgggaggcatcaactaaattatctgccagtgaaaatgctctgtcttctttgtctcagttgtttatgcagaacaaccaaccgttcctgtaaagttatttttcctaatttttagcctaaacttttcaatagatacaggccatttctccctgtctcctcctatctcctcatcttctgagactgtaaattatcctgtaacttcatttataatgggaacatatttattttctgtgatgatggctcccctgagcctttctttttcttagctacataaagttaacttcctctgtggcaaattaaggacagattacaagcagcctgggaaccgggctccgtcaccacagggggccgcctactcagcctccttctgttcagccatgggaaagatgcagctgctaagccagccgggtgctgggctgctctccccctgcctctcctgatccctcggagggagttgagaagtccctttctccatcagtctctggttggtgtctgatgctctgttttctagcctctcttcttctgctcctcccctcccccagctgcctaccaactccttcccacccccaggccagcagtgactgcctccaagactccccctccttccagcaccgcctcatggtttccatggcaacagaaaatgttggtgggaagcaaaaatgctgaactgcaactcgtgttggggctgggaggaggaggtgaaatgtgggcctctctggaggctgtagaaaggtggggagaaagaagccaggtgagaagccctgagaagaaaggaccacgaggctcgaaaggaaggtgcattggcaagcggggatcactttgatcagaaaaatcagctaggaggaagaaataggaaagagttataaaaagtaatagagaatcctgggccgggtgaagtggctcacacctgtaatcccagaactttgggaggctgagatgagaggactgcttgagcccaggagtttgagaccggcttagacaacatagcgagaccttgtccccgccttcaaaaaaaaaaaaaagtaatgaagaatcctatatatagtggttgattgagggattacgttaggtataaaactgggaataggtgactttatattgaaggtgagtagtgaaagtcaacaaacatagtggccaaaaaaaggggggcttgagagtttaacaataatatacatacatgaaaaacaaaagtaatattaacagatctgggcttgtaaattaactattgtccttacttatcagccaagtgttacttatcttctctgagccttagtcttctttttgcttgtctattaatatagtgttatcaatatccacctcaaaaagttgttgtgaggatcaagtttaaataaagcacataaagtggccactcatatagcaggtaaggtaggaatttttcttttaaccattgtatgaggttgaggaatggtacttcaaatgggtcttggagctggaaacttaaaattcattgaaaactgtgccttgtcatatatttgatttttgtatttatttcaattttccatatctcttaagtatatggcaacatggtttttttttttcttttttttctttttctttctttctttttttttttttgagacagagtattgctctgtcgcccaggctggagtacagtggtgcgatctcggctcactgcaacctctgcctcccaggttcaagcaattcttccgcctcagcctcccaagtagctgggattacaggaacatgccaccacgcccagctatttttttgtatttttagtagagacagggtttcaccatgttggtcaggctggtctcaaactcctgacctcaggtgatccacctgcctcggcctcccaaagtgctgggattacaggcgtgagccaccatgcccagccagcatcatgtgactacgtccctaagtacatagtaccatggcaatatttagtgttaaccccttcataaaaaataagaagaaccatcctttccttttaaataacctccctgtctgtgcttttcaagaagcctgtggtgttgactcattctctctcctttacagccacaatattgttggcatcataacttctcatttcttttctctctcttcagtgaaaggggttgctgcagaaattatgttctaaacccacaatcatgtttataatggtccacgaatattttttgactgaatgtctgtgtcatcacttccttcagaagtccaaggcaagaaaagctaagaagttgtggcccaactagagatgcccataagcctatttactccgggctgtctctttgcaatcttagaagatgtcaagttactgcagaggctctacttcatgcctccttttcctgaaattgggacaataatagcaacgatgataactagcgcctgaacttgttgttccaaagtgcctgacatgaatggaatcatataaacttcaactcaacccaatggaattagcatgttgttaccgtgacggtttccacatgtggaaactgaagcacagagacattaagtaattttcttaaggtaatatacctcgtaagtttcagggctggaatttgaatctaggcagaatctacctccttaatcatctccactgtgctaccctctagggaagaaatatctggaactgtggcttgatgatattactactgctttttatagacaacgatttttttcctcacttggtatcatctaatgaataaagaaggaacgtgttactgtacttctatttcaagatgtgtactgagcccattggtttatcttttttctcctcttagatcccagtaaaaaaagctaaaaaaagaattcatgatctaacaataatgaggataattggagaaaagctatatggatctgggagatttcaataaatttccagaagtcagaaagagcgtggaaagatgatgcagtggggcagaggtagctttgggctagtgtgtttgcagagggtcctgaatcaaaaaaagagcccaagttgcccatcagaacctcggaagtttcagtctgagagaatggagatgggatggaggaggagatagagaagtgagtagaaaatgaggatgaatttaaaggtctgtgtattgaacagctgcccacctgcctgtaacacacatatccccaccccaatctctctttctctctctgtttctctctgtctctatccctttctgtctctctctctctctctcacacacacacacacacacacacacacacacacacacacacacacacacacacaccaggcatttaccctccattctcaggtcaaaaaggaagtaaggctaactctctaaagacattttaaaaagcctttctggggagagctggagcaactagtacagtggtgtttgggacaccctgatcattatagggacattctgctcaccacaacacaaaacctggaaattaaaaaaaaatgcacacagaatttccagtttgcttttccattgcctcttcctgaaatatgaacagaaaatcacaaactacagtcattagaggatagcttttagcacgagcgacaaagatcaaatgggaaataatgcacagcagaaaaactaactcaaaagacaattccaataatctcaatataaaaataactaacctctaactggtgtttctaacaggttcaaaacaatacatcagaggaaaaagaaaagggtgccaaaaaaggaatagagaaaaagagccttgagaaattgaaaatattattgccaaaattttaaaaatctatttaaacattgaaagcaatctcctagagtgtaagatgaaaatacaaagagttggtaaatgtgagcacaaggataaaagacatggaggaatgatggaagaaatccaacacctgcctaggaagatttcacaaaaaaggcaattgaaacgaagagatagatagaaatgatcaaagaaataatagaagggaatttcccaaaatgtacctttatatttaaagtgcctaccaagtgtggaacaggatgaaaaagacacccactcagtcacatcttagtgacacatcaggacactgaggataaagagaagatcctgaaacttccagagagggagaaaggtcaccgataaaagaaacaacgtcagactcctcatcaaacacatcaaacactgtaagacaagagagcattgtcttccatactcagaaaaattacatccggccttgaatgacatactaagccacgctattaatcaaccacaggggcagaatatgggcatttttagattcacaaagggttagaaattaatctttcatgtatttctcagctgtttcttttataaacagttatttgaatgtgtgctctggcaatatgaaaaatgacacagggaggaaagcatccaagaaacagtggattcaatggaggactgcaatgaagagagtcccaaaatgatgaatgtgtggcagtctcagagaacaggtccagcttcggacaggaagactaaggattaatgtgtggcagtctcagagaacagcccagcttcggacaggaagactaaggagatgggtcccaggaaaaatgtagatcagaaaaacagatagtatgatggagactatgaaaatcttaaggataaagtaaagataggaaatgcaagatgaaggaaaagtaatcagagatgacaggaaagattaaacagggttaaagattaaacaagattaaaaaaggtaagttctaggataactctaatgttcccagtaactgtgcaaatgggtgtaaccatcattatcatgggtgccctgcctctcaggacccaggtatggggttttcattcttgatacggcttcccacaccccacgagttggcatagaagcagagaaatactttcaggtcccaatgcaagcttggatgctgaggacttcagcagggaccaccatacagtacagatttccctgtgtgcctggcagcactaaggtctctagtattatggggtgacaacaggagaagccaatccagatggcaatggaatttcatgctggctttgccatggagtaaaaactaagttgacttgaaacacacacacaaaaaaattatattttgtcgcacttgaatttgtgggctaagattcagtttgcaactgtagtgtgggtagaggaattaggagagagaagagatgatagtattgacaatgtaaatcctcatctctcacatcagaatgtcagtaaataatatctaaagttgataaagccaaaattaagggcatttgcatgttatatggagataaccaccagaaggactaagcacagaaatattgaaagtatttgcttttggagagtggggctgggaacagggagaagaatgcaggaaatggtttgtattaaagttttatttgtatatttgtttgaatgcttgaaaattatatatgtattatttcattttttttaaagtgtgctcctttctgtcaattttactctccttgctacagtgtagttaagttgtccttggcatcattgttcctgtgtctatgtagaccacctgttttggaagaaggtgaggttatcaatcaaacggctaaccagtcacaggcatctactcattcacttgctaagctccttcctcattctcgtttccaagagtgctttcaaggacacaagagaagaccctatttagtgctgtcattgtcttggttgtgcggtaacaggaagcagagaagccttaatttttagcatctagacttcagctccaaatactgccattgaaatgggaagctctgattacagcttctaaagtgcactgttttctctgtgctacagaactgtcttctgaattagtatcaataaaacgctttctaacaggatctttgacaccagaagtcaccactgatgccaatgtaattaccatccctggacgctaggccttgtcaggcagcacagataatcacctacaaccaggggccaacgattacccagtcagtcaacgacattgactgctcactgggaggttctgcacgagtaagagagaggagaactgcaatgtcctttcctcaaagtacttcaaactaaacagggctgagggtgtggaggggaaggaaagcagagattcacacacatcaaaagacagaaataaacaaacctatccattctcagttacacagagagggctgtggagatctgagttggcgcagaataaaaatggacttttgcatcgcctggcccctgtttggtaaaaacctccttggttttatgtatttcctcttttcattttttttaaatggtgttatgtatttcctcttttcatttcttcccctgcccactaactgggctcaactactgaataacccctgtgtgccatgctttttctgtgcttccatactaattatatgctgttccgcttgcctgaaagctgttcctatcactcagccctttcagcttgcaaatttttctaatctatcaagaggtaaacctgacctcttctgtggagccttgcctgattcactccattttaattccaatcagttacagtgctgtgagctttgtgagaggagggacagagtatattatcatttgaaaataattaaaattgttaatagatgtaaaacacttagaatagtggtgcctgaaatgtaagcaaatgtgtttattattattattattagcatcattactatgatcaatgtttgtatttagaagccctagcataacatctggcatatgaaagtggaaactaagcaaatgtttctttgtttgaattcttggaacatttcagacaaactgagttttattgatgagaaggttgatgggttttcttggcagtggtcattattccaaggtgaaagtgaggattattgctttagctattgcaactgagaacacagaatatcttttaagaagcagaagctctaataggtgaataaatcattttggaggataggaggatattccagatgatatgaaactattgaaaacagatttgctgttggttttcagaaaatgtactagccctcaggaagatgggcttgtttggagagatacctaatgtaacacaaataacttcattttcttcagcattatctggaatagatggttaattagtctcagacagctgtttccatactcacccgcctttgctgtctgtgtgatgtgcacgtgtgtgctgtcatctgggtgagcctatctgggcacagtgacgggtcattaagctgtcttctcatatggtgcatgtatagtgtctgaagcacagtttcaggagacaggtaacacttccactcagagaggcattacatgacccctagggttgtcaatagatccgtagctcttttgctcttcaaacactacatgcattttgacatctcaccatctttgttcattgttccattcactgttatgtccttcaccccgttctttactgcttacataaatacactcaagcccacttcctccagagatttcaccatcactccagctcatagatatctcttccatctccatcatattcagcttgctttcttctttctttgtctctccctttctccctttctctctttctttttctttctctctcttttttctttttctctctgtctccctccctccctccctcaacctctctctctctatttttctgaaacagagtttcactcagtttcccaggctagaatgcagtggtgtgctcagagttcactgaagccttgaactcttgagcttaagcaatccttgcgcctcagcctctcaagctgctgggactataggccaccatgcccagctaatcaatctttctttctttctttctttttctctttgtttttctttccttccttccttctctttctttccttccttccttctctctttctttcttcttcctctctttcctttcctttcttccttctttcttctctttctctctctctccttctccccttctctcctttctctctttccctaccttccctccctccctccctccctccctccctccctccctcctttctttctttctttctttctttctttctttctttctttctttctttctttctttctttttctttctttctttctttcaagataggagtctcactgtgttgctcagactggtcttcaactcctggtctcaggcaatgctcctgattcagccttccaaactggctgggattacaggtgcaagccactgtgcgcagccagtcatagatttctaacactaatttctccaatagttacattttatattgtgaaaacacttacattgttggcttttattaacatttgaatgtgatttgctatttgctgttaagtatgctagtcttagctccctgagtagactgttggatctttaagcagatgctgtactatggctctttgtagtttctaccacatttagcacagttagatgagtatataggtacttaataggtgttcccttaggaatgaatggataaccctcctgggatccattcaaaaggattctcctgagaactccttaacaaaggcttatctactttctagtttagactgtcaacacatgctaaaggataaaagatgcagatttgaaacacatagatttacattttaaaatgctgtggcatatttgttaatatacttcacagtctgaatgcaagtttaggttagttacccttgaggacaaagctactagactctcgaggattcaaatagtctcataaaaatcatcacaatgttatcattggtagttaagggaacattttataataagtgggtgtctttgagcatgtttcctagggaaagtgctaagtgcaatctagtccatggaagtcccacagtactctgcgaacaacctgcactacttcatggccacttcacctgaatggctcagttctttgagtgtccatgtagtcaactaatcagtctgtggtgagtaagagtaaattaaggtgactaactttccaaagtcctttaaagttatttgatttaaggtcgctgagctaggtggtttatggatatttcagtattcctggaataattcatgtaagctttttccttgtatccaatatattatgagggtaagagcaatgaagccctgtgccaatttctccatttcactggctaatcagtaattctaacattgtttgccagctaaatggaacaggcactcttgtcaccatcatgattcattgcctactgaaagcacagagctggccttaatctaattcttaataaaaccttgcgaactaggtatactgtctcaatttgcacacggaaaacagatgttcacgaaggttgagggactggcccacgatctcacaccaagtaggtaaagaaccatggaagcaattctgtgccttaaagtgcaattgtctttctaattcctgtggagcatgattgtcttttccatgctgaatctaatgattacaaatatcaaatgagccctaagcatggccctgtaatcctactccattctcctagtaaactctccttcccactctctgaaacaactttttaatatcttctctatccttatatcttctacatccttacagcattattcactagaaaacagaaaccatcagaagaaacatatttccatattctcaatgcctcatataccagtcatgatggtacccactctctctgtcttccctcctgttatcacaggaatgtccccattagcaaccaactctccacttggctctggatcccaacctctctcatctttattctttccatccttctttcttttccaatatcaatacctctttttctacctaatcattcctttcagtagccaaacatgactccagtctctcctgttttaaaaaattcttccctttgccccacaagtcaccctttagctattagtgtatttccgtactcccattatcagaaaaacttcttttgacagttgtctactacttcttctatccaatgcaacatggcttccgtggctctcatttcacagaatgtgctcttgttaagttctccaggagcctctgtgttgccaaattcagtggctacttctctagtctcatttctttttttttttttcaccttcaacttttattttaagttcctagggtatatgtataggatgtgcaggtttgttacataggtaaatgtatgtcttggtggtttgctgcacagatcaaccaatcacccaggtattaagcccagcataccttaactattcttcctgatgctctccctcccccaacccccacccctgataggccccagtgtgtgttgttccccaccatgtgtccatgtgttctcatcattcagctcccatttataaatgagaacgggcagtgtttggttttctgttcctgtgttagtttgctgaggataatggcttccagctcaatccacatccctgcggagaacatgttatcataccttttcatggctgcatagtattctatggagtatatgtactacattttctttttccagtctatcattgataggcatttcggttgattctcatttgatctctcatcagcattctacctaactgataactttcccatggagcaagtttttcccatggagcaagctttcccatggagcaagcttttggtagcattctacctgataactttcccatggagcaagctttctaaacactttgagtttgaggggtcagtagaatatataggaggtagaaaactttgcttctgttgagtatcggtgaagtaacctaaggtgaaagtgcagagtgagaagagaagagactcaagggctaagcctgagggtacaggcggaagcagggagggctacaaggaagactgagaaggtaggaggagataacagagacaaggttagaagtcaaggacaaaaagagttgtcataaaaaaaaaaaagtggtcagaatcaaaggccagagaaagatcgggtaaacagggactagtaaaagtatattgtctttggcaattgagagtttattggttgccatttataaataatttcaggatgatgacagaggctgatggtattaaggcctgattgtatttttctgaagagcaaaccagcaagtgtaggcattattttgggaggcttggttatgaagggaagaagagtaagtggatagtgtctagagcagaataagaattgaggaaggttttgaaaaaaaatcaggttatatctgagtttgctcagagagggtagagaagaaggcttccctaatatcacagcattatgcaagaactaaaaatagaatctatttcttctgcctccaagataattgagataatacatgtgtaagagtttaaaaaactataaagtacaataagaatttgatatagtgttcttctttccactatattacaattaattaccaggaagtcaatggattgcatttttaactatataacacaccctttaccccactccctgcaacaagaacctcactgctatttattcagcagttcttaaatgattgatttgttgtggatgatcttttgcttgcttccttttgaaacagtgagggatttctggatgtttgccagcctgaatattcctgtttacttgtcttaggctaacagataactggatgggccatattgttatacaggcctgatgaatgccaaatgttcagctctatctctacaggattacacctttctgaaaaaagaatgtataatataacttctgtcaaataaacttgagatacatttgtttctagtcctcagatttcaagatctcccttaagactttggaaggacaagcctaattctctttgccaggcatgaaaccagacattagcttataaactcaagatgttccataattctttcaatatgaattctaattatctttgctccttctaagagaaggtaaaagtataacaatgtgaaatctaattctatggactcaaggggcagaaatcagtgacctgatattcagaggcctatattaattatccattttatttttctcacctctgtaatttgtaagtagagttgcaagggctcttgttcttcagttactattttagatcatacactctcaaatgaatggatagttctcaatgcctgcgatgcgcttgattcacacagactagcctaggttgtctgaaatgaagtcagggagacgcatgcaatgacctgtaaggtgttgtttctgtgtctttgtagcctgagttttcttgtggataaaaatctatagccttttattatgacagctcattacaccacagaaaaaactaaactgaaagatagatcatgtcttccatgatcactgctactgtttgatgtggtgtctcctgcatgaatgaaatgactgccactcagaaggtctcatggtctgagaacaaacttgacctggaaattcatctgtatttttacaaccctgtgtatggtgagaaagtttccttagtctagactgcttaatatctgtataaggccatttttttcttctctctcacctctcttgttgatactcctctgaatcatcatccacccaagatcaaggaatgctcacgctacttttgtttgtccagggctcagatctttctcagctcactcagatatgttgccccagtatctcttattgaaaacttttccctatggactcagattgacctcagtttaaatcttcagtgctttggaccatatatttagtctttctataactaagttttgcccttgtaaaactggaataatactacatactgtgtaacatttgtgagggggtaaagataatgtatgtgataatcatataacaagttcttgataaacaatagttatattattaaattggctatattttttttctttctataaaacattacttgcctaatcatcaatttccttggagtgcttctatcaggtagttatcaagtgtaaggatggaacccaaataaatatttcttgtaagtgtgatttatttaggtactggaagaggctgcaaaataaaatggaaagagtgtagggctagaaaggtgacaagttcctggttctggtgttgccagttctcatattaaatagcagtgttatctgtatatgattacccatctatgaaaaactctaagttattagaaagattgaattcatcattgatgaaagagatccttcaggcatctggaatcttatgtaaacctcacgtagactgagtttaattcaattaaataactatttattgaatgatcattatggactgtgcttggcaatgtgggggataataaacaaaggctacacatatacacacatttattgagaactgttatgagttgaattgtgtcaccccaaatttatatgttggagttctaacccctagtagatatgtggatatagatacacatcctagtagatatagtaggatgtggccttatttggagatagggtctttacagacataatcaagttaaaatgaggtcattagggtgggccctaatcaaatatgactggtgcatattcgacatgcacagaggaagagatttgaaacacaaggagaaggtgaccaaggagataggtccagaatggctccttcccttatagccctcagaggaaccaaccctgctggcactttggtctcagacttctggcctccagaactgtgagacaataaatttctcttgtttcagccacctagtttgtggttctttgttgtggcagccatagcaaactgatatgaagacctactatgtgctagtaactgggaaactaacactgaacagggcactgttatttgtttcaggggaagaagtttggaaaagaagcagatacttcagtcccatgtaataaacctgctccaagagaagtatgtacaaggtgtcatgggaggacagtgaaggacagttgagtattaccaaaggcttgtttaaggctcctcagcagggacttctaagccaggcctttgaagtaagagtgcaagaatgagtgcaagaagcaagagttctgggcagaaaacagtgtttatatgaggcagtgtatgcaaaggcacagatatctgagcaggtgtggcactgttgtagaactgtaagtaatccaacatggccagagcttaagagcagtgaaagataaggctggagaggtgagcaagttccaggtcagtagcggaaggctccctggagcaaggggagcacctagaaccttgaggtaggtcttccttgattagcaatcgcgaggacataggctatgttaggtaggagggaaactgtaaacaaaagtgaatgcgtatatttatttggcagtgagcattctggtctggttaaagcagacatcctcttgacaagcagagcaagcaagtgagaagctaagaggtaagataaagtctctcaaaggaccagaagtatgacaaacggagtgctttgagggcagggctagtatcttgtttagtgcttgcagtatagcagtggctcaagaaacaatcactgaataagtgaagggagaagtggtgaaattctgtccttttactgaattaagcagggacttttaggttacagaggtttggttttgaaatctaggctctgctggcaatttttttaaccttgttgagtttcatcctctttatttctaattgtgagtatactaatattgaccgtattggtgagaattatatgggataatttatatggaactatatagaattatgggtatactaatacttagcatgggataatttatatggaattttatagaatatatggaactatatagaattatatgaaactatatagaattatgggtatactaatgcttacagtatatggtgagaattatatgggataatttacatggaaatatatagaacttaaaaattccatttgatcaatatttattaagaagctactatatgccaagccctgtggtaggctttaggactagaaagatgaacaagacccaatctctgcctctaaggaatttactttctgttagggggatggggaagcagacatctgaatagataaaagaactgtgatgcaatagaataaggactagcttagggctaagaacagagcaccgtgggtgcacagaggagggacagttacgccagccagacggcaggatagtgttggggaatacttcctgggggaagtgatgcttaagctgattcatgaacaatgatacgcaattaggtgaagaaggaagaaaaaggaattccaaacagagggaacaacaggcttcctttgcagctgtgtttttctagttcctgtgcctgtgcaattccttgctgaaaatatactctagtcggcttggttaaagcaaaaacaccctctctagctctcgtcagactcctgaaggttggatcgtgctctgaacagcctcagctattggctggcttctctttaaactaaacaggccttcagaaacccttcatgtagccacctgcctgatctcctcactccctttctcctgctttctttcttttcttcctgtccttcctcggtatctgctttcttcctcctctcattaaacatttcctatgtctacatgtgtaaactatgggctgtgcctggagatacaggggataaaagcatacatctaactcatgaggagctcgaaactgaaagtagggtcagcgagctatggcccattgaccagatccgcctgtttttgtaaataaagttttattggaacatgcccacgcccatttatctatgtactggctatggctgctttcatgctacaatagctgtgttgtgtagttgcaatagagaccatgtggcttgcaaagcctaaaatatttaccatctggccctttacagaaaaagtttgctggcccctgttctagtgtttatatatggcagaagtggtggggatagatggacaagtaaagaggtaatgtacccctgtaagataagtttttcaaaagggtactatagaaggagagttcctaacccatacttggagattgagaaaagaactgagagctaaaaaaagtgacaagtacgcttagagctaaaggataaaaaggagttaagagggaaaggaagatcattcttggcagagacagtagcatgtgcaaagccaggcaatgaaagaaaaacatgcagttctctattgcaaaaagaggaagcggtgaaagataaggcaggaaaatcagtttgggccaggtcattaaggatcctaaatatgaaaaccatattaaggattttagaaatgccctataatctctcccataggtaactgagaacctttgaaggattttaagcagagtagtgctaaagcaaatgtgtgctctagaaagatcactctggctgtaggatagttaacatttactgggcatttattctatgccaggtctgtgctaaacgctctttgcatttggaaatatctattgagtagctggacagcactgggaaccaggtagaaagaggtgaaacatggagaacagatatggatctatgagaaccagggatctccctaagggatgaaaaggtgtagagcaccacccttatttggaggcatgaggagaagtagaagaacaggggtgattgcaaaggggagtatactgtcatggaacacaaacggggagtaaataacaaggaggagtggatagtgaaaatcagatattgtaaagagagctaagagaagaaaagtggaagaacaagcagggggcagggaactggtaagaagcagatcagagctgacttaaaagagagcaatttcagcagaaaagttgagaaacaagctggattatagggttaaggaagtggttggaagtgagaaaatggaggtcactgccactgaacacttgtttgagagatttgtctttttaaagaagagtagaaatatgactgtggctggatttcttaaaattaggctgtaattcagcagctttggtaacttttctgattcatgaggtaaatttctcatctcaaatatctggtcatttgaagtaatactggagatcaaattacgcaaatatgctgcatgactaaattaaaggcctattcatgtgagcattagttagtaatgggagttgtattatatactgcattattagaaaatggggcagcatattttaatgcttaaaaatttaatcagagcaacttccagaaggaggaaaaggctcctttttaacacaagatttgaatcatggcaatttttttttttttctgaaagccattcttctaagatggtcatccctgcacatgccctcatttctgactttctgctgcacaagcaatcagtattcgtgcaaggctaatgggatatacaagaacaattagtagctctgccagcgccaatattgtacttgcctctttaaagagctcaaaatattaaataacaattggaaagaacatttcttctagactactcattagattgattttacagatgagtaaactgaatcatagagaaacaagatagtggaaatgagaagtcttactttggttctatctcacaccactgtaaggctgtgcctattatatctgtaattaagctgttgtccagataaacaataattcctgcttggctttgacttttagataccaacagatatttaaatgccggcagttgaaaaggttatttttttttctttcaaaagtgggtttgtaactattggcttaaattattttagaaaactatagctgtactttcaacataaggccacccactcaactctgagcctagactgtttgagaaataagaaggtataggaaatttggcaggtatttttctcttgtatctttaaatctcagtaagttcacaaaattttcctaaccaatattggaacaagaaattatcacggggggaggggggtgactaatctcaccttttaaggacaattaatttttctacttcacaagtttaacttcttatttggatcacaatatgctactaagatacttaaaaggtcattttttcaggccaactgcaaatgatgttttcattatagaaaagttatgtaaaagtggaaaagagatgtaagtccattaacgtgtaaaatgcaccatagcaatgggaaaaaagttttaatgaaatacgtatgagctctatcatgcgcaaatgttttgttgaaatggatgactccaagagctctgtggttccacttcagtgtctaataggcactactcactttaaccttcagcaagccctttatgaatgctatccacccaagtgtatgaaaatgccaattcatgtagggctatcagtattattgttatttcttattctgtaaaggctgcattttgaacattttaataagggtcaaagcattccaagtcaatctagatggcaattgttagaaatgcaggaggtgctttaaaaaatgagttggtaataatttcattcttctcccattttgattagtttataaatataactgtcagctagttatcatggtgaggttattggtcagtcctcctccaagtaatataaactccttaatacagtcttcagactatgaatctaccataacattgccagtgttttgatatcatcagtatcttcatcttcctttatttcaagctatgatagattttacctcttctattatctactgtaatttgctgctgacacaccaattgctagtaaatacatatgttgagcgatggtgattatgtgaagaatgaggggcaagatccctgtggtgtagtgtgtgtgcacccatgtgtgcatgaagaaacgtgtgtatgtgtgatgtgcatgcaaataatataggtctgagggaaatactgtactccccttgaaggtaagggtcatgtcttattcactgttacatccctagtacttaacactgtctctggcacagaaatgatatctaaggagtgcttgctgcatgaatgagtgaagggtactaatggtccatgttcccattggcaaaataaggcttccagtttaaaaatgagactggaggtccacctacaacaatctgttgtgctttcagtttttacaggctgatttctacgcacacagcattatgctgggacttgtgaggaaagcaaggaaactgaatacacagaacttggacttgagaagctttcagtctaattggggagacaagatacatacaagtgaaaacttaactcctaattctagagagagaatcatggcatgccaaatgtatttttttcatgtcaaatgtaaccactgcgtgagttcaggagaaaagagcctgttctgtactgcagccattaaagaaagctacctaaactaggcaagaattgagttatacctttgaggataaaagacagcagggaaggaaaggaaatgtctgtccaggaggagcgggtagagaatacagatgagcaaagttattaagataagaatagattctttgggacttaaaatttaggaagcagtcattagactttgaaaaataaatatgatggtagagacaaatataacaaggaaataaataagcatgcacattttgtatagtaatcacttcatacctaaactccttggtgaaaaaaaatgtcgaaacttagacacattctctatgttgcaaactcaggggaagtgagtgaaatgtcagaaggcatggcagcattcccagaggttagtgagtatcaggtaggctttgccaagcaggagggaggtgatgatatttgacttctgaggggataaacaggtaaggtgggatctgggcagattttcagacaaaagattctgttgtgaaggggcttctggttttaacatagatgtgactctccttaagtcttaggtgacctgatgtacttctgaaactattcattgattgtacaaatttctatttattttacatttttaagggcacagaaggatctaaactatgtgcacaactattctacaaaccaaactgaaaatcaaaatgaaatacacaaaggaaaagttgtttgaaattttgtctttaagatacagggaaaaaatcacacatcagtaaaatcaaggataaatatcagcctgaaggaggagcaataattgacaaatatttaaaaacaattgggggccaggtgtggtggctcatgcctgtaatctcagcactttgggaggccaaggcaggcggatcatttaagatcaggagttctagaccagcctggtcgacatggtgaaaccctgtctctactaaaattacaaaaattagccgggtgtggtggtgcacacctgtaatcccagctacttgggaggctgaagcaggagaatcgcttgaactggaaagatggaggctgcagggggctgagatcacaccactgcattccagcctgggtaacaaagtgagactcccactcaaaaaaaaaaaaaaccaaaaacaaaaaacaactggggtctttcttttctaaccatatctagacattggtgaaaatagtccttattaaagataataatagctatggagataaatcatccaagtgttgcatttatgtgtgagagtatgtatgtagaacagatttagcaaataatttttaaagctttcaataaatactttaagtgacttatatggacactttaaatgcacattcattaatggattcttgattgaataaaaaattaactcctgaaaatatttcctaaataaagtacatctatgcatggatgcactatgatgtttcaaccaacattaattatacccttttgatttctactgtcttgttcaaaaacactaataagacatgcactacatcatagttaataggagtgtggtgcttgttgcttaggcaacaggaggaataaatgcaggtcagaatgtgcttcaagaaaaacaaaagctagaatatgatactgagtggagactaagcaagtctaacagatttttcaccacattaaagaaatatgtttcttagagcaagccaatcatattcatgtgtttaactaagtttgcaattacataaattagattatgtagatcaataaataatttttataaaggtagaaattaatcgcttatgatactagtagcaaataaatggtgtataacagcatgtaaagcactaattgattataccacttcatgatttgcttcattttcataattaattaactcctctaaatggcaattcaaagtttttttaaaagataattctgtctcatgaagaaagtatttgattggcccatctaagttaataatattttcttattttctagaaaattataccaaatactttgaattaaacaagtaaagaatataatctatgattagaccttggttacatcatgtatatccaggattttgccttccatataaattttgaagtgcttatacatgattcattcatgaataatttttacgatctctctttgaatgcttatttgaaacctgtttgattaacctttcagttcgaggctttcaaaaaggtattatatttgctcataagtgtttaacattcagaggaaaaataagctgaattaaagtctttcagcttggccaaatgatccaggaaatccaaagacctaacttctcatgggaccagaataaatttggacaagggtttcagggttgggaatgagaaacccttatttcaagtagacatagggagaaataattaagatattgaaatgtacagtaaacataaataataaaaaaagacttcaattctgtttgatagttcttctaattcttaatgccatctgtttagtgtcctaagtctgtcctaaatctgcccagtgttctaagactttcatagcaattgaagaactttcacttttttccatttcaatacccaaatatcttgtctatataaccagtgacagtacttgataaacacaagaaaaataacagtagctgcatatatcagtataaaaaaaccaacaaatcactcataaagcattctgtgcatgcaattacttagagctcatatatcttactatatttatgtcttttttatttttaaaaactcttgggcatacatacttttggagaaggagcagaagttgaataatgttaataatcttcaaatctataatattcaagtcaacctcagagaaaaataatctaagatagaaattaaaaaatctaatcagctgtcactattgtgttatcatttctggtactagtaagctgcaggtgtcagccctattactgtatttaggcagggctattacttatttccacaagtcatttgtgtgttacatgcctgtgttatgtaggtctctctaaacttagggatcagtgatatgtgtgatgggtacttaaaagcaaggaaaggtaatagagctgtgacgtagcttaacaaggggaactgatgagcactgggggaggtatgggaatgattagaaagctgaattgtcggtttgcacagttccccatcctccttcctcacctatatgcaaaacggtggaaagttagcacatgccaggtttagattgcatgtagaccagaattcagaagtacatgactatacttactccaccaacctttctttctaaatattgacagctaaatgaccaaagtgtttattttccacctaaagtaataaacaatacttcatcgctcttcaatcagcaagtggaagtaaacgctctccataattgaccatctgaagcagtttgctaatgaactgaaggttgtccacatgatttaaactgcttattgaacaattatcaggaaaagaaatgatcttcacaccataaacacaacaaattgtctcattaaccactaaatgctgatgctcaagtgaaataatataagaatcaagaattagctgaagagtgatataatccgagtattctaagattacaaatttatttaaaaaatcataccaagaatgacagggagaatatcaatattaatcttctttcactgcctataaatagcactctcaccagttcattcatataacacatatgtatatggatacatacagatctcattttttagcaagagtctatatgtacacagcaagttcagtcctaagggcatccaattttccaatgcagttacatatataaatctgaccagttttggtgcaaatcaggctgcctctgagccatgtaagacacataagaagcaaagacagacaaaaggcagctccgtggacacagagagcttcttaccataaactgcacattgtcaaatccattagccatcaggtggttctcgtactgaggtagcccaatgctttccaaccattgtcccactgtttggacagggcatctgggtcctgtaagaggatgaagagggaagcgtttaagcagggagtagccgtccacggggtaatagcggtagtcctgggctgagaggtggcattgccacatcatgcccctgggaaagttgctatcaaaggagcccgccagcttgacagattaatgttctcagcgagagagcaaagtcagaagtaaaacatagtttgccaggcaggctgtggagtatgacttgatcctagctccacatttcttacatattaatctttactaccgaccagtacgtcatacagcccccaaaaccaggcagcagaagaaggcatatcaagctgtcagcttgggctggtctgcgttctatgtgattgttggagtactccacaatgagcaatgcacggccggcagccagaattcttttttatcaagtactcctacactcatcagtatgcagctccatgctccttgctccccctcgctcgctccccttcattacccagcccaggctacacctcgcattttcaataatagccatcagataaggcagattttttttgtctgcaagctgtaagcctgctgctgctgcttcctcctacacacccatccaagcgtcaatcttgaatgatgagagcagtcaaaacaaatgcagaaaatagcaagattcaaaagcaaaccaaagtgcttaaatctgaattgaatcttcatactggttatacgttacagagctatttgttgtggaattttacgtttcaaaagacaccaggaaatgcgaagcttgaactatagcttataacagagctcacgacaggttccctttctccttttcctttctttcctgtcttttcttcttcctttttaaatggagcacagataaacgtttctgatctgaagctttgcagtgtttggagaataattattctgtttctttaccatgctatagcaaaataagcctctccgagatatatatttttttcttttttgaaatactgcaaaatacagaaactgcatcgcaatcttgaagtcaagataatttatttcttgtttgcatggtttcttccaaacaaaagtattattaggcacaagaaatcctttttcccctctgatatttataacccaatctaccagggttaccattctaaattagctataaaggtaacattaactggatagattttttttttaataaagaagatgagccctaacccaaaataattcaagaataacagatgtaaatgtgtgagttttactgaatggcagatagactgagtaatttatttaataattgggagaaaccagggattaagaatagaacccacaggactagatcatcagaagaaacagactcttaagattgggagagaacttgcagaaaggttagtctaaccttcttcctaacgtaggcatccctggctaaaatgttcctagaggaatatcttccaacttctacttgaatactgcctgtaacagagctcttactacttctcacgaagcctcaatttattagaaagatatttcacttcctaccttgcttctactcactgctccagctctgccttcggagaagcacagattgagaacagtgcctcttccacataaagagctttaaaatttaaagataactctctcatccccccagagcagccgcctggcacatagtaagtgcctaatacaaatttattgaataaatgaaacatcgcttttcttttttcctcaaacctcatctttctctgtttcctttctctttttaagggcattgtcaactttcctggcacacagacattaaacctcaaaacatcttctactcctctttcactactgaaatcagtccccaaattctatcatccctcttcccagtgtgatccattcccttgattctatttcctgttttaagtttacagaactgccacctacattgattttgttctcatagttcaggcccacctagcctagtgaaacaacgacttctatattgatctttctacctctaatatttaaaaaatcaattttatgcatggtgtcagaataatccctttaagacacagttttgattactactccctgtctcaaaacccttctgtggttttctgttgtcttcaaaatcaactcccaactcctctgatgacattttggggtcttcatgattgactgcagttcatctaactttatttccacttttccactgccccagacaggcaggattacttgctggtctctaaaggcagcccataatgggctttggttggttttattatgtccccacatttctgtccatttgttggctttgaatcagttgctatttccattatgaaacctcttctaatcttctctaccacgaataaatctctttcttctctgtcttaaatggcatttttagaccctctattgtaacagatattttctgccttcaattttagttgtttgtgtctgacttattttttgaaagcaggcaatatgctttgctaatatttcacatagtaaagattcagtacatacctgctaaacaaaataatgtaatttcatgatccaaagtacaaaaaattctattttcaaatttaaaaaaagttttaactctatcccaagtctctaaattatttatttaaaataagataacttgttttttaaacagattttttcatgtctgtcttttagctcatcatcctcatccactttttgaataagcagccctgggtggactgcatagtacttgattatattttgttgctgattggtcctggatcttttaataacatcaaagagtttgtagtagtttatgaatcaattttaatagattctagttgctcaacattacctataggagaagctaaaaacaagatactatttgtccctggccagctctaaagctgttacaaggtggaagaaaaggaaagtctcaattatagcttctcctaggatcacagccacagtgcttcacctggtcattttgaattataaatagttgaatatactacatggaaattgagcaaacacgacaatgacactttggcttggcaaggcacatgctgattggccagctcttcaaacctgtttcatctgttaaaatgcaaaccaggggccaagtacctggcagagcacgatacacatcctgcttattaaataaactttgttaaataaatgcctgagtaactaaatgaataaatgatattggaaatgcctttcttgagattctcatttcttagtacagagagagggaaagagggagagggaagaaaaaatgtgtgtgtgcacaaaacatagagagtggactaatagacactggagactcagaaagggggagggtgggagaagagtgagggatgggagattacataatgggtacagtgtacactatttgggtggtgggtacactaaaagcccagacctcaccactttggatatatccatgtaacaaatctgcacttgtacctcttagagcaataaaaataaataaaattatatattacaaaagacagtatatttgtggtggggattatttcaaggttcagactgctatataagaacacaactcagagaaaatactggttatgaactactttacaaaatttatatagactgcctgaattttattcttttaggtattcaatccttcaatttttattcaataatttttacatgttgacaaaatgttataatatatggaggaagtgagctgggagaggatggggtgaggaaggtataaaagagagggaagaaggaaaaaaaagaagaccctgagtcatgttgtttgtttgcggttttgttgaagtattttctcatgagtcaaatctctaaaagaatcttggttcaggtctgaagatcactctgtaacagtgcttaaatatattactctctttacctaaaatacttttatggagtcttaaaattcttaaagcataacaacacactaattaggcaggaacttttattcaactagaatgtctttaagttccaaaagtgagacaagaggagggaaagaagaaactgaccattattctgggctaccatgtcctaggcagtgtggtgtgaattattatcctgatttaccgtaaggaaactgaagctcagagtatgtggtgaaaacaggaattttctttgtcatagtcttttaaaaaataataattctaggggttttactcccataatggcagtgtgaggagctccacaggtccaagccccagtcaaaaaacttaacttgaaaattataaacaaacaatcaaaaaaccctacacaatcagaaaccaaaaacaatgccaacaaaaaccaaccatcaaagtctttgcaaagtgtcctaagagcatataatgtaaaaatgtttattccaaagacagacactaaaacttggtaaaaacagattctgagattctgtagcacttgagccatagctccctctggcccctccttccctgcaactcatctccatagatgctccactttggatggatgtgtccaagagaaagggctccccttctcctcaaatcccaaccaagcggcatgggatctcatcaaaaggagcaggccagcatttccaatttcctctaaatctaagctgtagaggttcaattcctggtgagtgtggctgagaggtcaggggctcctttcttccacccagaccccattcatagaatagaaagttcatcccagctgggtcaggccaaaaatactgggatcttcactgccctcgactgcttacatatagggtagaggttccatgcccagaaaggtaaactaggaagaccagaggctatcattcttgccccatgcctggaagagtggctcaacgattttgcttaaagggagagtcagtttataagaacaaaaagctctaaagctttcccccaagaggttgacttatttgtttgttttcaatttttgttttggatttagggagtatatgttcaggtttgccacgtgcgtatattgtgtgatgttaaggtttggggcatgaatgatcccgtcaccaggtactcagcacagtacccaatagttagtttttcatacattgtccccctccatccttccctactccagtagtccccactttctattgatgtcttcttcatgcccatgaatacccaatatttagctcccacttataagtgagaacatacagtacttggttttctgttcctgcattaatttccttagaataatggtctccagctgcatctatgttgctgcaaaggatataattttttttctttttttatggatgcatagtattcaatggtatatatgtaccatgttttctttacccaattcaccattgatgagtactcaggttgatgccgtgtctttgttattgtgaatagtgctgcgatgaacatatgagcacagatacctttttggtagaatgatttattttcttttggatatagacccagtaatgggactgctgggtcaaatggtagtttgttttaagttctttgagaaatctccaaactgctttccacagagtctgaactaagtgacattcccatcaacagtgtataagtgtccctttcttctgtagcctcaccagcagctattattatgcctcttagtaatagccattctgactggtgagaaatggtatctcattgtggttttgatttgcacttctccgatgatcagtgacgttaagcattgtttcgtatgtttgttggccacttgtatgtcttcttttgcgaagtgtctgttcatgtcttttgcccatttttaatgtggttatttatttttatttgttcaattgtttaagttccttatagattctggatattagatgtttgttggaagcatagtttgtaaatattttctcccattctgtaggttatctttttactctgttgataatttcttttgctgtgcagaagctctttaatttaattaggtcccacttatcaatttttgtttttgttgcaattgcttttgaggatttagtcataaattcttccctaaggctgatgtccagaatggtgttttctaggttttcttctaggattctttttttttttgagatggagtcttgctctgtcacccacgctggagtgcagtggtgctatctcagctcactgcaatctccgcctcctgggttcatgccattctcctacctcagcctcccgagtagctggaactacaggcacccaccaccacaccaggctatttttttttttttttttgtatttttagtagagatggggtttcaccatgttagccaggatggtctcgatctcctgacctcatgatctgcctgcctcggcctcccaaagtgctgggattacaggcatgagccaccacgcccagcctcttctaggattcttatagtttgaggtcttactttaaatcttgaatccatcttgaggtaagttttgtatatggtcaaaggtaggggtccagtttcattcttctgcatatcgcaagccagctatcccagcataatttgttgcatagggagtcctttcctcattgcttatttttgttgatttgtcaaatatcaggtggctgtaggtgtgcggctttatatctgggtcctctattctcttccataggtctatgcatctgtgtttgtaccagtaccatgctattttgtttattgtagccttatagcatagtttgaagtcagggaatgcgatgcctctggctttgttctttttgtttaggattgctttggctattcaggatctttttggttcaacatgaattttagaaaagttttttctagttctgtgaaaatggtagtttgataggaatagcactgaatctgtagattgctttgggaagtatggccattttaaccatattgattctttcaatccatgagcacagaatgtttttccatttttttgtgaaactgaggttatttgacacagagtgtgcggaagtttaagcctaaacgtgttatcaaaatcaatggaggttacacagtggctcattcctgtaatcccagcaatttgggaggctgaggtgagaggatcacttgagtttgagaccagcttgggcaacatagcaagccctctatctctacgaacaattaaaaagtagccagagatgatggcatgtgcctatcatcccagctactcgggaggctgagatgggaggaccccaaggctgcagtgagctatgattgcaccactgcactccatcctgggtaacagagcaagaccctgtctgtaaaaaaacaaaccaaaccaaaacaaaaaaatcccccccaaaacccagtggagatattctggtgacaaacaatcaaaaagtggctaatagctacagtagggaaataagctaaatggtaggttagctagttttaaagaaacagagaaagacagttatgaagagccctgttgaggtcaaaagaaacttcaaatactagcttcaaaaattcctccttctcaaatttaattggagcagactctggagcaatttatagctgacggattgtcaaaaacaatagagcaatcagcaggcaattactggagtctaatatctggatgtgatatcaaatgagatagacaacagaaagattaggaaaagagacaaagagagccctgctataaccactgccatcccaaaactgtgcagatggccaaggctacacccttgagaggataaatacaacgtgatgcatccatactattgactattacttgacaataaaaataaatgaagtgctgatatatgctgcaaattgcatgaaccttgaaaacatcatgccaagtgaaaaaaaaaagctagttataaaagaccatatattgtataattctgtttaaataaaaggtcaagaatagacaaatctatagagacagaatgtagattaggggtttcctagggctggagaagtgaactgtggaaagtgactattaatggatttagggtttctttttagagtgacgaaaatgttttaaaattgtgatgatggttgcacaactctgtgactacactaaaaacaactgaattgtaccttttaaatcagttacttaaattatatatatgtatttatatagtatatcagtagatttaaaattattgaatgatgatataaaataataaaaacaaatcttaaaatttctttaaatttacaagaacaaaatgcacatacataattgtatataaaacattggggttgtttaatatatattggtagttttagtgctctgggttttttttcttctttagttttcttggttaccccttcctccattcttgtcctgcaatctgcatcatccatcctccctgcaaggttattcatgttaataaactggtatgtatattcatatatatttacccattttcaaataacacacacacacacacaaaggcagatatgttcggatatatacgtatatgggagagtatttttggcatggtttcatcaaaatgaaattataccactcacttttctgaaccttagtttgctcatttaacatcttataaaaattctactggccgggcgtggtggctcacgcctaatctcagcactctgggaggccgaggcaggtggatcacaaggtcaggagtttgagaccagcctggccaatatggtaaaacctcgtctctactacaaatacaaaaattagccggacatggtggcaggcacctgtagtcccagctactctggaggctgagggagaagaatcacttgaacccaggaggtggaggttgcagtgagccaagattgtgccactgcactccagcctgggcgacagagcgagactctgtcaaaaaaaaaaaaaattctactaagtaaatgagttttaatttattatttgttggttatttgtaaaaagttaaaatagttatttttagttattttcaactttttaaaaataactacataatagttcataatgtggataaaccacagtttattcagttctttgcctgatatctctaggatatctttgcctgatatacatccttttattttctttttttaaagatttttattttgaaataattgtcaatttgcatgaaatgatagagagagtgattctggatagattttcttcagttttctccagttgtgacatcctgtatgactttagcacagtatcacaatatcacagccaggtcattggcactgaaaaaaatccactgaccctgtttatatgtcctgtgttttacatgcactctgtgtgtgtgtgtgtgtgtgtgtgtgtgtgtgtgtgtttagttctgtacaattttatcacacgtgcagaccacgtggccatcatcacagtcgagacaccgacagcaccatcataagaatccctcctggaacttttttttatggccatagccttcttcctccctttcccattttttgacccctggcaactactgatctgtgtccatctctatcattttatcatttcaagaatgttacatgaataaaatcatatattatgtaacattttggaattgggatttttcattcagcagaattcctctgaaatccatacaaattattcagtgtgtcagtagcttattttttcatttctgagtagtattccatgatatggatgtaccgcaccatttacccattctcttccagagtggctgtaccattttacattcccattaatagtatacaaatgatgcagtttctttgcatcttcactagcatttggtgttgtcaatttttttatgtagtcattctgataggtatgtactaatatttccttgcggttttaatttgtatttccctcatggcttactatgttgaacaaaatcttattgcctgtatctttttgttaaaacgtctgttcatgtcttttgctgttttcttcattggattgtttttctactgttgagttttgagaattctttacatagtctagatactaggaatttgttggactttttatcaatttttttatggatcatgtttttggtgtctatcccattatttttaactttaaaaaatgagcatttaaaaatgtgtctcataaatagcccagagctgtaatattttaatctgaagttttaaaatacaatctctaatggcttacattttaatgggcaaatacaatttggagtaatgacaatcatgcttgattttatccattccatcttatgttcttatttatttacattgttgtttcctcattttccttttcttcatttttggtactctggtaacattcttattcattctatttttctctttttaactttgtgactctgagatacttctctattcctttcaaggttactttatttttccctgctctaatgatcagatatatacttttctatgattatttgaaaataagttaccaattatttccctctcaaaaacgctctatatccttcatactccagtaaaattagaccctcagaatgttttcctttcttcgttctctttttcctacaaccacatgtgatctctggaatgcttttcctttacccatctgccttattcccaaccagttcctaggttttgctgataatcatttagtaaacattttcctagtcaattactagaatttcctcacagtatattcctcctatttaaagagtctttatttaatatttatgttgcacactcccagttggtttatacatttcagtttagatttaattattgtaaagattcattggtcaccactatttcatatccttataaccatcttaatcttgaggtttctgtttccatttgtttgtagtttagttagaatagtttctcatatattcagaaaatattttaaactgattaatcataaaagcagagtgaatcacaatttgtgagatgcaggtaaaatggtacttggagataaatgtatagcactaaatgcctatattagacaggcagaaatactcaccactatactagtaaggaacaatgtctaccttagaaatgacaagaatttcaaatcatttatctcagaattcactttaagaaatgaaagtaagaagaaagataactccaacaaaaataagcagaagtaaggaaataaagatcagaggggaaataaatgaaacaaaagatcaatagagaaaaatcaatgaaaccaaaagctgttttttgagatgattagtccaactggtaaatctctattcaggctgaccaggaagtaaaggagaataaagaagtaatcaataccgggaatgagagaagtgacagcaaaagagtttttatggatataaaaagaataaagaaatgttatgaataactgttagtatcagtaaattcagcaacttagatgaaatgacaaattcattaagagaagcaaggtaccaaacctcactcatgaagaaaagttcataactgactagctctctacctattgaagtaattgtatttgcagttaaaatctttatacaaaacaaaacaaaactccaggcctcaatggctctagtgttaaattctaccaaacatatagtgaaagaaataatagcaattctacacaaactcttccagaaagttgaggagagagaatacttgccaacttattctatgaagccagcattattttgataccaaaatcagatcaagacattatgagaaaagaaaactatatgtattagtgtctgtcataaacatagatgtaaaaattcttaacaaaattttggcaaatagtatccaacaatatatacaggatgatacaatatgactaagtgaagtttaccccaataatgcaaggtctcttaaacatgggagaatcaattaatgtgattcatcagattaactaataaagaaaaaccatataatcctctccgcagatgcaagaaatcatttgacaaaatccagcatctacttatgataaaaactctcagcaaaatagaaagaaatttcttaatcctgataaaaaggcatttatacacaacctacagttagtaccatactagattgtgaaagactgaatgcttttctgttaagtttagaaacaaagcaaggatgtccattctcaacacttctacccaacattgtactggaggttctagctggtgcagtaagttacaaaaaagaaataaaatgcattcatattggaaaggaagcagtagaactgcttcttgcttctattcccacatgacatgattttctatgtataaaatcctgtgagacctacataaaaactacaagaaataataagtgagtttagcagagttgcaggatataagatcaatatacaaacatcaattgtatttccctacactaacaataaacaattggaatttgaaataaaaaccaacataatttacaacagcaccaaaactatgaaattctaaggaataaaactgtcaaaagatgtgtcaagaccaattaaatattgctgggaaaaatcatacaggacctaaataaatggaaagatatactatgttaatgaattggcacagtcaacattgttaacatatctgttcttcccaaatatatctatacattcaatttaatcctaatcaaaatcccagcaggtgctttgtttggtagaaattgtcaagatttttctaaatttcatatgaagtgcaaatgacccagaataaccaaaacaacttcgaaaaaaagaacaaagttgacaaaggtatactacctgactttaacacttattataaagacatggttatccacatattaggatattggggtcaagatagacaaacagatcaatgaaacaaaatagtggtttcaggaatagtgtgacacacagagggtcaactgagttttgacaaaggtgaaaaatcagttctgtaaagaaaggagagacttttaatgaattattctgggaaaatagaatacctatatgccaaaaaaaatttaatccatatctttcatcatatataaaaattatctcaaactgtatcataggcctacccatacaatctaaaactacaaaatttctagaagaaaacttagaaaaaaacttagggaaagtcttaaccttacagtaggcaccagaagtacaattataaaagaaaaaaatgataaacaactaaaattttcagactcttccctttgaaagacaatattaagagaatgaaaaacaaaatgctgattagaagaaaacatttgtgaatcatgtgataacaaatgtatatccagaatatataaagaactctcaaaactcagtattaagaaaataaatcaatttttaaaaatgagcaaaagatttgaacagaatcagagaaggtatatggaagggaaacaagcatttgaaaagaggctcaacatcactagccattaggaaaatgcaaatgaaaatgacaattagataccacttgttagaatgtctaaaatcattgccaaatgatgcgaattaagagaaactctcattccctgctggtgagaatagaaaatgttacaaccactttggaaaagtttgatggtttcttaaaaagccaaatatacatccactagatgacccagccattttactgctgaatatttacccaaaagaaataaaaacatatgccatacagagacttgtataggcatgtttacagcagctttatttgtaatagccaacaactagaaacatcctaaaagtccatcaacagatgaatggataaacaaattgtggcatatctatacaactgaatattactcagcaataaaaaggaatggatagttcatacacacaagacatggatgcatgtcaaaatcattttgcacagtgaaagaaaccagaccaaaagaatacattctgtatgattccatttatataaagttctagagagtataaacttaaatatagtgacagaaaacagatcaatggctccttggggatatgacaagattggtaggattacaaaggggcaaaaggaaacttttggggctgatgaatatattccttttcttgattgtggtgatggtttcacaggtgtgtatacatttctcaagtatcaaaaagggtacactttaaatatatgccgtttgttgtaggttaatgatacctcaataagcctactttaaaaagttaagctgggtgcagtggctcacgcctataatcccagcactttgggaggctgaggcgggtggatcgcctgaggtcaagagtatgagatcagcctggccaacacagtgaaaccccgtctctattaaaaatacaaaaaaattagctgggtgtggtggcgggagcctataatcccagctactcaggaggttgaggcaggagaatcacttgaacctgggaggcagaggttgcagtgagccaagatagtgccattgcactccagcctgggcaacaagagcaaaactccatctcaaaaaaaaaaaaaaggaagttaaaaaaataaagtagaaaaagaaaatacagaatgatgaggagggaagcaacttattttagacagaataatcagagaatgactctctgaaaaggtaatatttaaacagagactcaaaggtattgagggaacaagccattccagcatctaggtaaaagctctaggcagcgggaacagtaaatttgaggaccaatgacctgctctatattgtaatgccatggtgatcctgagggggtgaaactcagtggtacctcaattttggcatgttcttaatatcagtcttcttgtgtattgcatagccattgaagtcctaggagattgagataaatgtgttatttcaggacactgtctgaaaactgtcataactgcattaaaataaacccataatattagtttaggtatctaaaattaatttattcttttaaaagtaaaaggcagctaatattctgattaatttcagacatctcttaattaggttcgagttcattagggggaaaatacttctttttatactttattcatttcttcagcattcactgatttcttcaataaatatttatgttctaagcattttgccaggcggtggggagatagctttgaatatccatgtacttgtggaatttatagccttgtggagaaaatgagtttatcatttagagaaatgtcctttgagatgagagaaattaaaacttagagacatgacttcctattgtgaccacatagagatgagaaatacattagcaaaaacactacctgatttaataggtgttacttggtaaaactctgatgaaacagttaaggtgagtaaaatgatttggcagaggcagcagttaattatgtttgctaagcaggaaaatgacatttggaaaggatgaaggaaaacttctgaacaagagttttaaaaaaaagatgaagaaactggctgaaccctccaaaatgtaataactatctgtttatgctagcatcaaggtgactgacataaggcacatacttttcaaagaatgtgagtctttctagtgatcaaagccatagaaaatagaaggtagctaatatttattgggcacctactatgggtctggccttttatatatgttatctcattatgtaaaacaacatcaaacacatattgagcatttatttactgggagtcagcttctattctaaacgttctacatgtattggctcactttattttacagtaaactagtagtactattgttatcatctccttttatagggaatgaaaataagatacagagaagttatgaattgtctaaagctgcccagttaaaacttgaaccctaagtagcctggctccagagcctaactaagctttcagccactactctatgccgcttctgtgttccaggtgcacaggatgggaaacttgtccttttgcaggagtgagaatgctcatccatacacgtgccagcaagtttgttttaaaagggcttcttggggttactttgttgttgtttattctccttccccccttcaccttacattcattattcttggcttctaatgtgaaaagccatgagaaaaggcaggaggaaataacaagaggtgggagaatagtaaagcccatcacctggatatttttatttcatgtcagcaaagggctctgctgtgattttgaaatattgcagcttcagtgctgtttccacatgggtgctcagctggtctgcaatgcatggatgcctgtgctatgtgtccagaagacagctgccttgatgagatgggggacagtgtggaggtcggtagcccagactctcgagccagactgcctgggtttgaatcctggctcttttccatgatttaaatatttgctgcttctatttttaatatacagcaatagacttgtttctgggggcttagttgttctttggaagagtgaggggggacacctcaccccatctatctcatggttttatttgaagctgaaatgaaatagcacgtgaaaaaagcactgtaacttagagctatctcaatcgtagggatatattgttatctttactgccagtaaaatatatacctgtgttgttcattcagtccctcgaccaagagactggtcctgcgccatcagtgcatttccttgcccagttctctttgtttccaacagacaaaaatgcatggggtgagcagtctggccaaataacaggaaagctaattgtaccgtgaagtgatcagaattcccacacccatgatgttgttgaaggctttgtcttatctaatatgcaccaatagccaggtcttcagcactaagcagcctggtctttgcaatttatctaaaagtaaaaagagaaaaagcaatgtggggccaagagtggcaaagacaggatgattcttatttctaccgtaattagcaaaagggacaattagttattttaacatattttaaataaaggttggttatttttgaaggtactggtttaaaaaaagcacataatttcttaagaaggctatgcccacattggggaaagaaactgtgtattccactaataactaaagtgctggtgtctatgtgagcctgcctttctgtcttttacatcttgtgatacaggtataggagctaggagtgaatagtattcatttctgtaggacagaataagaaagatctcgactaacaaatctatttttaactagtaagtagcagtatctcatttttccaatcctaggtgtcctctgatctgagaattataaactacatgtccttcttccttatggagaaaaactgacagtaagaattagcaggaaaagagacaacccataagaacaatgcttcctcctgataaaaggatagccattctgaaattcaaaaatagaaatgcaaagcagaggtagcagacaacagaaaaatgaaagggattgtcattccaagaattggggaatgctataggtcaacaaagttctggatcataacgccgagatttaaataggaaaatactccaagattatggtctgatgttaaaatgctaagggaagtcaggagcttggattcaattttccctaaggccttgcattttatttctaactaaaatttcatggagcacttaagaaataccagcctttacaaaacagatctgacaacttatgtgctggggtatggtctaaaataggaaatgaaatttaagcctaaaatgctaaaatcttttggcagacaacaaaattatatatataggccatacctgattggaaaaaaatagtaattccgttgattttgttcttgttttcccttcttttaaggttgctggcaagtgtttgaatccccattgagaagaaggtgatcagagaattaagtcattgagccagtctgtgtgacagcctttgtgttaggaccagggaggaaagggaacatgtcccagcctcaaagattttagagtttagtgaggaggaaattaccataaagaatgatcagtattatattaaagatgtgtgcaagatatataaaatgttgaaggaaggggaggatgcttaacttggcttggatagagagcttatagaggagaccatctaatctgtgccttgaagacgtagtaggaatttttgaggcaaaaagaaggaagatggtgttccaggcagagggaacagcatgtgcaaaggtatgtttgaggaactacaaatgattcattattgctgtacttcaaaggttatatgtgcatgtatgaggagggaaatctgcacagaaatggaggcaggataagtaggaaacagacaatcaagggacttgtgtgccatgaaaaagagaactcttttctttcctgagaacagagagatttgatcaaattgttgttgcacaaacatcccctggaggatgtgggagatagacgaatacaggaaagaaactggaagtggaaaggtatagaaaacctgcaaggctctttctcttaaagagcaaatagacaaaatgacctaactaattattttaggagacagtctttaatgcagaggggcctccaaatattcttagtttcctagaacaaagtaagccctggttcaacagctgactggacttcctgtgaaagaaatttagtctgccatgcctcagctgcagaagtcagacatgagaggattcttcccatagagaagacttggtctaatgttggttcaaacttagcttgatagccatggcaaatgaacactctttagttgctagaagagcaatgttaaaatttcaggtgtttcgtgtatgctttacaaagtgatgaaaaataataacaatttttttaaaaaagatgatagctgagaggattaaagatgttgataaatacagaaagtgcttagaacagtacttgcatatatgcactgaataaatattagtgaaaataaatattagctataacaataaatattgactatatattattagctataataagtatttacctataataaccataatacatgtaataatgtattaataataattggctcctgaatcagaaacaaatttcaaatagtcacctctctgaataagttaggtactatctaaaatccatgaaatctgtgattttgaaagaactcatcaggaaactctggttcagtttttacatccatcactcttcagcagatgtattaagattaagtatgaacacagaagaggcactgaatttatttttttcatcttagcctattttaactgttccgaaatctcatgattagagtaaataccttctgtgatggatgcttatttaccttcttgataaagtcaactggtaaatctctaattcttataaatcagaagccagaaaaatgtctcaacctgaaaattaatgcttatttccattttctactaatattgtgaaaatccagggctaaaaactggtttctgcttcatttttccagcaatcgtaaaatgtttctttgggtaaagtgggataaattttcagagaatttgaccctcaattctgtgtgtatttttcacacttaagacaatcttagaaacttcacatgcaggaaatttaatttatttcatatagaagcattggctgaaaattataacataaaccaaaaacaaagaatagagctggcttaaaaatgttgaattaacagactaaaatatatttatactataatataaacatataattaggtaatttaaactaagcattgagattcataatgacccaaagtctgggggtagaaaaagagctttcttttcttctgttttctatacaactcagagccaacctgggaatctgtcatggacagttatattcaccaccaagcatgtgtccttctcttctgataaccacaattttccttgggggatttaccctctcattactcgtagttcctgtgcttgggaggagtttcttgcctatcatctactgggataggtatatgaccaaaatctggtgctgtcggtggcttctgagatggctgcattgattcttagttccttctactgaaggctttgtgcaagtccctcccacttgaataactttcttctaattaatagcatacctcaaaattgggaagatgtcacttccattattagattacaaagttctgactttgatcttactaagagatcctcttccttgctggtttactaggagatcctcttccttgatgaagcaagattctatgttgaggcccgtgccaaggaattgaagaaaatctatggccaacagccatctaagaaaggaggccctcagtccaacagatcaaaaggaactgaatcctatcaacagccatgtaaatgaactttgaagtgtatctcaggatgagccttcagatgagccccttgccctggcctacacattgactgaagctttgtgaaagggcctgaagcaaggacccagttaagccatgtctagattcctgacccacagaaattgcgagattataaaatgtatgctgttttaagctgctaaattttgtggtgatttgttatacaacaatagacaagaaatgcatctgggtgctttttatgctcccctggccaaaatgtttcattcagagttgaccacatgatccaactcagtacaataaaagttagggtctctctccctctgctgtacacacagggcataagattgcaaagacttaatcttggtggtattggaagtcttacttgaaccatttggagtctgaaaaggaagccaacatagagcataatagagtagaaaaatggaaagaggctggttcctaataaccttttttgagaatccagaatcaagctgcaactgaaacttgaatttcccttggatttttggatatgcccctttatattttacaaatataaaaaaattatattttcaaggtatatgtttttgcttaaaacaatttgagttatgaactaatatactacatcatgaaatagtcattgaattcctcttcttgcttttgtcttgcaaataatattttattctctctataaaacagtgattaattgttaatagagttaagaaaactgatgctcaatgaaggaattctctacttcagtacctgtggagtctaagataaatttttaaaaataaagtgctaaaaatcagctcagtagcatttacatagctagctgatgttggatataagaacattgacatggatttgaattgtatagtcacatgcattttgttttttaaaataatatagagacaaaatttccaacatgttgctttctactgtgtccacagaacccttcattctatgctgaattctactcaaagccaaataacatctttaagtttccatggacattgagcaaagtttcccagattctaccgtggttgtgttacaagttaagtattccttatccaaatgcttgagaccagaagtgtttcaaattttggaatatttgcatatacataataagacatcttgggaaagagacccaagtctaaacatggaattcatttgtgtttcatatacatcttgtacacatagtctgaaggtaatttaacacaatattttaaataattttgtgcatttaaataagtttgtatatcttgagccatcagaaagcaaaggtgtcactatctcagctgcccatgtggacaatctgtggttgtttggcatcatcataattcctgattctgaaattatatgctactgataagcaatctttttttatacttactcaacacaagtacttcatagtaaaaaataggacataccattaatacaggaaaaaataatgtgttcaggttagctaatccgcatagtaccatcaccagaatacctgcatcagctgttgaagaagagcaacaacaaatagttgcaggcttccaggctccacctacgatgctgtgttttgattgaaaggtttctgtacactgtgttttattttttatttatttacttatttttaattttacttttgagaccgagtcctgctctgttgctcaggctggagtgcagtagcatgatctccattgactgaaacttctgcctctggggttcaagtgattctcctgcctcaccctcccaagtagctgggattacaggtgcccatcaccatgcccggctaatttttttgtattttcagtagagatggggtttcaccatgttggccaggctggtttcaaactcctgacctcaggtgatccgcctgcctcagcctccctaagtgctaggattacaggtgtgagccaccacacttggcctgtgttttatttttttaggtgggaagaaacatcagacacaggtgagagaccaggaagtgggtcctccagggatcaggaggcattctactggttggctttttaaaatgtttcctccagagtcatttgcctcatttacaatgttttttgtcttttaagtttctctttgatttcataaactgacatgatttcttgttatgaatgcatgctgctctagaccttcaacaagtccatcacacattttcaccatgtcattataggcactttttcctcagtatgaatgtcatcttcatcattactacgatcatgatcaccttgattcagaaccatttcagctgcttcaggattggtcaatgaatgcacaaatggagcctcaatgttaaaaaaacttcattgatatgcacttctaccagcttactgattgatatagtttgaatgtcaaactatatcatgttgaggtgtaatccctagtgttggaggtgtttggatcatgggggcagatccctcatgaatggcttgggccatccccttagcgataagtgagctctcattctcagttcacatgagatctggtcattaaaaagtgtctggcacctcctcctaattatctctctctcgatcccattttctccgtgtgagatgcctgctccccctttgccttccaccatcaataaaggctccctgagagccccccagaagccaagcagatgccagcaccctgcttcctgtacagcctgcagagccatgcgccaattaagcctcttttctttataaattacatagtctcagatgtttctttattgcaatgcatgaacagcctaatatactgatagactctgaatgcatattttctgcatatgagaggaggtccaaaatcatttttttcacacttgacatatgggaatccttcaaagtaccaatttgttcatcatcatcactgaacacagccatagacaacaggttgtaccaggcatgcaaaactgtctttagtcactatgttccaagtcttggcaacagcatatacagtattcttcatgttaaactcctttacgaaaacgtccatgcccatacctctgttccctgacgctagcatgctgtttaataaagtgtttttatatttccttttcattgacttaagggtaccctaatcacatagctcaatgaatgaagtcacatttgaggaaaattgcatgacataaacttttttttatgagaatttcacctggaggatgagcagaacagttgttaaggaataacaaaatattgcagttgttattcagtacagcttccatgcagtgagcatgagccgctggtacaaaatgtttgtgaaatcaatcaggaaacatgtccctgatgatctatgtctttctgttagcataataacagaatggtaagaaattcactccttgaaaacagcagggacacaagcttttgcttaaaacagcaagtttacacttatgtatgtctgctgcattagcacatcccagcagaggtattacccttggcctccttaattcctgtctaggctgtctcatcagctgtggttagtgtcttcctggggcaataatggcaataatgccaaaacagtgatgtttcatcagcattatagacttgttctagcatcagattttcacaagtgatgaccttggcaaacttgttactaaatttttttttcactgctttgtaatcagcagatgctttactaccacaatctttacaagtctaatgctgtgtctcttcttgaatattcatggttaacttcaattttcagttcattgtgatagatctttgtttgtttcataatcagaataccattaagtggcacgtgttcactgcaacaccaacagatccattccttccatacacaattgagatattccattttggctttatgcagtgtttttctatttttcattatcttctgctcatcactttcagtatagaacttgaacagtttatcctgctatttcctcaggtcatatccagggtcattccaacgccatactcttctgtaagatgcttcacacattcaccaatatccaatttctccaacagcttggctttctgtggcatagacaaacattaattcttcctctttttaaaatcatgattatccatacccacaggggtgtctgtaggccatttggactctttcaacaatatctttttaccacgaagcagagattaagcaaaaaatccacaatgggtaatgcacatgtcttggccccacacaggacatcatggcacctcatggggaacctgctgttggcatatccaattaacacacatgctttcttattacctttgactggcaggcttgttgggggagaggaatctgggcaggcatgtgaatatgttgcaattgaagagggctgggggccctttttacccttggggatgctgaataaattaaaataatttcaggcactatcaactttgttgttgtatttataacaatgcagggaatgtttccccaaccttttaaatgtttgttccctattgttattatatttttctgctttgttcattatttattttatatcaaatatggtttcattgaaaataactttatatgcataatttgcctaatagatcataaataacttaagaccattcatgtaataagataacaaaaataacaatatttttgtagttttagacgtgctttaaataaaatagtaagaacaaaagttcataaaatcttatcgaggtcaaatgctagcccagttgttgatccaaaaccagatatctcttcaactcaccctaatgaactatcaatgactaatcataaaattgggataataaaaataatgctttagcatgataaaggaataccaaatatagagacaatgtagaaaaaaaggttagcagtaataaaataaaccttggctataacattcatttctataaactatagtaattatctagatcaaatacatattatggattgactaagtgtgatgatagaaaatgggcttaggaaggatataaatttagttgaggccgggcgcggtggctcatgcctataatcccagcactttgggaggctgaggtgggcggatcacgaggtcaggagattgaggccatcctggctaacacggtgaaaccccgtctctactaaaaatacaaaaaaattagccgggcgtggtggcgggtgcctgtagtcccagctacttgggaggctgaggcaggagaatggtgtgaacccaggagatggagcttgcagtgagccgaaatggcaccactgcactccggcctgggtgacacagcgagactctgtctcaaaaaaaaaaaaaaaaaaaaaaaaaatttagttatctattttaaggaataaactgaaaagacatgcattgtgtcatttaccttaacaaacagtttacaagagtgccatgcattctctttcctgccatccttcttgacttcaatagcattttgtaaaagatgatggtttagggccatgtaacagctggcttagtatattagctctaggaaattttcttaacaaagagcagactcctaattatgtgaccatgggaaaaactctctatgaatctcctttctcatctataaaattaggaaaatctgtaaagtgagtacctatataatagggttgttgacagattaaatgtgataatacttaacaacagtgctgacatatgataaatcctcaataatgctaactgtaattactattataatatcactgtgactattgttatttattattagtatcatcaaaattatttggcatttaaggttctccatcatttgggcttaatcaaccccaactgcatttataataaaccctaggctgtaacattcatttctatgaaccctttcctccttgttatgagaatgcttccttctatttattcattacctgcctcatggcttcttgcttccctgtttttgttcatgctatcctttctacctataataatctgtggctccctcatcctttttgccaatttcctcctggctttgtgctactgatcctttgaggtcctttcatctcctcagcaagaatttctaggatacttccagttttcttcttcttataaactcccatagtacattatttatgcctcttacaaggcattttaaacttttgatactgttaaaaatgtacatatacattgcatatttttcacaagactttaaacacctagatgatggaagccatgtcttaaccatctctgtgtcccacacagtacctagcagaatgccttgcacaaagggggctaaacagatattctaaataaatggtgattataggaatcagacatgtaatttttgcttcattagaagaatcttctaattaactggactaagcagtgcttactttcccaaaaagttgattatagagactcactgttggaggtttgtttcttaggtaatcaaggctgatcactggatttctttgattttcccaagattggggctaatgcctgaaattggggaaagttctttgagggaaagggtttttttttttttttttttttaatctgaacgaaatttcaaaaaagggaatgcttcttacttgaccaaaattgaaagcaccatgggataaaaatttctgagttatgagtctcaggggtccaaacacaaaaccccaaagcatggcctcttggtttgctgactactttgaactgaaggacactgaaagtgcctcagaagcaaggtctttctgatcctctcctgccttctttctccctctccactttctcccccaaagcaagccataaaacctaggaaggtctctgacctcctcccctccctactgactgtcctcatatgacagatgtcctgtcccatatctggggtgaatctgaacaaacaggcctaagtttctccccagtttacatccattagagtatactgttttctccaaccatacttctacatgactatccattcttcatcaaatctaagcataaaaatatagctttccttgggtttgtgggtgttcatttctgaagccttgtgtgtcacataaactttggttaaataaattcgttatgcttttctcttgtcaatccatgttctgttatagggatgttaaccatgatccttgcgataagttaggaaaaagaagccttggcttttttttttggctcccaataccttgctcacagaataaaactttataatttctcataatatgtttttcttttgaaagccccaaccatccactgagcttgaaatctatgttttatttctgaaggctcattattctagattttagctttcatttggacaatgatcaaagagaaacaactttcacagcctcaaggtaaaagattgtaaacagcaaattagtgaacaaaagtatttttctttagttttatcttaaatgtataagaacaaaaaccaagatggccttcacaagagaaaatattccttttccaaataatattggctaatttgaaattttcatattcaaacaaatttaattttgtgagtgggaaaaacattttttcaagagaaagttttaggtattttcttattttttatttttttgtgggtacataatgggtgtatatacttatggggtatatgagatttttcatacaggcatacaatgtgtaatgatcacgtcagaataaatggggtttccatcaacagaagcatttattctttgtgttacaaacagtccaagtacactcttttagttatttttaaatgtataattaaattattatatttaattatataactaatgatagttaccctgttgtactatcaaacaccagatcttattcattctttctatttatttgtacccattaatcatctccccttcctccttatcctcccactacccttcccagcttctggtaaccatatgtattagtccattttcacactgctataaagaactacatgagactgagtaatttataaacaaaagaggcttaattgactcacagttccacatggctggggaggcctcaggaaacttataatcatggcagaaggtcaaggggaagcaaggcacattttatatggtggcagggcgtagggactgccacacacttttaaaccatcagatcttgtgagaacttgctatcatgagaacagcatgggggaaaccacccccacgattcaatcacctcctaccagttccctcccccaacacatggggattacaatttgacatgagatttgggtggggacacagagccaaaccatatcatcatcttactctctatctccatgagttaaattgttttaatttgtagctcccacaaataagtgagaacatgcaaagcttttccttctgtgcctggcttattttacttaacataaggacctcctgttccatcgttgttgctgcaaatgacaggatctcattctttttatggctgaatagtactccattgtgtatatgtattacattttctttatcaattcatctgttggacacttggttttttccaaatcttggctattatgaatagtgctacaataaatgtgggggtgcagatatctcttcaatatattgatttcctttcttttgggtatatacctaggagtgggattactagatcatatggtagccctacttttagttttttcaggaacctccaaaccgttctgcataatggtggttctaatttacgttcctactaacagtgtacgagagttcctttttctccacgtcttcaccagcatttattattgcttgtcttttggataaaagccatttaactggggtgagatgatatctcattgtggttctgatttacatttctctgataatcaatgatgttgaacacacttttatatgtctctttgccatatatatgtcttcttttgagaaatgtctattcagatcttttgctcagttttaaatcaaattattagattctttttcctgtagagttgtttgaggtccttgtatgttatggttttaatcccctgtcagatggagggtttgcaaatattttctcccactctatgggttattaattatatgaaatatttagaaagaaaacaatagttgcatccatatctgaaaaatttagagacactgatgacatgatgaccttcattccctaatgtttttatggatgatctagatatcacaagacacattaaagaaactacactgtagggaatattcaacagttggattgagcttatgcagcgtttcccaaagttttagaaattccatcagataacaaaaggaataatgtccaataagaatcattggtcttaggtgcagtggctcatgcccgtaatcccagcactttgggaggccaaggcgggcggatcatgaggtcaggagtttgagaccagcctggccaacatggtgaaaccccatctctactaaaaatacaaaaaattagccaggcgtggtggtggtcgcctgtaatcccacctacttgggaggctgaggcaggagcatctcttgaaaccagaaggcggaggttgcagtgagctgagatcgtgtcactgcactccagcctgggtaacaagagcaaaactccatctccaaaaacaacaacaataacaacaacaaatcattggtcaaggaagtttgggaaatagagggcaaagcaggttaaacagatttctttaatgtagatccctgagactttgacatactaattttcctcatgaatctccaataagggttatacggcattgatgtttcctgacctcatatggccaaggattactcttgacttttttctgtcagagcaccttgaaggactgacaatctatgaagcacattttgggaaactcatgtctaatattatatacaaaggaggttaatgacaatatgcaatgaaaaattaatcaaaatgcagtttcatataaatcaaatatacatttcacttataatatcaaatataaaaaagacatagtcttgaagtaaaatgagccttatcatctcaaatgggtaatctggatattaattcacctgttgtttagaatcttattcattaaacaagcactcagtttttaccttctttgtgacaagcactgtgttcagtaccaagataataaaagatgatagtaacacaatatatcttcccatttagattgcaattccacagagttctaaaggtactttctttggcaaaatagttcaaaaaatatgtcaagagactatatcaataagttattgagccatagactattaaagaagtgggaggtcaatagaggagagataagaaggtttcatggtgtgcaagattggaatttggcctagaggactgataggaggtacagtttagctccatttgggttcaagcatagaacatgtacagaataaagaaaagacttagggctacaagttcatattagaaacatcccctagacctagagttagagatctagattccaattccagttctaaaagtcacttgctatgtgaccttagctatcttgtctatctatagattatggaaaataatgcctgttttgtctatttcaaaatatcattaggagaaaacacctatagatagcatagtatgttgttaatttttggagttcaaactatatttatctaagttcgtcaagagttagtgcaaagcattgcttacaatgtatcctcaatgaacatttatttcatgaaagaatgaatggataaaagaagttagacctgaatttcctctgccacttactaactaggtcatacatgaccttagttaaattacttagtcaccctgagcctcaggtttcgtatttctaaaatgagggttaaaaattatgcttatatcacaagattgctctggttaaatggaaattgatgaaaaattcttagcacagtagttagtatatacttttcatcacatatacatcctatatattggataattaaagacaattcatcaaatataaagtacagtgattgtgtttatgataaaaactatcacatagcagagaaggagaagtgagtgttcaacatgtagttgtgaactgacacttttggtccaagagctgcatcagaacacgatgagtgacacacaatgtgcaccataacatcaccaagaatgtgagtttaaaaagtatcagatcattgactgattcttcagaaggatcctagattaccatgccatttaaaaatatgtgtaagaaaagcagagctcaaaaattatgtatgagaggctttccagtgtacgttgagcctcaaaggaataaaataaactgaaatttagacatttactcacaacgattggtatagctcagaggtgataatctctggaaagagtattgataatgttaatcattttatagattttaaattggtttgtgttctactgggaaccaaagaagatgtcatgaaggtggctggcaagatggacgaataggaatagctctggtctgcagctcccagtaagatcaatgcagaaggtgggtgatttctgcatttctaactgaggtacccggtttgtctcattgggacggttagacagtgggtgcagcccatggagggcgagtagaagcagtgtgaggtgtcacctcacctggaagtgcaaggggtcgggggactccctcccctagccaagggaagccatgaggaactgtgcagtgaggaacggtgcattctggcccagatactacgcttttcccatggtcttcgcaacctgcagaccaggagattcctccagtgcctatgccacaagggccctgggtttcaagcataaaattgggcggccatttgggcagacaccgagttagctgcaggagttttctttcataccccagtggccctggaacaccagcgagacagaactgttcactcccctggaaagggggctgaagccagggagccaagtggtctagctcagtggatcccacccccacagagcccagcaagctaagatccactggcttgaaattctcactgccagcacagcagtctgaagtcaacctgggatgctccagcttggttggggaaggggcgtccgctatgactgaggcttgaataggcggttttcccctcacagcaaaacaaagctacaggaagttccaactgtgcacagcctactgcagattggtaaagctgctgtagccacactgtctctctagattcctcctctctggcagggcatctctgaaagaaaggcagcagccccagtcagggccttatagataaaacttcatcttcctgggacagagcacctggaggaaggggcagctgtgggcacagcttcagcagacataaatgttcctgcctgccagcgctgaagagagcagcagatctcccggcacattgattgagctctgctaagggacagactgcctccttaagtgggtccctgacacccatgcctcctgactgagagatacctcccagcaggagtcgacagacacctcacacaggagagctctgactggcatctggagggtgcccctctgagatgaagcttccagaggaaggatcaggcagcagtctttgctgttctgcagcctctgccgctgatacccaggcaaacagggtctggagtggacctccagcaaactccagtagacctgcagcagaggggcctgactgttagaaggaaaactaacaaacagaaaggaatagtatcaacatcaacagaaatgacatccacaccaaaaccctatcagaagtccaaaggtagataaatccatgaagatggggagataccactgcaaaaaggctgaaaattccaaaaatcagaatgcctcttcttctccaaaggatcataactcctcgccagcaagggaacaaaactggatggagaatgagtttgacgaattgacagaagtaggcttcagaaggtgggtaataacaaattcctccgagctaaaggagcatgttctaaatgaattgctaactagaataaccagtttagagaagaacataaacgacctgatggagctgaaaaacacagcacaagaactttgtgaagcatacacaagtatcaatagccaaattgatcaagcagaagaaaggatatcagagattgaagatcaacttaatgaaatcaagcatgaagacaagattagagaacaaataatgaaaaggaacaaacaaagccaccaagaaacatgggactatgtgaaaagaccaaacctacgtttggttggtgtacctggaagtgacggggagagtggaaccaagctggaaaatactcttcaggatattatccaggagaacttccccaacctagcaagacaggccaacattcaaattcaggaaatactgagaacaccatgaaggtactccttcatgagaagaacaaccccaagacacataattgtccgattcaccaaggttgaaatgaaggaaaaaatgttaagggcagccagagagaaaggttaggttacccacaaagggaatctgataagactaacaacgtatctgtctgcagaaaccttgcaagccaggagagagtaggggagccaatattcaacattcttaaagagaataattttcaacccagaatttcatatccagccaaactgagctttaaaagtgaaggagaaataaaatcctttacagataagcaaatgctgagagattttgtcaccaccagttctgccttataagagctcctgaaggaagcactaaacatggaaaggaacaaccggtccagccactgcaaaaacataccaaattgtaaagaccattgacactatgaagaaactacatcaactaatgggcaaaataaccagctagcatcataatgacaggatcaaattcacacataacaatattaaccttaaatgtaaatgggctaaatgacccaattaaaagatacagactgacaaattggaaaaagagtcaagacccattggtgtgctgtattcaggagacccatctcatgtgcaaagacacacataggctcaaaataaagggatgggggaatatttaccaagcaaatggaaagcaaaaaaaaaagcaggggttgcaatcctagtctctgataaaacagactttaaaccaacaaagatcaagagagacaaagacgggcattacataatggtaaaaggatcaatgcaacaaaaagagctaactattctaaatatatatgcactcaatagaggagcacccagattcataaagcaagttcttagagacctacaaagagacttagactcccacacaataatagtgggagactttaacaccccactgtcaatattagacagatcaatgagacggaaaattaacaaggatattcgggacttgcactcagctgtagaacaagcagacctaatagacatctacaaaactgtccatcccaaatcaacagaatataaattcttctcagcaccacatcacacttattctaaaattgaccatataattggaagtaaaacactcctcagcaaatgcaaaagaacggaaatcataacaaacagtctctcagaccacagtgcaatcaaattggaactcaggattaagaaactcactcaaaaccacacaactacatggaaactgaacaacctgctcctgaatgactactgggtaaataatgaaatgaaggcagaaataaataagttatttgaaaccattgagaacaaagacacaatgtaccagaatctctgggacatagctaaagcactgtttagagggacatttatagcactaaatgcccacagcagaaaacgggaaagatctaaaatcaataccctaacatcacaattaaaagaactagagaagcaagagcaaacaaattaaaaaggtagcagaggacaagaaataactaaaatcagagcagaactgaaggagacagagacacgaaatacccttcgaaaaatcaatgaatccaggagctggttttctgaaaagatcaacaaaatagaccactagccagactaataaagaagaaaagagagaataatcaaatagacgcaataaaaaatgataaaggagatatcaccactgatcccaaggaaatacaaactaccatcagagcatactataaacacctctacataaataaactagaaaatctagaagaaatggataaattgctggacacatacttcctcccaagcctaaaccaggaagaagtcgaatccctgaatagaccaacaacaagttctgaaattgaggcaggaatgaatagcctaccaaccaaaaaaaagtccaggaccaaacggattcgcagccgaattctaccagtggtgcaaagaggagctggtaccattccttctgaaactattccaaacaatagaaaaagagggactccaccctaactcattttatgagaccagcatcatcctgataccaaaacctggcagagaaacaacaaaaaaagaaaatttcaggccaatatccctgatgaacatcaatgcaaaaatcctcaataaaacactggcaaaccgaatccagcaacacatcaaaaagcttatctaccacgatcaagttggcttcatccctgggatgcaaggttggttcaatatatatacaaatcaataaacattatccatgacataaacagaaccaatgacaaaaaccacaattgtcttaatagatgcagaaaaggccttcaacaaaattcaacagcccttcatctaaaaactcaataagctaggtattgacggaacttatctcaaaataataagagctatttatgacaaacccacagcccatatcatactgaatgggcaaaaactggaagcattcccttagaaaatgggcacaagagaaggatgccctctctcaccactcctattcaacatagtattggaagttctggccagggcaatcaggcaagacaaagaaataaagggtattcaaataggaagagaggaagtcaaatgcctctgtttgcagatgatatgactgtatatttagaaaaccccatcgtctcagttcaaaatcttcttaagctgataagcaacttcagcaaagtctcaggatacaaaatcaatgtgcgaaaatcacaagcattcctatacatcaataatagacaaacagagaggcaaatcataagtgaactcccattcacaattgctacaaagagaataaaatacctaggaatacaacttacaagggatgtgaaggacctcttcaaggagaactacaaaccactgctcaaggaaataagagagaacacaaacaaatggaaaaacattccatgctcatggataggaagaatcaatatagtgaaaacgtccatactacccaaagcaatttatagatacaatgctatccccatcaaggtatcattgactttcttcacagaattagaaaaaacagtgctttaaatttcatatggaaccaaaaaagagcccatatatccaagataatcctaagcaaaaagatcaaaactggggacatcatgctacctgacttcaaactatactacaaggctatagtaaccaaaacagcatgatattgttacaaaaacagatatacagagcaatggaacagaacagagtcctcagaaatcataccacacatctacaaccatctgatctctgacaagcctgacaaaaacaagcaatggggaaaggattccctatttaataaatactgctgggaaaactggctagccatatgcagaaaactgaaactgcacccccttccttacaccttatacaaaaattaactgaagatggattaaaaacttaaatgtaagacctaaaaccataaaaaccctagaagaaaacctaggcaataccattcaggacacaggcatgggcaaagacttcatgactaaaacaccaaaagcaacagcaacaaaagccaaaattgacaaatgggatctaattaaactaaagagcttctgcacagcaaaataaactatcatgagagtgaacaggcaacctacagaatgggagaaaatttttgcaatctctccatctgacaaacagctaatatccagaaactacaaagaacataaacaaattttcaagaaaaaaaaaaacaaataatctcatcaaaaagtaggtgaaggatatgaacagacacttccctaaataagacatgtatgcagccaacaaacatgaaaaaaagctataatcactggtcactagagaaatgcaaatcaaaaccacagtgagatattatctcatgccagttagaatggtgatcattaaaaagtcagggaacaacagatgctggagaggatacggagaaataggaatgcttttatactgttggtgggagtgaaatgagttcaaccattgtggaagacagtatggtgattcctcaaggatctagaaccagaaataccatttgacccaacaatcccattactgggtacatacccaaaggagtataaatcattctactataaagacacatgcacacgtgtgtttactgcgacactgttcacaatagcaaagacttggaaccaacccaaatgcccatcaatgatagactggataaagaaaatgtggcacatatacaccatgtaatactatgcagccataaaaaggatgagttcatgtcctttgcagggacatggatgaagcaggaaaccatcattctcagcaaactaacacaagaacagaaaaccaaacaccatatactctcactcataagtgggaactgaacaatgagaacacatggacacagggaggggaacatcacacactgggcctgtcagggagtagggaactaggggagggatagcattaggagaaatacctaatgtagatgacgggttgatgggtgcagcaaaccaccgtggcacgtgtatacctatgtaacaaacctgcatgttctccacatgtatttcggaacttaaagtataataaaagaattggctgggtgcggtggctcatgcctgtaatcccagcactttgggaggccaaggcgggcagatcacgaggtcaggagtttgagaccagccttaccaacatggtgaaaccccatctctactaaaaatacaaaaattagctgggcgtggtggcaggcaactgtaaccccagctactcaggaggctaaggcaggagaatcgcttgaatccgagaggtggaggctgcagtgagccgagattgtgccactgcactccagcctgagtgacagagcaagactccatctcaaaaaaaaaaaaaaaaaaaaaaaaagtcacatattgtgatcataacagaggtaggtgtttgagctggtactcttattctgagaagcatccattggctttgatacaaattttattgttaaaaatgatttgaaaattgaaaattgtcttgcttgatttccctactatctttgaagtattttcagttcaatactttgaaatatttcagggttcaataaatcaatgagacatatggattatctagggagaatctatttgtttctctaggccattgaactgttggaagcacattaattattcatgatttcttctgattaacaaatttgtactatctgaaatacatgttcagtactattcaatactttattaaaagttatattatttactcctaaaaaccagagttgggtacataattatttcttttgttagcattttagagatataaaaggggcttatttctaataacaacgaagattaaccattacacaaggcattctagaaatgagtggtcataatatcacattttaaataattgaaaaacgtatacaaatatatgttgcccaaaataaagcatgacgtcaaccatctgttataatataacactgcattttcttacattctctaggtaaacattatagggactattatgtaaaaaaattccaaattattctaatagctctattcttaaaaccattaagaagattatctctgtttttaatattcaatataataaatacaatttgagtgcaaaagtttaaaaagttttatactatattttatataataataacttatgctactttactctcctagtattgcaagctaaaatcttttaataccaaagttactgaagaagagaaaaatttttaaattaacactttaatatattctgtcttccatctcttagacaacctgttgtcaaattctggcatctcttcctacttcttcagatttgacttttctttggattcatattgcataccttacacctgcaataaattatatatacctttaatatgcttattccttgtacataacagctatagctactgttgggctcagaacatgataccctgaaatatggcactttggcaattgagaagactgcagaagcaggaaggttgcttttactttctcctccctttttcttctaaagaacattcataaagagttatcgacctatctcacctgaatgtaggtcataagaacctcacaccacacaggtcctaccctatacccagaaactaagaaaaatctgaacaaagaggtcctggtaagttccttccagtttattacaaatagttcatatccactttttgtccaattatacatctacacaactgttcattcttcattaaacttaagtataaaaatacaattttttctggttctttgggtcttcatttctgaaggctcttgtgtcatgcaaaactttggttaaatacattatgcatttttcttgttatcttgtcttatgttgtaggagtgtcagttgtgaaccttgtgatgggtgaggaaaagatacttctttttctttcctagaatactcaatacatgttatatgaatgaattgctcatctgactttcttcctggcctctctactcagccactgaatctctggggacctagtgtaagaagacagattttccatgtatttctagttcttttttttttttttttttttttttttgagatggagtcttgctctgtcacccaggctggagtgcagtggtgcgatcttggttcactacaacctccacctcccaggttcaagcgattctcctgcctcagcctcctgagtagccgggactataggcgcatgcccccacacctagctaatttttgtatttttagtagagatggggtttcatcatgttggccaggatggtctcaatctctttacctcgtgatccgcccgcctcagcctctcaaagtgctgggattacaggcatgagccactgcacccagccatatttcaggctttaaatgaaatggaatatatattttttaaaggtaagtttaaccagaatacatttattcatgggaatttttttatttacacccatttgaagactaagctacatttgaaattgatatcatattgcataaacatatgaatacatgtatttgtctaacataaagtcttcaataaatatttagtgaatgaataaaagtatgttatactcaacataaatgagtttaggtcatttcctgatgactttgaggggtcacagatgtgctggtgctttccttgacacaactttctcttacccctttagtttaaatatatatatttaattattttaaaaatagagtttcatattttgagttttatttaataaaacagatcatcaaactcataaatgaagcttgtaaaacattttggaatgacttcatccacaaattttgaggaatgaaacaaaaaagaaatggatattaaaactcttaagaggccaatcaaccatttgtgttttgatattattagcaccccaattcaaacacacaaaaggttaaaaaataaattataaaacaactggggacatttggacatcaagtgggtcttggataatattaagcaattattgtttgatattccattaggtactgtaatggtattttggttattttttaaagttgttatttttacatgcaatatattaacagatgagatgatatttcttagactttcttcaaaataatcctgtgtgtatatggggagtgaatgcttggtatagaaggaaatatggttatttgttgataggttttgaagttgggtgataggaacatggatgttcataacaccattttctttacttctgtatatatttgaatttttcaaaaataaaaaggtttttttaatcatgctaataaaactatcagaggaactttgaaaacattggattcttgagataaagtggctttccagaaaaaaagtggcatgaaataaaatgctctcatactttgtttaactgatgtactttatttaaatatctttactatatattattggtttcctagttagctatgccaatatattagatggtggaatcatgacctatagctagctgagaattttaaattttactgactttattgactccatactcttcatggacactaatttagtcagacaagttacagaactccaataacgtaataaacatgttaagtgcctagtgtattaaatctcttctgaaaatctacctttttgatgattttgagcatggatttctaataactgaatgccatagtgtcaaatgttgatttggtcaaagatactgtttttgactggatcaagcaaaaacacttcccaaaatgcagcagcagcacaatctgttatattgcaatgagaaaaaaaaattggcaaggactataaaagttacttaagaaagaacttcacaaggagatgaagcacaaatggaaatgcctcagaaagtagaatgtagggcaaatttctaaggagatcacaaagaaatagcaaaagcttgtaggagttgggtcaaaaaagctcagcaggaaacaggatgccacatctaagaaacatgaaaggaaacagaaaaaagaattcttttactatttcaggaacaaaagaaagctaaatgacacactttgctccttcagtgaagagaaaaggaaatctaatggtccatgatagtaaaaatgcacatgcaattggtaatttaaaaaaatcctccttaaaagaaagataaagtagaattatcgagcatttattgagaggtgcaaaatttaaggcgcaagaaaatatttaaaaaattaatctaacataacttaaccattatgatgtgatttatatgcaaagatacctaaaggattcaccatccacatataatggaatattatgcagccaataaaagttattattaataatattaaaaaagttaataatatgatattaagtaataaatgccaaatcatgttgttgtctggaagagaatcgtcaaattgtcaacagtagtttttgctgataatattactggtgatttttatttttgtcatctatttattcatttgttggatattctgcaatgggaattacttttataatcaggcataacaataaaaatattattcaaagtacctactgtagtctccaacagttcaattccaagtagtccatttaaaggactcttgttaagttgccaataatcactgctttgataaatcaaatggatacttgctcttatttcctggctctgtgaagcatctgacttttttcaatgttccatgctaaaattctctgctcccttggcttggtagttctaatttaaccatgcatcagctgtcacctggaagactgcaatggctggctgtctttactacaagccattctgtcaattaccaccagggcaatcctgaccacattactccattgcttttgcctcttcaaagacttatcttacagaacatagagggtgagttgctctggatgctttctgtttttttttgtttgtttttgttttttttcttttttttaaattttattattattatactttaagttttagggtacatgtgcacaatgtgcaggatagttacatatgtatacatgtgccatgctggtgtgctgcacccattaactcgtcatttagcattaggtatatctcctaaagctatccctctcccctcccccaagctttctgtttattagtgacccaatgaaaagaaaaggacaactttgggtccagggattgtaaattgtgtcctcaaatctctatttcttgcttctgttctctcttaggtagttgtatctcataagcaaaagagcttcctctcagtgacagggatgagagggcagggccacagataattccaggcttatatcatcctacctagcaaccccaaagccaagggagatatcctctctcccattctctgtgtatgaaatccaaaggaaagtctctggttgactaacagtaccacacctaattgctaaggccaagaatgtgggcctgggtcataggtccaatctgaacggagagatattgtactatgattggtagcctgatcagaactacagcacttggaaggtccaagggtaagtgcttcaaagaaaatcagggataattaataacagaaaagagtaaggaatattggaaagatgaaaaaccaaatatcctttataaaaagtaatattcaatctccttagcccaacactcttagaatttcttggattggcctctgctcatgtttcttgcctcatctttcgccattccctcccaagaactccagtttctaactatgccaaacacttggatcttttctgaataggcagtgctaggcagaatagtggcccccaaagatgttcatgccttaatcctaggaacgtataaacatgttaacttgcaagacaaaagatacactgcagatgtgattaagattaaggactttgaaatggaaagatcatcctggtttacctaggtgggcccaatctaatcacatgagtcctcaaaagcagagaatctcttccagattcagataaccagaaatatggcaatgtgaaaagaactccatccaccattgctggctttaaaaatggaggaagaggctacaaatcaagaaatgtgggtggcctttagaagctggaaaatgcaaggaaatggattttttttgaaagcctacagaaagtaatgcaatcctgttggtattttgattttagctcaatcagacttttgtctcactttggatctattacagaactgaaagataataaatttttatcgtttaagcttccaagtctatggtaatttgtcacagcaataagaagaattatacaggccattctatgtcatgctttcttgattttgtactttctggtcatttcatgtaaaatatctatcttccacatctatcttccacactgatgcaccccgctcaatcccagcccacttggtgaactccctacccttattcaaactataactcaggtttcactccttctctaaagccttccttagcatcactcctaggaatatgtgactcctaggaatacttttttcttatggccacacagcactctgcattcttccgctatagtatttaaagtgctgtatgaaatttgtctcagactgtaaatttatattaggccagggactatatcctattcctcaatgtatatcacaggtaaagcatgttgagcacatagtacattttaataactgcttgtgtatgcatgaaaaatcattgcactggttactcactttgagatttatataggaatgagaaagagttgaaaactgaaaaaggtccagcatattttaaaaagagaacatgaatatagcactagggatttaacttctactgccacaaaaatgttggaaatcaacgagtagtaggtcaattgtcaaataacttgaggatagcaggtacatttttattatgagcaaatcttgtctaaattagttgtctaaactcttccttctacatcagtaactgaactgataaatttgggagtaagaaattggttgtaatcaatctttcttgatgtgacaaggctttagattgaattctaaagatcaatgaacttggaaaatgtggtctcttctctaatggcattaattaataacatctaatattatcacctagaatctggccaatacatttacatagaatcagcctgcaagagggtcctcaaatgattcttggcttctcatattcactcccttatgtagtccctcccaatactgaataggtctaacctgtgtgaccaatgggattttgaaaaagtaacaatgtatgatttctgaagatagatcttaaatgaattgctggttccaccttacttttttgaattgctcctacttctaggggatgatagataccatgttgtgaggacactcgagcggtcctgtggaggggcccattagagaaaaactaaggtcttccagcaaaagctagtactaaattgccagctgtttaagtgagccactttcaaagcagattccccagccccagacaaactttcagatgactgcatccctggccaattttttgactacaacctcataagagaccttgaacaataattacttagctgatccactctcaaattcctgacctgcagaaactgtgagaaataaataaaagtctattactgtcttaagtcatgcagttttagataactagttttagataacatgcagcaatagataactagtattctgcctatagaataaaatagacaaaagtcactataaactatttcctgtgttgttagccgtggttttttaaaaacaattattatcctttcactttcagccctagtcttccaaaccaataaacaagagtcttagaaggaagataacttcaaggcacatctgctccttttagattttatactaaaaacaaaataaagagccagtcttattactctactgccaattctcggtaataagtgacatttcctcctcccttgtgtctgtatttttttctactattgaggcacctgaaattggatgatgagatttccaatgtgcccttagaaaatgagaaagacatgacacactgtaactctcctccttataaggctcaggaaagaaatatacctttttgggcctctctattttcctgacagaaaaagagagagagatagaaggtagaaaagctatctgccatccttcagctatgatattcctgaggctcatcatatttttcttattttagagagtctgtagagggacacgtactcagtgtgttatatttgctcctttatgtgtgaccatcacagagcaaatgtcttgatgtcatctcatcaaaagcatcagagatgcttggagcagggagaagaaagggggtaggaagaagagagtgatgaaaaagggcaaaggaagaacaggagagggccaattgtgtagaaacagcaaacagcctgacttgttcaggcacaggccagaactgctcctaggctgttgagttaacacagatacactctggttaatgctcttaagaagatgaattaagtgaaacatttcagttctaacaaaagtggttcctgcaaaaaggagagatggggcacaactagaagaaaaatacttgcattctagtttagttcagtctcttcagagaaggtaacatattacagtggaactacatcataaggtaaatttcaaatcagataaaatatttatgattttgagaaaacatttcacatgaatctataaatacctagcctaaggtttactgctaccatcgtttacaggttaattagcgcattttgcagccttgccataaatctgcttccatttagatagaatggctagatggttgtctttagcatcctgaaatttaatagtagaactatgtagcagattctagtctttctaagcaggaatgacaaaatagtttcaaattattatttttttgtcatcatatgactggtaacatgtcattggcacttaaattttatgagtgtctatttattaggctacagaaataattttgttctccattgctctatgtataggtggggaagctagtgacctcttcaggggtggtttcagaagttaagggggtgtagccaaaacctggtgttatctccttagcttgtctaaattcaggaaagtcactggagaataaaaaagaaccaattttactataagacaatgaagattctaggcagttcttagaaataggtaagaaatctaagctccacaagggcagaagtctttgctctttttctttcctatgcactcaacaagaatttcttgactgtatgaaggagccagggaatgctcagaagaatctgtgactcatcaaaaggtaagaggcactgctgaataaggaaatagagtggagactgcctctctatggagtgccatttgagaagacatctgaaagaaagtggagacacaggctacctggaggaagcatgtagcaggcagtgggaacagcaggttaatggccctggtgtggcagtgagcttgacatgttcaaagggcaataaggagggctttgacatgcaacagagtaagggaagagagagtggcaggaaataagcaagagaggcaggtgagggcctgatcacgcatggtgtaggaggtcatcataagaatgtaggattttattctgaatcatagtaaggtgtcattgattaaagaatgtggtcaggccagcagaataagtattaatagtccatgacagtgacagactgtctttgaaaaacattatttcctgagtggaaaaaaaaaaccctagaaactgaagatacagtcaagtatcctatgagtactgaataaatactcttaactcactggtaggtggatgtgtttgaaaatgattactaaggaacatactgtgttattattcaagctatcatgatgggtatagatttagttttttaaagaaagcttcttatttctggaacagttgaataaatttattataatttccagagacccagtccttaagcatggagttattttagtgtaatgccaacacgctcctgtcttggtttaggtgagctttcaggtgtgcaggcaatttgcatgataaattttgcatgtatacatctcctctctcctttgctgcaaaggaagccaagtagtaaacagtctttcttagtaaatgttttgctgaaagaaaacacacatttacaagtcaaatcatgtgaaatctttgataaggaaaggatgatagcaaggtttattttacagtttatgctgaaaattttactgggaagaaataactaggctggttatttccagttacacaataagcagttactttttaagagctactgtgtaaaataaacactgctaagtggttgtaatatttgacttcattcattcattcattcattcatttatattaactaacatctattatatatgtaccatgtaccagggcactatgctaggagccaaaaataaaagaaaaattttaattacagctacaaataatccacagtctagaagaactcaacagagtacattggcttcttctaattccaaataaaaatagggtcagcatatgtcttcacactatgacaattggcaatagactgttaagcttcggctttctctttctatttcctcttctgcctttctgctgtgactttgtaatcaataggactattagcttaactggatacatcagctaataatccaacaggacaaatgcataattcttagaatcagtttagatggttgcccgcagcccccttctactcatcctctgaaaatgctgtagagttcactccagtgacctaccatccataaaccctctgtggctgttcagatgtttacacacattggctacttcacagaaagtcctatctctctgttaaaagagaaagtatatgtggctgaaatgatggttagttctcatttcagtacttggacgtcaagcagttagtttactgttgcttttgtaacttggaggcattccattctatactgaacacttctttggataaagttctcatctttctaacacattgttagattaaaatagtaatggaaaagtaataatctctccagcctacagacagctcttatgccactacatgtctatagtattgatataacatttttataacatttctgtttcagttatctattgctgtataacaatcaacctaaaacaacaaacactttatttccttgtgatattacaatttgggctaggctcagccaagtgcttcttctgttagtcttgtctgaggttactggtgtggttgtataccaccagtcatgccacttggggacactaggacatctgtatttgtctttattcctgtagtctcaggcttctccctctccaagtgtcctacatcctctccacactctctttctgcaagttggatgagcctcagacttctcaagagttccaagacttgttaaagcttagccccagaattaaaatacattacttctaccactttctattggtgaaagcaagtgaaagagccagcctagattcaaggtgaggaaaccacacaggaatgtgaatacttacaggcatggttcagtggaggtctctaatgtaacaactacacctaccttgactcaaataatctgtaaacctgcattagatctttagattgataaagagtttcaggagggtagggtgagctccttaccaaggggccatgatcagagtcctacctcttttgcgttgcatggttccaacaacacttcatttctagaagtcatcttacctttactcatcctgggccctttgtctgggacagcttttctactttctgacatctattgaagtctttcttctcaaaacttcaagctcaggctttatctcctgccagaagcctttcctgatgctttcaggttctgttaagacctgcttctttctttttttttttttttgagacggagtctcactctgttgcccaggctggagtgcagtggtgtgatcttggctcactgcaagctccgccctccgggtgcacgccattctcctgtctcagcctcccaagtagctgggactacaggtgcccgccaccaagcccgacaaatttttttgtacttttagtagagatggggtttcactgtgttagccaggatggtcttgatctcctgacctcgtgatccacccgcctcagcctcccaaagtgctgggattacaggcgtgagccactgcacccggccaagacctgcttctgagattctaaaatatatcctgtgtttatctctttcacggaacttattatattgtagtaaaatgtctgggcatttgtttatgagtttgtttcaccagctagactgtttacaatctgaagtcaggcctgagtcttattaatgtgattttgtcattctgtaagtgcccagtaataacatgttaaaagggaactggaacaggagaagtgtatgttgtataatctgatgtcaccccaaatccagcataattcaatgcatatattagtggcttaataaatattggacggttggttgaatacataaatctatttctgttagtcactacataagagatataaactcttattttggtaacctggtaaattttcagcaagcttcataaacatttcaattcctagctaggaaagaagcaatatgccttgggcacaacttttcaagtaatatcaatgtttagcagcatcaacctttcaggcaggtgtaaatagctaaaaataaaaattcatatccttctgaaatgctggctaaatttctgaaggaatgtattcatgctctgaaacacaaaaccgttctcttgcttctataaaacagaacaaaacctgtgggaaaccaaattactttgctaagtgtgacaaatccaaactgctacagagcaagagataacataaattaatgggtcttggaggcaaacaccaggagttattttgaggtgagtgaaatccgatctccatcctaaaaccacactgtgtttccatggatcaagtttttagttttatgctttttagaaaactatttatgcacaataattacagccacctgaatgccctaaataaacgtagcccagtaaatgcaggcgtgtgcttgaatggtgccctattgctttcaagtactttgtagtgggctgcatgtctgttttgacgattcccccctaaaacctaaaggcagagatgctggaagggtttgcattaccaggtgacacagtgcttgactttgataagccgttgctaaggcaaagaaactcctaaagccttattgagggtagcccgtggaagtctgtcacactgtcttatattatttttctttggatacaagccatttttctaatttaacccttgattttcttgagggcagtaaagttgtcttaggttcttttcacacagagagtgtttagaaatgtttgtggttgaaatgagtacccttctggattatgtttaccccaaaggagatgcattattttattttaatcagtgttaaagataatgtataggaggccattggataccactgagctcttgtaccaggccccccccaaaaagaaaaacaaaccaaaatggagtcactcatgctaaagttccacatcaccaagcaaaatctaagttgtttttctgaccttccaagaaaccaagagagtgcgagatgatggccaaatctctaaacaagccagttttagctggcaggattagaaattcccctttactttatcctttacaaggaaagtaacatttaaacaatcagtctgctttttgttttctatttttgctttcctcagcccttttctgtgtataaaccaatgtcctcttgctcacctcatcataatggtcattttattttagagaatgaggtactgcctgtccagaactgcaaataaaagcttattaagatctttatactaaatttttttgttgttgttgaaacttaatcttttgacaattctggcaaccaacaaagggacccaaatgacactgctgatgaatcccaagacctcttggggaacgcaggagagatgttactgagcccttttcaggtcccctgtcttcctcacggagccccagtctgttcctttcaggttggactccggtctttttgcactgaatctctggagcttatcagctttcatttgggggttactttgtgctgtaagagagcatttgaccttgaggtgccaagggttagtctgtgctctgagaaggtgcttgacctttgggtttgtgctggctgatgagttactggcaggagctgcagttttaaaggtgactgacaacagttgcagtaagtggttattactgcagggagtcagaactccagcttccaaaattcgtagagatttggtttctatcttcttaattgctttgtcttgagcacttagttgaggcatgcctcaggtgtctgacagggtcaggcagaaactggaaaattattggctaagttggtcaaaggcatctcagtgccaaagccacaatttgatcagtgggcatgatttgggcacttgagagctattagagcaacccaccaccaaaagataagactaccatgaaaggataagctgcatgtaaaatagggtagcacctatcagcctctagaaaatgtccgttcaacaaggtacgctgtgaaagcattatataacccaatgtggcacttccctcttaggctttgatttagactctgagagactcaacattcaatataaagatagttcctaatttataaaaaaactgagcactccacctttcagccacacttgccttttacactttattaggccccggaagcttcaaatacttacaaaaatggccaaatcttactaaagatactttagaatgacaatggccattatatagcatgtttcagatgaacaacactgcatttaagatgtgcatatatcaatgagggttctcaaattaggccaaacccagatgtgcagaagtttctaaaaagatttcaaaaaaaaaatttaatgggctcttttcaaagattgttttacagaaatcaagtgaaaagtttaatgattaattgataagaaaaattaaatctactatccttttcatttagttactcttccaccccgaaggtaaaaagaaagctaaagtgtttctaaaggttaggatctcaggtcaagcaggtttgcttcttttttagagctatccataccgagtccaggcacagagaatgttttctttgccccattctctaatgggctccactctggagtcagtaatgtagttaagaaacaagctaaatggaaaatatagcctattgaactagatcagtctctgaagtacacccttctggcatttagctggctatttggaaactttttgtaaaaaatttacatctataaagaaaaatcactagaaattcttaaagtgagagagagtactggtctaaacaagcctgacctttgatgagtttgtcttaactgggcttcccacctacatctttctttgtctagggtgaatggactcttagaagaatgatggttacgacaaggtctgtctggatttgtagatttcctctcctgtgacaaatgttaatcttccctggttgctggatctgtctttaggcaaataaggaagaatattcagaaaaccctgtcttgcattgtgctattctttaagtgccttcagttcaaagtaatcaatataccaaagtgacatattttggggtgcgattttctgaactactttaatggctatgtagtttaagaagcaattcgagcatgaatgttaagaatgagtaaatttacataaatgtaaatggtataaaagtttatagctgaacttgtcatagtttaaaaagtctttttcagtaactttaactcttaaagtcatgttaaattaatagatatttatgaaatatcagtcattcttaacaaaactaaagtattaaaatattaattgctgaacataagcttaaaatgtatacactttgatatcttgtttttatatcatatagaagagctcaacatatttaagtctgttagtaaacatgaaaaaattgttatatgaggaagcacatgtttctagaaagtataaaatttgtattcctaaaatgtttttgacagacagctcaaaattgcttacttcttaagattccactggaagttaaacttactaagggttaaaaattccaattaatatatgaaagctaaaactagaaataataaaggaagtaactccaaatatgagaaaaataagtaatatttttgctaaataaaactatgaggtatgaaagatgtgtttttgttaaggaagaaagagagtaatttttctcctaagtagaatgactagtttttccaaagtagaaaaagtattgaaaacacaactgaatgaataagaaatttgtagacagtttgttgaagatgaatcttgtgaaaggaactctataagggtgatcaagctggctaaaatgagaaaaaatgttatccatatgtttttctaagaattgagtattaatatcaaaagtatactgatataaaactagaatttgatctcctgtgttaaaaccacaaggttttctggaattattgatctgttcttaataggaaatagtaaaaagtttttctttatttttttaggtaacttgcctagaaagcaaagagtctgtactttatcaagatgattctgtgtgctttgtattgtctttattaggtctttgatgactgagaaaactgaatcctctctattaaagagctaagagtttttcctacaactaggtaacttactgtatttgcctttagagtcttttaattattactctggttaaactaatgactataacttcacagtgatctgtgatcctattttgatcaaatgttttaaaccatttgacattttttataaactttccaaaataaactaaattaagtcttcttgaccttgaattaactttgggaaaacctcaaaggacgtgtctctcaccttttaaaagagagatattaaactagttaggcttatttcatatgttaaattatatggggagtgttccaacaattgtatgtaatccctagaaatatatcagtcctaattctggttattgtgctaaaatgttgtatgctacgggacattgaatatataagtttctgataatgttaaggtcataccattggactgggtgagaagttccagaactctggtgaagaaactggaggcttcatgaaactgccaaccaagatcaagcagagcgagatttacttatgtaagactgaaaaactgatgaagaagagttatggttttttatggctttttaatttgaaacattacttgttattttaatgttttattttacagatttaagaaaagcttttttttaaacctatctatagctttcagcaatgtggtaaagtatacttttgtgaacaaaagttaaaacatttactttttcctctctatttgatctttccagaattcagaaactatttgtgaggattcttgtttttatggcaatatggttatttgcataaattcaataagaattactctctttataacatgatacaattggaaatactggttgcattactaaagcattgactgggatgtcatacctgagaatgcacatagaatgactctgtaggtactgtgggtaaagtctgaagtctgccttggtttggtttcctatcttccagaggttttcaaaagtccaatttgagattccttattaaaggttccagcaaaacaaaactcggaaagagcccaagtggtcactactttttctgcatttatgtaaataatcaggccaagttggatgagattaaacttattttgccaacaaattagtctcactccattttttgtaacaatgagggtgactctagagagaaaaattgctttagaagaaaaactgtagtaccactgttactagattgtagcctctttaactattttttgagtttttactatctgcctgtggactggactggatcctgaatttgtctagtttcctccaatatctggctctgaaaacaagacctgctctctttcttaagccctgtaagatgaagctagacaactcaatataaatttcaagaaacaagtctcatgcttgatgtgtgggccatacagagagttcaccaaaatgcccaatattgtaaccagagacattcaaactataaacaaggatgagaacttgatgatttcatgttgtggacagtgacagagcaggagcatcaccatcttggataagcactgtcattttaaagttcaccttgatcaaaaactgcctaaatccaaaggacatcagcctaatggctaaggtcagcctgatcacaaaccacaaataacatctctgaccaaaaacattccaaaccccttcccggcaagagacatgccagccctcatataacctcccctctggccagagagatgttagccccaagataacctcccctctgaccagagacattccaaccctgccataaacttctcccctacacagaaacattccaagcctgtgataaagctctctcaccctaaaactaataaatactcttagtccctaagagagaatgctcctgaccaaaattggccagaagcccctctcaggtttagtctccaaaataaacctttgactgttgagctacttttcgtgtttctttcctctttctttaactcttatatttggtgccaaatctgtaagagagaatgttcctgaccaaaatcagccagaagcccctctccaaaatatttattctccaaaataaaccctgtctttgacagttgagccacttgtcatgtttctttcctctttctttaactcttacagacagcttgtgcccagatgccaaaacaagactctgtatcataatgaaactcttagccctcttaatttttttcttatttatgcctaccattttttgctcagcaggatagacttgtagtaattttataatcagtagcttcttcaagtaacttacaaaattaaatcagattggtcatgtcaaacccagatctttacaaaacctaagggatcctttagtccacccagtgggtaactttggcaatatccctaatgcaattgctgttcaaattgtactagtgttcccttttatagggtaaaacttctagactcacatgtttttactccctgccttgctgacacttcttattgcacatgtataaatatagaaagtattgtagagactccattgcaaaaagttagcaaattggctacttggttaaaatgggtagattccttttctggctcattctttgttctattcaattttagttggtttggttcattaagaccctggctaaggtgcatactccaaactcttggcattcctaatatccttggcattatcgccaaaattcagaaactatttgtgaggataatagcagtctccctggtatactgcattccctcaaaagttttaaatgtttgcatgcagccatctctcaaacttcaaatggtctctattcagctattcagtcggtgtataacactaatcacggtttttgccattaaaagcaatggcaaaaaccacaattattttgcaccaacctaatagaatggcaaaaactcaaagaaatgcatgattatgaggacactataagctatgaatggcatgttgacttcagaaacccagaatggtggtaacttagggctaatgcccctgggggagcatgaccaaaagggggaaattgttaaagaaaatgtataggaagccattggctagcactgagctcctgaactaggcccaacagacccaattaaaatggagtcagtcatgctaaggtgccacatcaccaagccgaaagtaagttgtttatctgaccttccaagaaaccaggagagtgagagataatggccaaatccccaaacaagccagttttagctggcaggattaggaagtcccctctgctttaacctttagaaggaaagtaactttaaaacaaccagtctgctttttgtcatctatttctgctttcctcaactcttttctgtctataaacccatctcctcttgcttagctcatgggaacactgattctactttataaaatgtagtattacctcatcctagcattgcaaacaaaagtcaaatacaatttttaaactgaatttgttataattttgtcttttgacaccaggaaggacccgctccagttctgcctactacttgatcattctcctctttggattaaagctgtgtgaaacacaagaatgatgttgaacacatgacatcaagtggagggcaagccatgctaatttttgtggactggcccattgaagtggtattgagctagaattatagcctgtggccagaggagacctggagctcctttgccttgttattcttcttttcctgggggattagcaacccaagcagacagtttctttccttccaggaaaaccccaaacctcttggtgaagtgacaagaaatattcaccccagcgcacatcttcctaagaaggcccaaggcagaatgctagctctctcagtagttcccaggcaattcaatctgccacaaagtacaatgtagagcactgtgctacagggaaaaacaagcaaacagaaaaggaaaaaagtccattctgcatactgattttgtctaatgtggcatttgcacacttgggcggctacagtacttccgtgctgctgccagattaattcttcccaaacactgctcagatggtatcactcctttggccccaaaccttcactagggttatcgcctaaaaaaggtagcctgggagttaaaagtttgccatggtttggctcaaacttatatttccatgtgtcagtcctattatttcaaattccaaccaacaatcttctataatttttttcgtacttttccatgcctttacacgtgtagagattttttttttttcacttgtaagtcaaaagcctagctaggcatcaaattccaacagctgactttccccctatgcaaacatactctgaccttgccagctgacagaagtatttccctcccctgaactctgctaacactgctttgtcacagcattgcattttctttcttgtctggtccatgtttgttcaatctgctggacctataccagtgcctactgtattatgggtactcaataaatgttcattgaatgaatattaatttttacttattgtggtctttgcattgatggtttctttgtaagccaaatataacatttatactaacttatcatttttgagggtcaaagacaatttccaggtttcaagaaatgagggctctggggtctcttcaacacttgcaggcctagagctggacttgtataccttgagacttccctgctataggcagatgtcattgaataatattagtgtgctctatttacagagtgcctacgcttgtgctaaatcacttcacattcatatccctagttctcctagtgacatactgatgatgcctatctcatttttagaggaaacaaacaatgttcaaagatgaaggtcctttcccagagttgaatgtaaagtgagtaccagcgtcaggattcacacctaggtcagtctggctccaaatctagcttttttcctaccatcccacattccttctttgaattgcttcacagtttctatggaagtttctgctatttctctgtctttgtctctgaggttcatttccactcctgcagcttcacaaaagcccaattacacctgccagtgacctgctttgtctaacaggatttttgatggctatagcgtcatttcagcatccgcacggcctgcttctctctacccagagcacagctcccaggaggtgctggaagcctggcagcgggtcatttcagcagcttgtttttaccacttttcagcacaaactgctttatttcaaacattgctcatcactcacctgcctgcattcccccttcatcttcccttaagtctgtctcataggcctgtaagtagaaattgtggcaactcccgaagtctagcagcactggggaagagtagaaaccttactgtcagacttgctaattgaaaatttggggagaagtccactcagacgtgtctaaagcagattacctttgaagtacttacaaagaaaggttttctgagccttgaggtccataatggggatgtgtatatggagagcgggaaaggagctctttatactcagagagctgaactatttgcaagtgccaaggccttcccttgagtatggttaatgaatcaaatagaaatattatttcaccagttctaacatgcccatttatttttcatcttaacattctgtaatgggaatgtggcttacatagacagtggtagaaccattatttgccaaatagcagtcatcatagttgtttctgccttcacctgagtatcaaatacaccagcaataacatttgcagaataagcaggagcaggggtaggctagctctatgtaattacaaagctcacctaatttagtttttcataggattttagggaatgcttcacatcaaagctgttggtggcacagaggacaatactgtgtggaaaaacttgggcctcaatgaccgagcgaaaattgagtctactcagaagattcagatttggacccagaagaagttttagaaaaatttgaaccaatttacattacttatttttttatgtgtgcccaagaatggcataagattcaaaaaaaaaaatctgtctaaataatatgttagcactctttcactatatatgatataaaaattctagcttatgtaatagttaaattgatgttttcctctgatgtagtttaaaaaaagtttaagcgtacatgggaaataacttatacttttacatcagattggcttgggtttaaatttaggtttcatttcttattagccttgtgatatggtttggctgtgtccccacccaaatctcatttgaattgtagctcccataatccccatgtgtcatgggagggacccagtaggaggtaattgaatcatgggggcagtttttcccgtgctgttctcatggtagttaataaatctcacgagatctgatggttttataaggggcagttcccctgcacatgctttcttgcctgccatcacgtaagacatgcctttgcttctcctttgccttctgccatgattgtgaggcctcctgtggcgtgtggaactgtgagtccatgaaacctcttttgctttataaattacccagtctcatagcagtatgaaaatgggctaataagagtaaactggtaccagtagagtggggtactgctattaagacacctaaaaatgtggaagacactttggagctgggtaacaggcagaggttggaacactttggagggctcagaaaagacaggaagatgtggtaaagtttagagcttcctagagacttgttgaatggttttgaccaaaaagtccaggctgaggtggtctcagatggagatgaagaacttattaggaactggagcaaaggtgagccttgctatgctttagcaaagagactagtggcattttgcccctgtcctagagatctacggaactttgaatttgagagaaaggattagggtacctggtggaagaaatttctaagcagcaaagcattcaagaggtgactttggagctcttaaaagcattcagttttattcattcacaaagatatggtttggaattggaacttacgtttaaaagggaagcaggctattgcttcagagggtgcaatccccaagcctttgtggcttacatgtggtgttgggcctgcaggtgcacagaagtcaagaattgagttttgggaacctccttctaaatttcagaggatttacggaaatacttggatgtccaggcagaggtgtgctgccggggcaaagccctcatggggaacttctgctagggcagtctggaagggaaatgtggggtcagatcccccacacagagtccctactggggcactgacaagtggagctgtgagaagagggccaccctcctccagacctcagagaggtagagccactgacagcttgtaccgtgtgtctggaaaacccacagacattcaacaccagcctgtgaaagcagctgggagcggcactgtatcctgcaaagtcatagggctggagctgcccaaggccatgggagcccacctcttgtatcagtgtgccctagatatgagacatgcagtcaaaggagatcatttttgaactttaaggtttaatgaccgccctattggattttggacttgcatggggcctgtagcccccttgttttggccaatttctccaatttggaacaggtgtatttacccaatgcctgtaccctcattatacctaggaagtaactaacttgctttgattttatgggctcatgggcagaagagacttggcttgtctcagatgagactttggactgtggacttttgagttaatgctaaaatgagttaagactttggggaactgttgggaaggcaaaatggttatgaaatgtgaggacaagagatttggaaggggccaggggtggaatgaaatggtttggctgtgtcctcatcttgaattgtagctcccataatccccatgtgtcaagggagggccctggagggaggtaattgaatcatgagggcaggattttcccatgctgttctcatgatagtgaataagtctcacgagatctgatggttttataaagggcagtttccctgcacatgctctcttgcctgccaccatgtaagatgtgcctttgcacttcgtttgccttctgtcatgattgtgaggcctccccagctatgtggaactgtgagtccattaaacctctttttctttataaattacccacataattcttcatagcagtatgaaatactcaggtatttcttcatagcagtatgaaaatggagtcatacaccctgggaccctgggcatattacaaggtcttaatgagagaataacatttgtagcatgtggctaataattgctatcctgcaagctttattaaatcatttcttttatttgttaaaacgttataaacatttagttttactttagtttttactagaaagttgtaaatacacatttctttttttaaaaaaatctataattttcttttctagttgattttgaagcttcagtatataaagtagcatgtattttacacatgagctttgctgtcacttaactgagtaggaaaaaaccaacagtacaggaagtttgatggagtccaaaatcttagtagagatctgtgggtttccccttaaatattggtgaaaatataggatctgacaaggccctgtcttgtctcttttaagaaggcatagtttgatacaacatcatgccttccaggatttcataactgaattttcatactagaatttttgataggcatatggctgtccagccaaagactacatctcttagcttcctttgcagcttggcgtggccgtgtgactaagttctgatcaatggtatgtgaggaggaatgagctacgcaactttgggtcatgccctgaaaatgaagatgcagtcctcatcccctgtctattgtctgaaatatggatggatggacatagctgaagacattttattgggtcaaagatggaagctgtgtgttaaaggtggcagaagagcaggacaaaaataacatgggccctgatgattttggagccaacatatcaccttggaccaatgactcagacttcaatgtgagagataagcaaatttttatcttgtttaagccactattattttgggcctctctgttacagcactaaaaaatgtacgttaacctctccattttcatgtttctgtccctttcattcactcctccccctgaacaacacgacttaaagtcactcatgtgtgccaatctcataaaaaggcttcttctgagttcctattctgagaacctgctaaatttccttgaaatctagttgccttgaagttgctagtcctcctccctggtgaatggtgtcttgccctaaagctaagccccaatacccatggaaatgttttctcaaaatctggttcctgttcattctgactgcctggatgttccattatgtttcctacctcctcttaagatcctcagcttccttaagttggacccaatactaattataaccttatattggcttttcctttccttgcctatgtgatcttttttgttcatcacattccaccagcaaagtccagaggcagcattttgaatagacctggtcccttttctcaatctctttcagtttttttttggccccagaaaatataactgatcccttgtctccatctctttggcctttgagctgaaataactagaagaagcttgccaaagcatactaatatatgtaagttgttgagtgactactgtgtaagtgtcccattttagggattacctccaatccttataacaaatctaaaaagaggttgtattattccccttatacagatgaagaaactgaggctcagagtgaataagtgtcttgtccaagatgcctcatctagtaagtaatgaatcttcaattaaaacccaatctataatcttttcactatataggctatcttctaagcccaatgttaagacaagggcacagagattagggctcatgaaaaagaagacattctctttgtgagaatgtcctaccatgggtacacagattccaaggatgtgaggggactatctagcaccatactctagaggccatattaacaccaggatgctaatatgaaagtttcaaagcttcttggatgaaaagatgctctccttctaacttctgctttttgaatttaaaaaaagtcatttttctcaccttttctctcctaggattcttctgtttccctgaccttgattgacatttctccctaagtcctctgaattattatggaattaaatggcttattttaatttccctaggtgtctttattgaattctttcacagtgttttatggaaaatatctgattacgaattcatagaacagaacattatgagattctttgctaagtggctgccacagtagtattcaggtcctgaagcctctgcaatctctgtttctgtatacaggctcagaaacaaggaggcaagctaagttccagcatcttgcagttgactcttttatatcacctcctgaacaattcctaaacagaaaatactgtccccaaccccctggaaagattcatgaaatattagaaagcaaatcattttaacacagaagttaagatcttgggttctggaatcaaactgggtttgaatctcactgcttctgtttaaatgaccttgggtaagtttcttaatctcactttccctccatttcatggtctgtaaagtgggagtaacacctacctcacagagtattcatgaggattacatgaactaatagtgccaagctcataataagtgccaacctaaaagttaactaactatatcttttataattaagaagtaggagagtcttgttaaacctagtacaaaataccatagcatgtgaaagattctatgagtacctgcacctcctaaccattttctgacctatatacgtattatacataaacatgaaatcatatgaaaccatgctatttagcagaattcctctaattcagcttgattgacacaaataatccacaatgtggaggtgtcctgagagatcagatgattccttcagagaagagggtgaattctcattagagatctggtagttccagtctagatgagtcaccaatgaatagatttgctatgggttaatgttccgcccagcttgactaaattttaggcaggtttcttcctgactattggctcctaacctcccttttcttagagcatttactttacaaaacttgcaattataaattaggtctctggccctttgacatgtaaatcttctcccagtctctcactgattttacatcctaaaaatgccctttccaaggacctagaaaccatccttttgaaatatgattatcaaaaaagataatgtccttatcttctcatctctgtggaaggataggaggctgatttgataagcaccgacaaagaaacaagattttccttcaaagtaaggaagtatgaagaagtggccttgtagggagtgacagacatggctcagattcaagcagatcatttagtcattatagagaagttaaatattcctctcttacaggttagctgggctttaaaatcacaagaaaaaagtcaaaggttacaggcttttgtgaaaaagtacacaaaaagatgcctttcacaatgacagtcaactcaactctccaagcaatgcctagtttctagaaacttccagatgaagaccagccatttcagtctctgaagtcccaggggtgtgctgggatcttccacccactcagaaagcctctttctaagaattcagtctttgagcatagctgttagctagaaagaaaattccagttgatgtatgaatctatagaaccagtcattctcatgccctctagggataaactaggcatctccaaaccctgaaggaacagagtggtggtgagtggtgttcaaatattttaaaagtattggagtaccaacaaggacatactggttaggagaatatgagctcccaaaatggatattagacacattattattactttttgagatggaatcttgctctgtcgcccaggttggagtgcagtggcacgatcttggctcaccacaacctccacctcccaggttcaatcgattctcctgcctcagcctccagagtagctgagattaaaggtgcatgccaccacacccagctaatttttgtattttgagtagagacagggtttcatcatgttggccaggctggtcttgaactcctgacctcataatccacctgccttggcctcccaaagtgctgggattacaggtgtaagccaccatgcctggcctagacacattataaaggtaaataattataaccatgtgatgttgacacatgagtaaatatgaataaattcagatacctaaagggaatgcagtagaaattaagtaaaaaacaaaatataatttggcatcaagcatacaataaaagtagcatttcttttttttttttttttttttgagatggagtcttgctctgttgcccaggctggagtccagtggcgtcggctcactgcaaactccgcctcccaggttcacaccattctcctgcctcagcctcccaagcagctgggactacaggcacccaccaccacccccggctaatttttttgtatttttagtagagacggggtttcaccatgttagccaggatggtctggatctcctgaccttgtgatccgcctgccttggcctcccaaagtgctgggattacaggtgtgagccactgcgcccggcctaaaagcagcatttctaatcagtgaggatgacaaggactattaattcattcaataatacaggaacaattaaatagtcatctagtaaaaataaagtttgattcatacctcattccttatacaacagtaaattacatagatcaaatatagaaaaacccaaaccataaaagtactagaagaaattataataagattcttatataatctggaagtgagggaggcctttttaataataatacaacattttgaaaccattcatttaaaaaaggcttgattaaataaactacaaagtaattttaaaaatttgcatggtggccgggtgcggtggctcacgcctttaatcccagcaccttgggaggctgaggtgggcagatcacgaggtcaggagatcgagaccatcctggctaacatggtaaaaccctgtctctactaaaaatacaaaaaaattggccaggcatggtggcgggcacctgtagtcccagctactcgggaggctgaggcaggagaatggcgtgaacccgggaggtggagcttgcagtgagccaagatcatgctactgcactccagtctgggtgacagaggaagactccatctcaaaataaaataaaataaaataaaatttgcatggtaaaaatcagtgtaagttaagttgcaagtaaatgaaaaactgaggaaagataattacaacttgtatccattcatggggctatatggctaataagaaagagctcctttgcccttcacatcaatagaaatagaccaacagcagctcccagaatgggccaaggcattttgaacaggcagttcagagaaaaggaaatacaaatggaacttaaacatatgaaaaaaagctcaattttattcataatacaagaaacagcacaaagatactacttttcacctaccaaatatgtaagttccaaaaatttgataatatgctatattggtcaggacataacaaacttttccttatattgctgctgatggtataaatcattgtaactgctaaggagggcaatttggcaatacttatcaaaagtacaaacatccctgaaccagcaatttaacttttgggaatgtatccatcacacatatgccttcatatgtgatgtataaataaggttattcattgcagcattgtttataataagaaaatatataaaccattgttattgatagggagatagttaaataaattaaggtatattaataggattattattattttttaaaattttgcaggcacataaaacattcacacaactaaataccagaaagtgctctatgttctactgtggaaatatctctattaaattaaattaatgggttaaaaaaacaagataaagaacagaatgtagagtatgctaccattttttatatagcttaaaaatgagagataaagagaggaaaaatatatttttatatttgcttgtacctcggttaaatatccctggaaggatatacctgacactgtgtggttgcctattgggaagagaaatgggtatctgaggtaataggtattatagggagatttgcttcactaaacattgtataaacttttatactttcttacattaaaactctcttggccaggagtggtggctcatgcctgtaatgccagcaccttgggaagccaaggcaggtggatctccttgagttcaaaagttcaagaccagcctggataatacggcaaaaccccatctctaccaaaaatacaaaaaattagctgggtgtggtggcccatgcctgtgatcccagttacttgggaggctgagataggaggatcctttgagctggggaggtggaggttgcagtgagccatgattgtgccactgcactccagccagcatgacagagcgagaccctgtctcaaaaacaaacaaacaaacaaacaaaactctcttatatgacatctcatactttgaaatgttcaatttaatcattttccaaatctggaatatggctcatttttattgagatatgaattgttgttgatctcatgcttgatcttcccaaacagaacagaggctctatatctttctctgagaaactttggtgatatttttagcactgaaagtgggtaagaacacttctaacactggaaattcaaagtctgcagcacttactcttgggacttggaaaaattcttttttaaattaataattgttcatcaatggttccattttctttgcctacaagcatgtttcttccttcaaagtggacatgggtgtgtgcatatactcatctgtacacacatacatacacatgtatatgtgtaaggtattgaaagtaaaatgttttcttttaaagtatgtttgcatttttcctagaattggcctcacagtttccatcagacactcaaagcagtgggtgacataggaaaggttaaatattactaaatagtggacattacaattcctagttattcttttcccctttcctacagctaccatttaaatctaggttggcaacttcccttgggtctaaatcagcagtccccagtctttttggcatcagggaccggtgttatggaagacaatttttccatgggcagggcccagggtggaggatagttttgggatgattcaagcacattacattttttgtgcactttatttctattattattacattgtaacatataatgaaataattatacaactcactacaacgtagaatcagtgggagccctgaacttgttttcctgcaactagatggtcccatctgggggtaatgggagacagtgacagatcatcaggcattagattctcataaggagcacacagtctatgcagttcacaaaaaggttcgcactcctatgagaatctaatgctgctgctgatgtgacaggatgcagatctccggtggtaatgctcgctcacctgctgctcacttcctgctatgcagccaggtttctaacaggccatgggctggttggtactggtctgtggtctgggggttggaaatctttggtctagatgaccttgacagcagtatagctggcctgtctgccttcaggctttccacactccacattatatgcccaaccagccagctgttagtaatcattttaaaaataatttactgcctactttatcaaactagctgtgaagcgtttgactgtacgttgaactatagccaagtgtgctgtatttctgcactcatgagtgagcacttcgttgtcatacttcattgtcctggaatttctctgttcctgtttttattagtggggaaaactctgctgtattaattttgttcacagaataaacaaatttttctttaatatataaaaataaactagaaaacatgttttactggtcacttttcaggaagaaatgcctgtatatattttttaaatttttttttttaggaactttccatagggtgaatgatccatgtttgaatataaagtaatgattttattcagtgcttataaactgtattcaattgcatggagaaaaaagaatacactgacctctaatttaaaagtaaagagctttctggagaggtaacagaataataactaatggagctttacagtttataagtgctttcatataaatgacctcatttgtccccaccaaaatctcatgacaaattgtaatccccagtgttggaggtagggtcgactgggaggtgactggatcatggggggtggtccttcatgaatggtatagcaccatctcctggtgctgttcttacgatagtgagtgagttctctcgtgagatctggttgtttaaaagtatgcagcacctcccccttctctctctcttggtcctggtcctgccatgtaagatgcctatgcttctgctttgccttccgtcatgagtaaaaactccctgaagcctccccagaagcagatgccgctatacttcctataaagcctggagaatcatgagccaattaaacctattttctgaaaaaattacgcagtctcaggtatttctttatagcagtgagagaacagactaatacatcatcactgttattttaaagaataaggaaatgaagactcagaaggatgaagcaatgaccaacccaggtcatacagtaggtaagcgaaaaaccagggcctttaacttaaactttctgacactgtatctcataatctttctcatatggtgagtggctctcccaacattactgttacataaaaatttaggtcatgcgtgtaattttatcaagtatccctcaattcctgggacttaagtaattgatacacagaacaggttaaatagagagccttttctgaaagggtaaggaaaaacaacattgatgtttcagaaccaatgtgtgtttatatcatggaaaaagctagaaatcccagtagaaaagtctttacagaagcactacttatcactgtatacctggctatatataaatcataggtagcatactccccctttccctgaattctaatgaaagcattgttccaaatctattacagctatatagtttttataaaatgacccatggggaaaattctttctagagtttaaaagctggaaaagagtttctttctctacacgccttgataatattgttatcaatataatattatataatattataatgacagttctatagcccacttttgtcttgattatcaagaagctcagagtcaagttgtagtcttagttgtagtcatttttcttaatttgggttttctaaaatgtgattgttaatactgaatgtcaatttgattggactgaaggatgcaaagtattgtttctgggtgtctccgtgagggtgttgccaaaggagagtaacatttgagtcagtggactgggagaggcagatcaccctcaatctgggtgggcacgatctaatcagctgccagcgtggctacaaaaaagcaggcagaataaagtggaatgggcagacttgctgagtcttccggccttcatctgtctcctgtgctgaatgcttcctgccctgaaacaacagactccaggttcttcagctttggactcttggagttacaccagtgatttgctaggggctcttgggccttcggccacagactgaaggctgcactgtcggcttccgtacttctgagattttgggacttggactggcttcctcgcttctcagcttgcagacagcatattgtgggacttcaccttgtgatcatgtgagtcaatattccttaataaactccccatccatcctattagttctgtccctctagagaaccctaatacatggattattttctttgttctcctttttacatttttccttttatactatctagttcataccttttactaccgtttcaatggatttttattttactgtaattatatctttttttataagcctcctcaaatctgttttgaagataggcagagtataaacatacagagtccattctaaggaacatgagcatttagtccattgaaagaactaacaatagtataccaggtgcaaatgatctatttaatctcttgagtagcttccagagaagaaatttctgctgtaagtgcacagggtaatagagtcctgttttctttcttttattcttataataaaagtttgacatcactatcacaaccatttcatgtgtcagtaacagtagatgataggtatttggtattatacaacatttgcttgtgttaaaatgagccctggtatttcacgtatgttttatgattgtgcacatttggtgtgatccaaagagataatagtggaattttctatggaaattcttgtttgatacagaattatatcagaagttgacacaagaatcaatgtgtatattgtctagggtatatatcttacatatataattatatcacatctacagttctgattatcataggaatataatacacatgtcacacggacaaacgtattcattttcctaattgatggctacagcagagaaaaccagtgagtatcatctttgagagataaaaccgtggaaatgtcctttgtggtatgattaatactaaaagggaaagggtaattgggtgagaagttagaaggtgaaccaaaggaagactaagaactttttgtaccgtcaataaaacaaatccagacttagacacggtgagacgtaaaaaaactacatcaacctggagaatgttcctcccttaggattttcaagccactcaaaaatcaatcaaaaaggtttttcttttatagggacggctaaacagaactagcagaaacttagaggtaaaattgagtgacagggcggagctaagcagacatcatgatggggatgatataacaggaaatgttgctgtgatcagctaatttggaatgaactgttaaggtagggtgatatagctagtgtttttgttccctagtgtattgttcagtttcacattgaattgtaatcctcagtgttggaggtggggcctggtgggaggttactggatcatgggagtggatttctcatgaatggtttaccatcatccccttggtgctattctcatgacagtgagtgagttctcacaaaatctagttgcttaaaagtgtttggtacctcccccctctctcgcttgctcctacatttgctatacaaagtgcctgctcccgctttgacaccctctaccatgattgtaagctttctgaggcttccctagaacgcgagcagatgccaggaacatgcttcctgtaaagcctgcagaaccgtgagccaattaaacctcttttctttataaatcactcagtctcaggtatttctttatagtaaggcaagaacagcctaacacagtgggatgtttacattttagtgtttgctcagatttggggcaagccaaaagtcaggagcctgtggggaggagagatgtctgattaaatcttgatcaagccaagtcagtgggcaagaaatgggcaattgtgagcatctggccgggatctgcaacctcatgaaaagtatataccatcaaaaggctaactacttgtttgtcacataaattcttataaaaagcttagtggagccaagaagcaagctaagtataataagagaaactcttcttaccatttgtatcactaatgagcacataattgcagctagtcatgtaagtctcctacaaatcagcgtaaggttaattaagagagttgagacacttaggtgaaagtcacttttgcttatagtaaagaacttatctatcttacagacacatatcacttacattatgtatttgttatattaatatatttaatatatttaaaaaacattgtaaaatgatgatctggcaatatccctagaagaacctcattgaaatacttgagatttattggtcatttgtctttacaaaattgagatttgaaaagctttaaaggaggacattctaccaaagcataactcataaaacagaagataaaagtatgagccatggaattatagagctggaaaagatctagccctactgtttcattttcaaatgaggaaattgagggttattctaaggggttgtttttttaagtcatacagtaagttggtgcagacggaggagtagcaatcagatctctgagctcttttcctctttgacaatgaagttcacgaatgcaattttgtttcataagttatttactttactaaagtaaagtaaggtacagctatgatttattgttaaatgagaagaatgagtgtcagagaactgtatatggcatgatttcatgttcttaaaatacaaacaatatttgtcaatctatctatctatctatattgatttatttatcttctatctgtatgtgattgaatgaaattggagaaatgagtggaagcatatacaccacactaacattgaacatttacaagaagggtaaaaaaaggagtaagaaaaaaggaagcaaaatagaatttggtaaaatggtatgtgaaagtgaagattgcaaaacttttatccataaaattattaatacataaaaattgaatgtgcacatagacgaagactagaaagtcactaggatatacatacaacaagaacataaacaaaagaacatattattttgaccaggggtttattaaaaataaaaataaaaacaagtccaatgactcccttttctgaaaccactgaaacacaactattttgactcaaaactgataaaaagatgtaatcatatattcacaaacagtattcacttaggaaattttaccttattttcagcattgatacctataaagttttgtgcttcacctatgaatgtatatatatgtacatatacgtccatataaatattttatttgcttaccattatatttgtttactaaatttggatatacttctttattaaataatttagacaatgaaaataaaattaatgtatactcactgttaaaagcttagaaaatttagaaaaagagagagcagaaaataaaaaccactgataatcttactcagagatatccactgttagactttttgcatatgtcctttcagattttttttgcatgtatgtgtattcaaaaatgggctaatatcttactttattatctgctgctttcatttagtaacaaattatggctatatttctgtggtaatatatatagatacaatgtcattttaaattaggtgtttaacattttatcatcaggaattagtgtaatttcttttttaaattttctattaatggtcatttgatttgattctattttttaaacaaccataaacaatgctgaaatgaatatctttatatgtgcattttttgctcctgttcaattgcttccttaggatatattcctatatgtgatatttaattataaaatatttaatttcctaactccctggaagtttacacttcagtatcaaaaacactagtggatgacaattcctttgctattagaacagaagaccatagaatcaaccaataacagatacaaagtttttctcatgggtaagtgccctacactggtcacttaattcttcattatattttgggcaaataaatttgtatctaaaaaccatctttatgatgatctatgacttataaaaatctactatttatcttacaaattacttccaattacttttacttcttcttctgttgccggtatgaggtcactaatggtagattttagaaaatgcgctaacaattatatgtaaaccatacaattagtattttttaagtgtctacaaagaagacatttgcaagtggtttctagctttattgtgaatgtgcaaggggtatattctatcaagtaagcatcattcctatcctcaagacacttatatatactggaaatatgaaatcattatccatagtttggaaaaatttttcttttaagaaaataatagatggaaaagaaaagagaagtccaaggaaaaaaaaagtcatctgttaagatctgctatgtaccaggaatatagttaactacttccttattaattacagcctcccaataatattgaagtagatattatttattatagctgttttccatatgaagaagtgaaattcagactgatgaaatgatttgcacaaggtgacactgccaataattgatatagtgagattcaaacctaggtgacatacttttgacccaacaaaataagttttcaacaacttgagtgtctcagtgatagaatatattatctctggaagcagtgagcttatcatcatgggaagtatgttagcagatgttagttgatgttggttgatcatatatcagagacatgaaaaatattctactactaatgggcgatttcacttgctcatctccctaggccccttctggagggttagatattttgttgaattgaaaactgtaccatttttaaaccattgatacgtcataagcaaatattagaccacagaataatactcaactattttacacttaagggaaaccaaatatcacaatgaatattatctctaattttagaatactagagaatctcagcggtatttgaaagatcaaaatttatattatgcatgttatttttgcttttaaacactagttagaatgtatggtgctaaatacattttagcgtctgtggtgctaagaacacaatcgtttgattaaacaagatctcttgataaagattagttagcacatgctagcctaacaattactgaaattcacatttttacatgggtatcctattattaagtgattccttagatttaatctatctgaaaaaagtcagtaaaatgttatataaaataataataaaaataaatcctctcttgatttagataaaatagcatgcttgtgtgctaatgtattctactacctaccttccccagttgcttctattaaaaatagtactgtaaaaagaaataaaaatcaaaaatataatatgcctgttgcaaagcgtttcagagaagcttttatgtgaaatttaacagttcatggaacaaagaatatgactggaggcaaggaaaatttctcctctgaaaataagtgaaacctaggtcgtcattagagtttgtgcattcacttttgggacataggatatgttcagggctatgactcatttacatacatgactatgtggcctgtgttttgggagggctgtggggtgttagctgaagccttccatgctggtagttatgctttgctaagagaaggctggttctctacttacaccccctcagatggctctctttagtgcatgtctgtatgatttgacctaacagaaagaagaaatggactagcttctgttattctatgtcagcagcatattttattgaaaggagtatggacttcaggaaaagaaaaatcagggtttgaagcagctgagaagtcaacaagctacttattcttctgagctcttcttcatctataaaatgggcataataatacttcactgagtgagttgttttgagaattgaatacaaaaaatgttgacagtagtaaactgcacatcatctgatacacagttaagaatggagtacattttagcatccttttttttagttctgtaataaggagattgtaaatacatttaaaaaaaaatgtttccctagagtttggtgggtgatattgccacttaggaggatagctatcagctgcactggtgacaaagtacctcctgatgcagacccagagctacataagcaaacatgaggggcttggaagcaacccagacatcaagcaggagcagtttccagggctgtgaagatgtttgctctcctctacttagaaagaggctcttttaggagaaagggacatatttaggagaaagagctctgcctgttcttgcagacccagggaaagaggagcttggatcaggaagccagagagcatttactctgccttagtgagttcctaaggtcctagaaactctctatgggtgggtctctgctgcggtgagggactctgaactgtgacctgcccctcagatcccaggaagaagagaagcaaaagcttagaaagcaaggctgtaggataagtgttagccactgatttcagagctatgtattttccagcaaattgtctaagaactatgctttatctatccaatatagacaatgtactctataataaaattccttaggaattaattttaatagctttcatttataattaaaatctagatggcatttatatattgacaaatgaatacaatttaaccttaagtataagaagaaaatgccagccttaaaaatacattttaactacttaactatttttatacgaatgcacttgagattaatctaatatagtccatatatcttgcagtcagttcaatgtaacaagattattaaaactggtttagaaataggagggtgtttatgagattatctgtcacccttgtattgtgaagcctgagcgcttgattactctgcatgtttgctcttgtgtaatgacaagcacgtcccgtggagccaattactgcctccactttacttaagtgatcctccatcccatcaagaagatattcaacctgattcttagaaaagtgtgagtatttgaagtagttccagtgaaggtggtaaatttcctaacttgaaagcactttcttatgattgcaatgacaatggttaaagaaataaaacttcagaaaagattccacatgaaagcaacttagaatatgagtaattataccttaactacaatcctcagtgatcaaaagataagcaaggtttcccaagcatctttctgtggagcatgcactctaatgagaaagagaagccatgcatactctgataaaaaggcaagaaaattatatttatgaattaccagctatgtttcaggctataaagttgagaattcccaacctgaaaatctgaaatccgaaatgctcccaaatctaattttttgaacacctacatgacaccacaagtagaaaattttgactgtattttgacaagccacagtcaaaatacagtcaaaattttgttttgtgcacaaaattattaaaaatattgtataaaattacattcatgctttgtatagaaggtgtatataaataacaaatgaatttcatgtttagatttgggtcccaactacaagatgtttcattatatatatgcaaacattccaaatccaaaaataattgaaatctgaaacacttccggtcacaagcatttcagataagggatacctaaactgtagtagtacagtgtataatttaatcttgctacagtcttatagggtggttattaaaaatctgagtttctaggtgaggaagttgacatcagggaggtcagaaattgcaaaactgggacttgagaccaggtccatctaacttcaaaacctgttatctgaaaggattctaaaaatgcaaacctgagagtgcatgatgatgtagaatatattatcacatcacatatccagctttgctgaagaacagggtgttctgcacaatatgaggcattgaatataattgaatcctacaccaatactgatttgtttggcatttgagtctgatttcaagtgggaaaacagaagtgttgtttgtaaaacttatgaattaataagttctgagaatcaaaaggactgacctcaaacaaattcaggaaattatatttactcttatttctgtcttagtcctggacagttgacgttgctagataagtttcaaactactacacaattgctgagaaaattggggtggtaggaaaaagaggaaactgatttctattagtaaaactagttgatgacccatagagactgctcaaactttgagtgggttcatatttataggaataaagatgagagacctccaaatcttttcctgatccaataaatattttgtttataaaatatctgacattagaaatgtgtaggggtggggacaacaaaaaaaatgctgagacaaaataggcaagagaatccaaatgtaatgttgacctttgatccttcatctccattgcttaagattttattctcccaattgtcttaagaggtcttaagcaacaaacataagtgttcaaaaaactacagagctctgttagagctaggcatagcacttgacttagtatcctcccaaagcaaaattttgcagatagacaacacatactacataaaacggtgtttcctcttgctcattttaaatttacctcccattaatttcattgcctgtcccttcccaattgtcaagcaaaagcagtatgatcagatttcatcaaaataacttagaccacttaaatcaatgtgtattagacttttcttctttctgtgccagggtactctggaattttatgctctcttttagtaactgctcttctctggtaccaattgactggtgcatttatcatgacctgtattccaactgacacaccacaacaattcctgggaatacagtgaatttaacattaagattgtaagatcagctgacattctaagattcttacagacagggcttacgtgtatttattttggtatgaccacagcagcaaacacaatgtctgcatcacaataggacaaggtgagagctaaaatttaatatgtatctgcatatgttagacttttatgtatatgccatcgtgcatctctacactcatcctctattagtattctcatttctgtcaatggggaaactgagtaagtcacctaagatcaagcagctggtaaataacagagccaagatttgaattcatgtctgtctgactttttttttttttaccatgtgatttaccaaccacactcagtacccaaaatattacttgtggaatgccattttcacagggttgtttatcacacctctaattaaacctacccttgagagggaaaaaactgcaactcagcaaaactgtaattcacaactagcctaatggccaagtggaatggtacatgccatggtcaatcacttagcacgtaagtagtgtgtgatgaagaggtaaaaattgaggcacacacagagccagcctctgttaataacaatgattctttggggactgagtctccactttcattttaactaccactgtagaaaaatgataaataaagtcagtaggtaggatggcaatatgataggtagaaagagaagaaaaaataatttgtgtatttgtttaccactaaaatgcccttaagaggcagctttgtccaagtggcacttttaacatttatttttacttttaataatcatgtgtattatatttttatggctcaatggcactatatgtttgaagaattttagaacattaatatccaatgttacctaagtctagctgtggacttcatgcatgaaacaccattccagcacagaagcactcctagcttgaatatcctcagtattgaggaacttactatcacacggggcagccactctatctttgaataaagatagaatgagtaaagttgataagaaaagaaattcttaccttcacatcaatcaaagatctgtattcttacaatatccctgaaattattctgtaagcaggcctgaaagaattacgtggcaacatatgttgctaggctggttcgttgggttttggcaaagtcctcagtgtttgtcagcatttctatgtgagagaactggctacatagtctatcttggagctaatatcatacttgggtcactaaacatatgtatgaaattttgagaattgtttcttaatttttcagttttaaaatctaatgcaaacctgtatttcagaaaaaaagtattgcttgacctttttaaaaattatcacttaattaacatggggcccagccgagttagaataacttctcacttgttccaacataagagaaacaagcaaggtactcctaccagggtgtcacttagacctgcatattctttttagtgattgcaatgttacttcttagccacccaggccaatccaccataaaacaatcattctccaactttcctggtcttaagagtcacttggattgcttgtttaaaaggcatatttgttgagctctgcctccagaaatactgatttagtagcatggagccgaggaatcttcatttttcaccagcgctggaagtgattctgatgcaagtgatttgtagaccacattttgagaaaaattccctaatgttagcagttgtaatgatgcaggtagttcattcagttttgcttcagtacaaaactgcaaggataatactattgggttttctagatataggatcatgccatctgcaaacagggatagtttgacttcctctcttcctatttggatgctgtttttcacactgctgtaaagatactacctgagactgggttatttataaagaaaagaggtttaactgactcgcagtttcgcatggctgaggaggcctcaggaaacttacaatcatggtggaaggcaaaggggaagcaaggcacatcttacatggcagcaggagagagacacagtaaagggggaattgccacactctaagaccatcaggtctcgtgagaactcacccactatcatgaaaacagcatgctgggaaccaaccccatgatccaatcacctcccactaggtccctcccttgacatatcaggattacaattcaagatgagatttgggtgggaacacagccaaaccatagcagatgccctttctttctttctcttgcctgactgcactggccagaacttctgatactatgttgaataggaataaggagggcatgcttgtcttgtgctgattttcaaggagaatgcttccagctttgaccattaaaaagaatgagattatatcctttgcagggacatggatggagctggagaccattatccttagcaaactaacacaggaacagaaaaccaaattctgcatgttctcacttataagtgggagctaaatgacgagaacacatggacacacagaggggaacaacacacgctgatatcttttggaggatggagggtgggaggagggagagagtcaggaaaaataatgggtactaggcttaatacctgggtgatgaaataatctggacaacaaacctccatgatacaagtttacctatgcagcaaacatacttgtatccctgaacataaaataaaagttaaaaaagaagaaaattgcaaggatggtaagatttggggctctttcataacttttcaaatatgtcaactgagaatatcaaaatgaatcaccagccttttttgtttggggtgtgttcctgtgtgtttgtcacaaaattcacatacttttcaactgtgcctgccttacactaaaatagtcattatacccagctgtataggcccagctatatacatatatatgtatatatatgtgtgtgtatgtgtttgtgtgtgtctgggggctccacacacatttggtgtcaatactgaagtaatgcaaatatctctgtattggctacaaaactcaaacaagaaaaatgaatagatttggatctgatatggccttccactttggctctgaactttagttgtaaggaagaaaataatacttagtaagagtaatatataaaatagtgattgtaaaaccaactatttgtgaaatagtctgccaagtattatgggatacataaagatgattaacacacagttcttgcaaaattggagcccacaacttagcagaagttgttaatcactttggtcaggtgaatgtttcactgaataagaaatattagtgtattaagtcatcagattctttaatgctttgaagtgcttcatactgagctctacataaaatagaaacttcgtgtgtgtgcatgtgtgtctatatatatacatatttgaagacagggtctcactatcttgccaaggctggtctcaaacacctaggctctagcaatcctttggcctcagcctcccgagtacctgggactacaggcacatgcctagcacatagaaaaacttcactggtgtccaaggtggctgaataggaagagctctggtctgcagttcccagtgagatcgatgcagaagatgggtgatttctgcatttccaactgaggtacctggttcatctcattgagactggttggacagtgggtgcagcccacagagggcgagctgaagcagggcggggtgttgcctcacccaggaagtgcaaggggttgggggatttccccttcctagccaagggaaactgtgacagactgtacctggagaaatggtacactcctgatcaaatactgcacttttcccacagtcttagcaactggcagaccaggagataccttcccttgcctggcttggtgggtcccacacccacggatccttgctcactgctagtgcagcagtctgagatcaacatgcaatgctgcagcttgacggggggaggggcatccgtcactgttgaggcttgagtagctcacagtgtgaacaaagcagccgggaagctccaaatgggtggagcccactgcagcttagcaaggcctactgcctctctagattccacctctgggggaagggcatagcagaacaaaaggcagcagacagtttctgcagatttaaatgtccctgtctgacagctcggaagaaagcagtggttctctcagcacagcgtttgagctccaagaacagacagactgcctcctcaagcaggtccctgacccctgtgtagcctgactgggagacatctcccagtaggggccaacagacacctcaaagaggtgggtgctcctctgggacaaagcttccagaggaaggatcaggcagcaatatttgctgttctgcagcctctactagtgatacccaggcaaacagggtctggagtgggcctccagcaaactccagcagacctgcagctgaggggcttgactgttagaaggaaaactaataaacagaaaggaatagcatctacagcaacgaaaaggacatccacaccaaaaccccatctgtataggtcaccaacatcaaagaccaaaggtagataaaaccaaaaaaatgggagaaaccactgcagaaaagctgaaaattccaaaaaccagaatgcctcttctcctccaaaggattgcagctcctcgccagcaagtgaacaaaactagacagagaatgagtttgatgagttgacagaagtagccttcagaaggttggaataacaaactcctctgagctaaaggatcatattctaacccatctcaaggaagctaaaaaccctgaaaaaaggttagacaaatggctaactagaataaacggtgtaaagaagactttaaatgacctgatggaactgaaaaccaaagcacaagaacctcatgatgcatgcacaagcatcaatagctgatttgatcaagtggaagaaaggataacagtgatggaagatcaaataaatgaaataaagcaagaagacaagattagagaaaaaagagtgaaaagaaatgaacaaagcctccaagaaatatgggactatgtgaaaagaccaaatatacatttgattggtgtaccagaaagtgacagggagaatgaaccaagttagaaaacactcttcaggatattatctaggagaacttcccgaatctagcaaggcaggccaacattcaaattcaggaaatacagagaacaccacaaagatactcctcaagaagagcaaccccaagacacataatcatcagattcaacaaggttgaaatgaaggaaaaaatgttaagggcagccagagagaaaggttgggttacccacaaagggaagcccattagactaacagtggatctcttggcagaaacattacaagcaagaagagagtgggggccgatattcaacattcttaaagaaaagaattttcaacccagaatctcatatccagccaaattatgcttcataaatgaaggagaaataaaatcctttacagacaagcaaatgctgagagattttgtcaccaccaggcctaccttacaagagctcctgaagaaagcactaaacatggaaaggaacaaccggtaccagccactgcaaaaacatgccaaattgtaaagaccatcaacgctatgaggaaactgtggaattaacaggcaaaataaccagctaacataatgatagggtcaaattcaaagataacaatattaaccttaaatgtaaataggctaaatgtccctattaaaagacacagactggaaaattggataaagagccaagacccatcagtgtgctgtattcaggagacacatctcacatgcagagacacacataggctcaaaataaagggatggaggaagatctaccaagcaaatggaaaacaaaaaaaagcacggattgcaatcctagtctctgataaaacagattttaaaccaacaagatcaaaagagacaaagaaggccactatataatggtaaacggatcaattcaacaagaagagctaactatcctaaatatataggcacccaatacaggagtaaccagaatcataaagcaagtccttagagaccgacaaagagacatagactcccatacaataataatgatagactttaacaccccactgccaatattagacagatcaataagagagaaagttaacaaggatatccaggacttgaactcagctctggaccaagcggacataatagacatctacagaactgcataccccaaatcttctcagcaccacatcccacttattctaaaattgaccacatagttagaagtaaaacactcctcagcaaatgtaaaagagcagaaatcataacaaaccgtctctaaaaccacagtgcaatcaaattagaactcaggattaagaaattcactcaaaactgctcaactacgtggaaactgaacaacctgctcctgagtgactactgggtaaataacaaaatgaaggcagaaataaagatgttctttgaaaccaatgagaacaaagacacattgtaccagaatctctgggatacatttaaagcagcgtgtagagggaaacttatagcactaaatgcccacaagagaaagcaggaaagatctaaaattgacacgctaacatcacaattaaaagaactagagaaacaagagcaaacaaattcaaaagctagcagaagacaagaaataattaagatcagagcagaattgaaggagatagagacacaaaaaatccttcacaaaatcaatgaatccaggagctggttttttgaaaagatcaacaaaattgatataccactagcaagactaataaagaagaaaagagagaagaatcaaacagatgcaataaaaaatgataaaggggatatcaccaccaatcccacagaaatacaaactaccatcagagaatactataaacacctctacgcaaatgaagtagaaaatctagaagaaatgggtaaattcctggacacatacaccttcccaagactaaaccaggaagaagttgaatctctgaatagaccaataacaggttctgaaattgaggcaataataaatagcctaccaactaaaaaaagtccaggacaagacaaattcacagccgagttctaccagaggtacaaagaggaactggtaccattccttctgaaacttttccaatcaatagaaaaagagggaatcctccctaactcattttatgaggccagcatcatcttgataccaaagcctggcagagacacaacaacaaaagagaattttatgccaatatccctgatgaacattgatgtgaaaatcctcagtaaaatactagcaaactgaatccagcagcacatcaagaagcttatccaccacgatcagattggcttcatccctgggaggccaggttggttcaacatacacaaatcaataaatgtaatccatcacataaacagaaccaacaacaaaaaggacatgattatctcagtagatgcagaaaaggcctttgacaaaattcaacagcccttcatgctaaaaactctcaataaactaggtattgatggaatgtatctcaaaataataagagctatttatgacaaacccacagccaatatcatactgaacgggcaaaaactggaagcattccctttgaaaaccggcgaaagacagggatgccctctctcaccactcctattcaaaatagtgttggaagttctggccagagcaatcaggcaagagaatgacataaatcaattagaaaaagaggaagtcaaattgtctctgtttgcagatgatatgattgtatatttagaaaacccaatcattttagcccaaaatctccttaagctgataagcaacttcagcaaaatctcaggatacaaaatcaatctgcaaaaatcacaagcattcctatacaccaataatagacaaacagaaagtcaaaacatgagtgaactcccattcacaattactacaaagagaataaaatacctaggaatccaatttacaagggatgtgaaggacctctttaaccagaactacaaaccactgctcaatgaaataaaagaggacacaaacaaatggaagaacattccatgctcatggataagaagaatcaatatcgtgaaaatggccacaccacccaaggtaatttatagattcaatgctatccccatcaagttgccactgactttcttcacagaattggaaaaactactttacaattcatatggaaccaaaaaagagcctgtggagccaagacaatcctaagcaaaaagaacaaaccaggaggcatcatgctatctgacttcaaattattctacaaggctacagtaaacaaaacagcatgattctggtaccaaaacagatatatagaccaatggaacagaacagaggcctcagatataacaacacacatctacaaccatctgatcttcaacaaacctgacaaaaacaagcaatggggaaaggattccctatttaataaatggtgctgggaaaactggctagccatatgtagaaagctgaaactggatcccttcctcacaccatatacaaaaattaactcaagatggcttaatgactttaatgtaagacctaacaccataaaaatcctagaagaaaacctaggcaataccattcaggacataggcatgggcaaagacttcatgactaaaacaccaaaagcaatggcaacaaaagccagaatagacaaatgggatctaattaaactaaagagattccacacagcaaaagaaaaggcaacctacagaatgcgagaaaatttttgcaatctacccatctgacaaagggttaatatccaaaatctacaaagaacttaaacaaatttacaagagaaaaacaaataatcccatcaaaaagtgggcaaaggttatgaacagacacttctcaaaagaagacatctatctagccaacagacacatgaaaaaatgctcatcctcactggtcatcagagaaatgcaaatcaaaaccacagtgagataccatctcaagccagttagaatggcgatcattaaaaagtcaggaaacaacagatgctggagaggacgtggagaaataggaatgcttttacactgtttgtgggagcataaattagttcaaccattgtggaagacagtgtggcgattcctcaaggatctagaactagaaataccatttgacccagccatcccattactgggtatatacctaaaggatcataaatcatgttactatgaagacacatgcacacgtatgtttattgtggcactattcacaatagcaaagacttggaaccaacccaaatgtccaccagtgatagactggattaagaaaatgtggcacatatacaccatggaatactatgcagccattaaaaggatgagctcatgtcctttgcagggacatggatgaagcaggaaaccatcattctcagcaaactgtcacaaggacagaaaaccaaacaccacatgttctcactcataagtgaacaatgagaacacatggacacagggtggggaacatcacatgcaagggcctcttgcggggtggggagctgggggagggatagcattaggagaaatacctaatgtaaatgacgagttgatgggtgcagcaaaccaacatggcacatgtatacctatgtaacaaacctgcacattgtgcacatgtaccctagcacttaaagtataataataaaaaaaagacttacaaccaacagagagtttgaaatatatttaaattaaaagtattattaaaaaattctaaaaaaaaaaaagaaaaacttcactggcatagtaaaatagcacatgggaaaaaatcctctcaatttgctaagtcaatattcttataactgatgttgcttatatgtcattgttgttagatctgagagtggaaggaaataatttgtagttattgttataatgaaaaaaatgcaattatctaaagattcctatcattttctcactactccttaagcacatttattcattataatgtagaggaaggttgccttacttgtggtctcaccattcatctctttaagttcgttgttgattccaacatctatggaactcattattttgtcaatctgtaagaaacaaaaaccatttaaatggattgttacattcacttttaacattgtattttaaaataagtttcaaatgaagggagcaaatatttttgatgttattaccacagtgttccacagttaagagatgcatagcgaaatatttaaaggaaagcaaacatctttcggattgttttattaaaatgtaaagtatgttcccctttcttaaactttcaaaattagtttgccttttctttgtgtttcttgaaataaactttgtacttggatagattggtcatttaggaactgtgtattcttcaaactcagaaggactgtagataaattcatgtgacaaagtctctgctctctggcacccttcttcttctgcctaagaacatgcatcccatctaactggtaaaggagcaggtttcagggtgtggagagcacggccacaggagcaaagttttctgttttttgtttcgacagaatctcactgtgttgcccaggctacagtgctgtggcaccatctcagctcactgcaacctccgccgcccaggtccaaatgagtctcgtgcctcagcctcccaagtagctgggattacaggcatatgccaccacacctggctaatttttgtgtttttagtagagatgtgattttgccatgttggccaggatgtttctgaactcctggcctcaagtgatctacctgcctcggcgtcccaaagtgctaggattacaggcatgagccaccattcccggcctggagcaagttctaaccaaatggtttgaccaaccacaagctgattactgacatccaatcaccagcatctagtcatgaaaacaacttaattataagatctaagttaaatgttaattaatcctgcctctacaaaaggatctcagatgttattcactaaattaataaatataagaaatggctatacttgaaaaactaaccatctactagtatggaatttaaaggaagatatgatggtctaagctatagcaatttatggcttaatgactctcttgatgttagcaacctgaataagatagcaggtttcagaaaggacaatgggcattacttaaatgtcccagtttgttcaccctgaaacagatgcagagatattaagtgattttcccaaacagctcagttcagaatatcactatcagaccatatccatttctagttctccaaatactataatgatctattgtgcttctaaacctaatccaactggtacagtcttttcagagacaatatgtgatgtgttagaatgaaataccaagagagactgtatgaaattaaacactttaagtagaactgaaattggtgatatttgaacctcaaacatttttttctttatttccctgatagctgcaaaagggaaatatcaaatgatgtgtgtttattgtatggtggctggagaagagctaggaaactttatttactatgaagattctaaggagctcttctgaaaatataagatactttaaagaagggagacaaactaacaaagagtttggcaagtagcaaaacaacacagagcaaaatactgagctttttctcgatttgtcagctgcagtgcttggtaggacgagatgtgaatattctcttgtacctcatagctagttattacttctgcttgatatcaatttctatggaaacaatagattaacccacatgtgtggaacagtgtttgtttttatacttgctgtgaaattaccatgcattacccacagaaccatttcattccagttggagccgtatgcttttttttttcttgcttttgaaagagctaaaaagctgaaaatccttcccccaaacctccctcaactgcaaagccttataggatgaacagcaagaagaacaaagcttacttcttcccattccgatgtgaaggatggtgttctttcagaattccctttagaactgtgttcagcagtggaagattcactccagttaactcttgatgttttctcattggaaggataggcaatgagatcagaatcagatttagagacactttttgacaaatgcatgtcgatcaaggctttaggcaatgaccttattctccccagagtacaggctctctccacaaatccccctgcgttcataacccactggtccccattccgagatccactcctggttgatcttgtgccaacaatggtatggttttcgagttggttgctttttttgtgaaaaattgttctactgaccactttgggtttaattttctttaccaaaggttctgagttattttctattggagactgcttgaaaggcaaaggactgtttgccaaactgacttcatcttgtcctttttcacattgttctcttttcccatagagatgaaatggattttcaggggactcacaggctggagaggatccatggagcaggcctgcaaattgcccaggatcatattcttttgggggatcattgtcatcctgtcgggagaggtcatctgcaaaaggaaggaagggatatcagggtttataaaggttctgaaagccacgatataatagcagtgcccttatgaacatgtgggctatccaaacatttcatttactgctacatagcaataccttcactttatgaaatacccctgaccccacagtgccatgtatagaatgaatgtatgagtgtgtgtgcgtgtgtatgcatgtgtgaatcattctttctgatataccttagagttcatttcaaaagtatgaattgtgtattaattgaatgacttcattcacttctcccttgaacccagggtgtatgttttatagccaatgaacaaaattgggttttcttaaagtagaacacacacatctaaactctcacagtaaatgaatcatcgtgaagtagaacactaggcaggtaagtcaaggtcatatataatgacaaccctctgccctcctcccagcaaataaattcaaaaaccaaattttgaaaaaaggtattattaaaagtaattgaagtttaataatcctgatattaccttaaatataaatttaaaataattctatgcagattacataatttagacaaaaaaaatttgttcagacttaacaaaggcaaacaacgcagtatcagaaaaagagagactccaatataagaaactaatgtttagctatgaacacaaaggtagctttttctttcttctctgaaacggcattagctattttctaatttcttcagatctttgaagatgtaatgcagaaaagaaaccaatgatgaatgataatttttattcctttggatttttttctaagataaaacacacattttctctgagatttaaaatacaccatgctttttgcgacttaatttgtctttcaaagacatactgtgtaaaaacctggccaaagaatttagcaaagaaaggaagtgtcctttttttcagtgttcattttaattcatatcaatagctaaatattgccaagatgaaaatttaaattacctgataagcccataactcactgttgcaaagaactaaagtatagtaaatgtggtacataatgacaacaaatccaaagttgatgtgctgattcgtactttcagtaagttaattattaccataaaccccaaacactaacatttttataaattaacaagtaacatttaatgggtaagtgttatttactaggcactgaatgaggaattatatcatctcatttgacacccataacaatcctatgaagtgattattaataataattatgattttgtgatggaacgagatggccaaaatatcgaattctcacatttttaagaaattggcaaccataataaatcttattagacattggctcagaagatgctacaggcacatctgctctttatagtgaagattggccccaggtgtctatactgctctccgcctgggaactggtgaaagcaggtatattcctagctatgtatctctagacttcaccctggttcctgcttgatttttccaaagagaagatgtttgcctgcccagctatcataccagcatcctgagattgaagaaagaagagtgacaggaagagagatccaagacacatgaatctacaaatgcaacaatctgcatccatctactactattatactcactgtcttctcacaaaaacaaaacagaacgataaaacctcatcactttctaaaatagccacactgtcttgataactctctattttattttcctttcacaacagagaccattctaggggtagaatagtgagtggatagtgggataaggcagctttcaattctctccaaagactagagtttatcactgagtatgtgcatttttaagaagtcaaaactaacacttagacaacttaagacacagacatttccccacctagtaagcaattaagctgagattcaaattaaggtctatcagattctgacatccattggccttgcaaatatattgctattaaagataagctttaaaaaaatctagggttggtttatccataggacaagcaagtaggctctttgtaaagagacatgcttctcctgttcatgactgtatctggaatttgggaaaagtggactaaaagcatcagagctttttctttgttttgttttgttttcttcttggagataagctaatactaagaagaaaataagacctggcatcttgttccaatgcattttttttcttaggctacttggatctcacagagtgctttacaacataagcaggttggtatgggtgacaataatggggattaaggtggtaggaaggaggaattctgaaataaggaagttttagaatttcattttgaaagttgctgaagaaggataaaaggtctgaatttgaaaggaaaattgaaaagagcttgcctattgtgggaaaaagattctgtaaatctcagccaaaagagtttccgacgatgttcattatctagaaaaatgagaattttaggggcgtaatattatttaaagttttctgcaaatattattattaggttaccatcccctctgtagtttgactacaatgactataattaccaccccacaatgctttacactgtccaagtcctccaatcacaagcagtcacttctcaaagtaaaagataatttcattgttagcttataaagcttagttttttgaatagcagttcttagcattgtgatggtaacatttctgccaagagtggtgaaaagacaaatattacttgctttttccagtggccaaatcctaaagattattcaagtcaaagaaaaggagaagttgatatgaagcctcctggaaagcctgtgtggtggattgattgcagttatggccccagtctgctcacagctccctgcagacacagccctccccgtatctagtcctctcacgctgactccctcacagcgtggccatgtgccttgtaccgctcaatcagactgcagcaaatgtgatataagcagagacctctgaaaagcatgtgtgcattagacttgttcccttgttgctcttggaaccctgacaccatgtgaacaagccaggctggcctgctggatgatgaggtgacacattacccagctgtttcaaaatgtaggttttattatatttttcaggtatgttgaaaccaacagatcaggagacaattgccattgaaagatagacgctctactcattgatccgagaggcatgccacattataggggccacacagggaactaccagggtccatcaggaggaggctgacaaagtgaggggagattgtgggcaagagcctttactatggtttccatgaaaagaaacacacaaagcaggtataagcaggtttaggaatggctagtttgaatagtttcagcagactctggggcataagaactgtacctagttgtctggtcattagagcaggtgaatgaatagtggcctagagagtgagagccagatgaaggaggtaattgggactatgggctctacgattgttagtttgcataagaaaagcatgctctctggtgagctgtttactatctctaggaattagctagccccaggaggggccgtccctccacagcaagagctcaagagaccaaagcataaaaataaaaatacacaaataaaatagaaaataaaaagacatggttaatacatccgccagtcctgtcaccccaaccaaaagccagccaacttccacctatgtgagtgagggcatctaggacctaccaaattcaggccattctgccaataccaccgatgcatcagcaagcacagctaagaggagctgaggttttcccaggccagaagaagacacccaccaggatcatgagcaatattaatggccattaagtttgggagggtttgatatatgaaaatataaactatatcccaagttttaaagaattaatatattcttcaaaataaattctggcaatgtttatatttccacatctggaaaatgatgatagtaatagaacatacctaaaagtgctgtgaagattgaatgaaatcatagaataataaatgtgttagtccatttgggctgatataacaaaatttcataaaccaggtagcttacaaacaacagatatttatttctcacaggcctagaggctgagtagtccaagatcaagacacctgcagatttggtgtcaggagagggttaattttctggttcatagagggcaccatcttgcctgggtcctcacatggtggagggagcaaaggagctctctggagtctctcttataaggtctctgtcctcatgacttaatcacctaccaaaaggcccacctcctattaccatcactttgggggctgggatttcaacatatgaattttggtagaacacaaatatttggaccatggcaagaagtaaaacagttagaacaatatatgctgcatagaacactaagaatatgtttctactattataacaataatttttaatctatagggtttcatttttataaagaaatacagtaataactgtattagacactcaataaagattattttgacataataatcatgtgggatttactcctttgtttctgtttgtatattttaaaaagtatactttggaaagaattttttgtgttttcttaccctttcttcagacaaaacggaggaaaatatacagattaaactgttgtcataacttgtctcatttaattttacacttctcttttgataagtggatatttcatgccaaggtacagaactaaatatgtgtgaattccaatctgatagttattcaaggcatcattagcatttcaaagaaatgtcagagtaaatgtccaataggaagcagttcaatctctttttatccacctttgctatgatttttatcacctatatatcacctgattaacaataaaatccaaaatttcatgctatggaaaaattatagaaaacaagttacttttttctattatagagtataacttttgtctattgggtcattgcatctgatttagaaaataaaaatttttcctatttttaaggataccggggctgatgttgatattagtagaaactgtgaatttatttcacaaatatgtataaaacgtttcctgtatatcaggtggcaaagtttcagcagtgtcaaaggcaatgtcctgccttcatggtgcctacattccagcagaaaagatgactacaggcaaatcaagaaatgctataatttctgatgatggtatgtgctgtgaaaaaaataaagcaaagtaatgagatagaaacgaaaggaagatgctataaggcaattaggaaatgtctttctcaggagctgacattgagcagacatagaaatgactgtgaaagtgtaaatcattcaatgttttgggggaggattatttcaaggcataggaaagaagatatgaaaagtccctaaggctggtaagaacagtaagaaggccagtgtggctataatagagtggtaggggattagtagaatggctgacgattgaatcagagatgcaggtaggaatagggttggggtgatatgacttatacttttagaagataattggtatttctgaacatgacaacagcatagtgttctttttaaattattcacctcaattctcataaaaacaagacacggggatagtaaaagaataaaatgagcacatgatagcaaaataaaggaaaaacactacaggtgatatctccagtaaagctaagtattaagaagtccccatggccccgaaacacagaggggtgtagccaaatcacatgacagcagtaggatccggaactgaatcagcagtgatgcagctatagtggtgaagagaaagggaaattcaatggcacctacaagccatggaacccagaaattgccatcagatactgatttcccaaaggagagggtcttgtgctaagcaggagtgtgcagtaaaatttgagaacaactagcagaacttgtacacatcttgtaacaagaccacaggaagtagcttactcccttgagaatatcagaaatctccaataaatgcatacttgtagtaggctacagatccactctgaagaaaaacttctgggagaagaatacaaattgcacagggtgaaaacaccaaagatgtgagggagaaaaacatttcatataatggggcagtaggggccaggtgcagtggctcacacctgtaaccccaacagtttgggaggccaaggcgagaggatcacttaagcccaggagtttgagaccagcctgggcaacatagcaagacctcatctgtacaaaaagtgtttaaaagaaatttaagcatgataatgagtgcctgtgagttccagctactcaggagactgagatgggaggattgcttgagcccaggagttcaagtctgcggtgagctttgatcatgccactgcacttagtctgggcaacagagtgagaccttctctagaaaaaaaaaaaaggcagtgggggtggcatcaggcagatgtccagtagagggagactttgaatgtaatagaatagcaaagcacagtgttcagatgtgagagcaccactttggaaggcaggcgcatggaactcaagaacactgaggtagtagcaggaagccttcctgaatcaagcagagaaaaacctgtatttcttaatacttcatcgtaactgcaaaggagaaggcccttgagatgtgaagggctcatggctactgtggctcatccctgctcccatacaggaatctcttcctaatccatgacatcccttctcattaaacgtgggaaacaaaaaaggatttagatagagggcaattttaggaataaaataaataatgacagtaatggattataacccactgaataaaacagaaagacacgagcccataaataaacaaatgatttaaaagtttgactaggaatgggaatcctaaataatttcaaattgcctccccacaaaatacttattaattagaaagaggaaaaagagacacgctacagtgaagaaatctgggaggccctatcttaatcaaatgatcaaagtgaacaatatcagtaatggaacaaatcaaaatcatatccagtgtggtaaagatgcaatgagaaaaatgcagaatcacttttggattttcctgccaaagatgtacaacctaaatctaattatataggaatatcagaaatatcagagaaatccaatttgtgggccattctacaaaataattggcctgtaatcttcagaagtgtcaaggtcatgaaagtcaaagaaagtcaaatgaacccttccaggctgaagaaaactaaggagacattacaactaaatgcaacgtgtgatcctgaactagatcctttgatcataaacaatattattgggtaaaccagcacatcttgaaggaggtctgaggaatagatgctagtgatgtattaactttctgatttggttgcacggtggttctgtggttgtgtaagaatgtacttgcctgtagaacatatacactaaattagtagttatcaaagtgtagtccagggatgcttggggtctccaagattatttcagaagtttcatgaagtcaaaacaattttcagactaacactaagacattatttgcccatttcactttcattatctcatgagtgtacagtagagttgttcagaggctacatgatgtgtcttttcacagtggaaatatgtgatgcctctttctatctcagctgtaggaactggcacgctattacttcttgacagaagaaagtcatatgtctaaacctaaagtaaatggagtgaggatgtaaatggccacctatgctactgcactgcaatgtaccatggcagaagagagagtaaagaactgagaacagtaatctcatcttaaaaataatgtttgctctaagttttgggtagatgccctttattaagttaaatgtcttatcttctaaggttgctgagaattttaattgtgactagatattgagtttataaagaatgtttttctgcatctgttcagttatgtaatttttctcctttactctgttagtgtgaatgacatttgtacattctctaatgttaaacattagatattaatgggataccaacaggataaactcagtgtggtcataatgaactttctttttggcatcctgctagatttggtttgttagtactttgggatctttccatctatgttcatgaaagaaataggcctttggttttaccttttttattctgtctagtttttacatgattactcacctcacagaaatagttggggaaaatttccatttccctagaagagtttatataagattggaacgatatgtttcttgaaagcctttatatttactttacctttaaaatcatctagactcaacatattctttgtggaaagatttcaaattattcattaaatttatttagtatagaactatctggagtctctatacctttttgaagttttttaaagttttaattatctagaatttgtctaatttttctcagtattaaaattcactggtacaaaattattcattcttctttcttaactttgaatggttttttgtatctgtagatttacccccttttctttcctaataggtttatttgtgcctttttatcttgatcattttgactggaaagtgcatccatttttttagtgtcaccaatgattccatttctggctttgtgaattaatattacatatttgttttctatttcattcatttctgtcctttactattttctttctatgccttttctggatttattctattatttcttataaaatttcttaagctggcatttacctcattagtcttcagcgtttcttcttttctaatatatgcatttaaaatttctaagttccactttatgctgcattcatcacatttgatatttagcatttatatttttgtttaactttaaaggtttttaagttagtattatggcatctcctttaactcatttctcatgacttatttagaaacgtgtatttaaattcataaatatatggggatatatatgggaatcttaatttaacttaattgaattatttttagaaaatatagtgtgtatgaatatgagtctttgacatgttgaaacttgcttatagtcaagatcactttttgtgactgtttcatgagaattacatgtattctccaattgttgaatacaaagctctttgcattatgtcagattaaatttattaatggaactcttaaactcttccattgagtgaggtgtgttgaaacctaattttagcagacttatgttttttcctatgaaatatatgtatattatatctggccaacatggtgaaaccctgtctatactaaaaatacaaaaatcaactggctgtggtggtgcgtgcctataatcctagctactcgagaggttgaagcaggagaatcgcttgaaccagggagttggaggttgcagtgtgccgagttcgtgtcactgcactccagcctgggtgacggagtgaaactccatctcaaaaaaaaaaaagaaaaaaaaaagaaaaaagtctaaagttaaataataccttatccacttccttcctaaacaatttaaaaactttagagcattttacattcaattacttcttctataataaatattgttgtcagtgttttaattattttgttagctttacaaatcaggtgttattattttattcagaccatttttaaatttcaattggtttacatgtttgccattttatttactcacaattcgttcctcagaatggcctgagatcattttccttcttaaagttattctttagaatttccttttatacaggtctctggtggtcaatgctctagttttcaactgtgaatatctttctattttactctcatttatttaaaattcataattttaggttgatagttattttctctcacagtttgaagaaattattccacttttttgtggctttcatctttccttgttaattctgctataatgatacctgtctttcttgtgggtgatccatcctttctctccacctggtttgaaaatctctgtatttttcaatttcacaataatgtgtctcactatggatttctgtttatttatcctgcttggaatacagtgtgctttctggacctgtgaatccatatttttatcagtttggaaaaaaatcagccattatccatcaaaaaatgtcctctcctacattttttaaaaaaattatttcatcccggccgggtgcagtggctcatgccgtaatcccagcactttgggaggctgagacgggtggatcacgaggtcaggagatcgagaccatcctggctaacactgtgaaacccggtctctactaaaaatacaaaaaattagcctggcattgtggcgggcgcctgtagtcccagctactccggaggctgaggcaggagaatggcgtgaacccgggaggcggagcttgcagtgagccgagatggtgccactgcactccagccggggcaacacagcgagactccgtctcaaaaaaaaaaaaattatttcatcccgagtctctgattcaaagttaatcttctgattccatacttcatatctcttcataccttccaaattttctgcctctttgcccctctgtgatacattttggggaatttttttcaaatgtatccttcagttcatcaattttctcttcttctgtgcataatctgctatttagcctattcatttaggattttaaaagtaatctcaagtattaaatttttcatatctgaaaatgccatttatttttcaaattttcctactattatagtcaccattttttactcattttaatgataaggcatattatttatttaaatattttgtttatatatagtggttctatttcttgtttcctatttccagtaataatatctatagtcattgagcgctaaatatgtctgtgttatttttgttgatatctacttatagtggtttgcttttcaaggtatttagaaataatttattattaactttattacttgattttaatctatggaagcttgtcaatctcatcagggaaggttttctgcagagagaaaaccttgtgcttccctgagctgtgttgactcagccttccagccttccagctgagccagggaacagtgtcccaaatagcaacactattattcccatctgcactcagaacaacaacagccctcctctcttctatcagatgtttttagagagcaagagtgactggagcaggcaatgtctcaagaacatgtcttattcagaatatatttgttctgctgcagaaagatctctcagagtacctagactgacataatactttgaagcataatatttttatttaaaaatgtacatttgtgacaatttcacttcaaaaaaaccacagtttattaggaatcaaaagtttttaacgtgactctttaaatgatttgtaccctactacataggtagggttaataataaattgccttgctctgcatgtttttgtcttgtaatgtatgatgtaatatataatcaataaattatcctgagaattgtataaacgaagaacaagcttattttaattaattatggcctcaaataaagcaaatccttttaaaataagatccccctaaaaagtatatttataaagaacacaaaagaaactaagggaggtttggtattttgaaagaattccaagtagtctatgatcttcatttaaaaaaaaaagcatgcaaaataatcatagagtgtgttttgtacataaatcctggatcaacttgatttgactaaagatagcaaggagctaaactttaataatatatactgtcaacttgtctcaacaagcttttaaaggagtgctgggttttagaaatattagggagaaatattatccacttgttttttttttttttttttacttataatgtaaacttatgtgatgagctagtacattcatttttttccaaatattgagaaaatattttccagttcactttccaggtcaccttcacattgagatagaagtgtgagtcaaacaagtaacaatgagccacagaggaaactatgtagaactgacattcccttaattccccaatgtaaaaaaatcaattatagtttccaaacatacaagaaattaatttaagcaaactccaattttctggaaaggaatttatttcaaaaattacaaagaccaagattccatactaggtaaggggaaccaccaatagatattgtgtgccttctatgtccaaggtcattctatctcatttaatcctcacaaaagtctctgaagtaggtattatggcatttgcactgatgaagaattagatagctagtgaacagaggagcccgtatgagatataaatctggctaatgcaaagccggcttttttccgatacatcacgacgctttgtgtcggattaccctagaacctcctatggcatcagtacaatgcaccatccactggagtgtcctatccaagtagcactggagcttgaaaaccacccagtgggcctctttccaggtatcagtagtgatctttgggtatttattctgattgcacaattagcccaaagattgctggtatgtttagatgctgaatggtgttagatagagcatgtaataaaattccctcttctaagcaacttaagaccggcagctgcctttctgaaaagccacccaggtaagctctgttgtttcctggtctattagccctacactctgccaaactcagcatttactgcggaagccagagaatgctgacattctgacagctcttggacagcagaccatgctgtttgactctgatttcaaacatttataatcttttctcttgttccctttgctcaatacaggagagaggctatcagccaatttccccaccgtttatagcaaatcccaaggctccctcatttccagctgctaagctgcctgggcagactgtattactaaattattgtatctttttggtagagtgcctgatctgtcttggcatgcgctttgcattgaaagaagctcctgttgcaagcaaaggaagccagcgacattcacccttcccacacgtctttcctctgttaccctcaaccactaacttctttgtttcccatgtataagccaagttcacaggggcagtttctcagctatctctgcctccctagggagttaaggatttcaaagagagttctgtgctaggagtatttcccatagcctagagccagatgaataaatggcgtctagtgaataactacatcagaaccaagaggttttgtttctctcttaccaaaatgtatttctttgtaataccacagtcactgtaaccatgtattttcctcatcagaagagactgtattgggggaagagaggaaatagcctctttaactcaagtcggttgttttcaagagtgttggtcctttggtttaacttattttaataacttcccatttatatactatcccaatggattatgaatgtgaaaaaagaactattctgaagaaataaaacaaaaaaagatctacgatctttaaataaaaaagaaagtgattttgtaatataaaagggacagaaactatttttaattactctaaaatgaataaccactccgattcaattttcaaaagttataccttgaatttgaattcaaagtcacccaaatgtcctcagtaaaagctctgagaatgcagtgcattcaaatgtatcctgtgagttttctattcctgtaagcaatgaacagcctagatttttctcatacgtatctcaagagatacttcatttcaaaagagcaggagagttatcaaaagtgtaatactattaacaagatacaccatagaaaatatacagaaacgttaaagataaattatatctagggagtatgttttaaatcaactttgctgttgctatggtaagagatatccaatgtaaaacaaaaatcctctataaggctttggtgctatagccatggcaacaatgatgttcaactctgcgagtgtttccatctgattcagagagaagaaaaaaatatgctttaaatgtatgtaaaatggcttagaaaatcgatcatttatggttatctttcacatgacccttcaaccaattaaagaagacattgtaaagatagcagccagagagcctaaacaaaaggctcatagatttgcttgggtttttcatgatcacagaagctggaaagatccactttagctgaggtgttggtaaatgacatattcatttagcaactatctcacagaaattttcaggttggggcctcatgtaattttccatgcataggaaaaaactaaatgcaatcaaatgacaatttctacctctttaacacaggaagagaaatattaacctaaagtaagaaaatatggaaagtggtgttctagctctgcaaaagaaaagtctcttaaatgctagtctcttaaatctactccaaataggcttttattccacctacctccaccgaatagcccttaacaatatcagcaaaatctctaccttcctgaaatgaacattcataactctcatcttacttgacctaccagctatacaattgatacagattatcacctcttggatgaaacactttcattaactcccaaggtaccacactcttctggttttcatcctacctcctaggctgttccttctcattctctgctcattccttctgtttccaaatgtggaagcattcaagtgctccagggcttggcatactgggacctctttcctgtttacattttctgtttacattaattcctttgctggccccagggtttaacatattactgaaacaactgcaacacccaagtttctgttttcaacctgacttctcccccacactccagacttgtatatcctactgtcttagttatccttatgcctccttttctctcacaccccacagccaatcacacagcgaatcctggtggctctacctttaaaatataactgcaacctgcctatgcctcacttgtccttttctccctggattattgtagcagcctcctaaccatctcctagctttcatttttgcacctcacaggcaattctcaacatagaagtcagagttatcttagtaaaactaaggcaaatcatgtcactcctctgctcaaaactcttcaatggcaccttgatccactctgagtaaaagccaggatccttacaataacctgtgaggccatacgtgatctcagacctgtggatactctgccccaattctcttaaataacataagctcctactacactccttttcccttaactgacatccagctatattgcctcttgctgttactccaatgcattaggcattcttctgggtcatgacctttgtacttgttttttctgcctgggattttcttcccttaggaagtagcccctcctccaacaccttcttcaaatatctattcctaacgaaaccttacttcataattttttcaataaggcctccatggatcacaccattttaaatggcaaccactaattcttattcccttccctgctttatagtttctccacgacacctataaatataaaaaaatatatattttacttacttatgctatcttaggaggagagacatttttgtccctatcatttcattgctatatccagaaattagaacaaaggctggaacatagtggataatcaataaacattctttgactgatggggtgaaataaatatatagatatttgcatgtgaagaaaaattcaagagtgatatcaacatagctaaatgttaacagtgattaacaataagtgactttaaaataaaataaccttttattctgtttataaaataatatctgttcattctagttattagtaaaagtaaagagagaagaaagacactcataattccaacacctaacaaaagttactattaacatttttatattttttcttttgttttttatggacattattttcccccaatgaaaataagatcactctgtttatgtaattaaaaaaaatttaaatctcacctaaaaaattgagacatgtttattttatttgtctaaaaatttattgtctaaaaaattgagacatgtttatttgtatcatatcaatccttgaaatattcaaataactgatacatttgattttgtttctctctttttataaagtacatttggtcttttatagtgactaggggaatgtgtgtgtgtgtgtgagtttttgttagtcattacttttatgttaccgaaatcatcttcggacctgttttctctgttttcatcagtaaatttttgtttctctctttataagttaatagctaatattactgagtgcttataggtgttaagtacttcagatgcattatctgatttcattcccacacaatgttccctcacataataccccataatactctggggtattatggtattcccatttcgtaggtgaggagttgaatgcttagatgttaagtaaccaatcagggttacagggttactaagtagtggagaagcacatgaacaaggtacccatgctccttactgttaaatcatttgcagttctaaaatgagggaattagcagacttgttatctctgttcccctgactccccactcatgcccacgccccgttttccaatttatattaaaatagtctgggttgtaaagtgctgatactatattactgtatattttataccttctcttttcaatttcttttagatttatagtgttacaacaatattgagaacaattagttgaaaacattttatgtcttacaagctttattttacattctagaatcctttatgctactatttcccttgcccattcttgagaatttatttatcacttgatcaactgaagtatatctttgagcaattacttcaaagagataggttgttttctaaattactgatatggtttggctctgtgtccctacccaaatcttatctcgaattgtaatccccacttgattggatcatgggggtggtttcccccatgctgttctcatgacagtgagtgagttctcatgagatatgacggttttataagtgcttgacagttcctcctacacacacactcactctctcttgcctgccgccatgaaagacatgcttgcttccccttctgttatggtgattaagtttcctgaggcctccctagtcacgtgaaacgtgagtcaactaaacctcttttctttataagttacccagtcttgggtagtatctttatatcagtgtgagaatggactaatacaattacatatctgaaaatgacttactatggtcttgcacaccttggctgggcatacaattcttgaatctcaagttcaaatccattgccctaaaaattctatatacaattccccattgtcttctgtaagtaatctgttttattaccttaatatctatctagattcttatatgactttttccttatccttgaaattataaaaatttaaaattcccttctaaaattatttatttcagaaattttgctaaattcagtaaatctgtaatttattattctaggcattctttagctcataaacaaacaatgagagttttcttttattgatgctttacttcactgctacacttttcgttctaaaattcctatcatatgcatattggatctcatggatctttcccctgtgttttatcttttctcttgtaatttttatttatacatttcttctgtctattaaatgtcttaatattctactttactgacttgggtttctcatgatccagtgtattttttgccttctttacagttttgaatttgatatgaatattattcaaccacatgaagcgtttatgatcttacagttttaacccttcatgactgcttagtctggtttcatgcagcgttagtctactgaatatcattgagatccatttgacgttagcattttggaaaatgctcttttcttaagaaaaattttacgtcaaaggatgccactgttttcattcctcaaaacgagccttctcttttgaggtatcatttaatgtctccagctctttctctatttgctcactgttgcaaagggtggtcttagcttgtctcttttggggacctgggatgagttctgtcagggacttaggaaattctccttttcacctttaggattcaaaagagagaagaaaggaaaagcttaggttaactgccagttctgccatattgcacaactctagggtccttcattcacatagtacaaatgtgcctcctgcaattgtggctggtggtggccatgttcaccgcagttttacttcattggcctagtgtagggctgttcagtagaattttctatgatgagggaaatgttctatatctgtgctggccaatatggtaaccactaaccacacatgattactgtgcacttgacatgtagctggtccaaatcaataatttaattttaaattcatttaattttattaacttaaattttactttaaatagtcacatgtagtagtggctactgtaaaggacagtacaggtctatagcagtggttctcatagtgtggaccccagaacagcagcattagcatctcctgaacacttattagaaatgaaaattcttaggccttgctctagaatatctgggggtgggccccagaaacctatacttttacaaactgtccacttgattctcactagaaatgcatattcttaggcctcacttcagaatacctggggatgggcccagcaatctatatttttacaaactctccacttgattcttaccattaatgcacattcttaggccctgctctagaacatcttggggtgggcccagcaatctctgttttagcagatcctccatgtgattctgatgcacattaagagatgagaaccactgctctactgatcacgagttaggagaggatcagaactaacagcagtcacaaaagggacttttttctctattccagtgtttcttttctatatttgaggtgagctgctaggagttaactggggcagtgtcctcattcttcgcttctcacagttgtcctcattaagaaccaactgtgacaatgttcccctcagtgtaagtgaagagtaagcaagtcatgatccttgctttccagtgggactggcaggatccaatggtacctcctcactgcccccatgtatttctttacttcgtgctttaaccttctaaagtcttctccagttactaccatggagagttcttcacatacggggaattatatatcttcagtccagttcagtcttcaatccacttcactttgccttctatcttgcaagaactcttgaaataatcagcatgtagatgtcacccattattaacttcccatactaatacagatatttttcttccttacttttatatctgttggtcatttccaaggtaatacagaaaggagtgaactagaaaaatgctttcagtcttctgcttttccaagaaatcttccatctttctcttaatgccttaccttatatgaaatattaaaagtttttcatataattctatagtgttttatatgtatcatttcatctaattaccaaaacattccagtgacataggttttattactgtcattttccagacaaggagactgaggcttacatggtttaagtgagctatataagaggaatgggtagagcatctgctttgtaagggtctctgatatgcagaaaatgatggctaacatttattggatctttattacggaccaagcattgtgataagtgttttttatccattatcttatttaaggcttataaaaatttccattttacagataatgagcaacactagaaaggttaaataacttgtctaattacacaactggttagtaaaactgcccatttccatgccctggtttgtctgactctagaggttgtgctcttaccggctatgctgtattggtttcttggcctggaaagtaatcaaatggcatgggcagagtaaagagtataacatttcggagggtgtccttacatctcatcatttatcacacagtgggttatttaatttattttccataccactaccaagtctacagtcacgggtttaagggttaatagaaacccattaatctctggtaattttaatattttgcttattttttcttactctgaatggaatccctaaaaccatatgagtcctaacttttatctccattcattctaaatatttactgcacaactactgcatgccagacactaagcgaggtgctgtgttcttgatgtttgctaggtagctgagcaatagtccctgtcaaaacgtttggtgaattgcctggtttactgttaaactctcctcccagtctgcctttgttatgaatatgattatggattcactgaaaacttcacttgaactttaagtatcataagagtatttggaacaaataggcaccttgattgcaactccaaggagttctgtggcttccttgctgcaaatttaaaagagagaactccatctccaaatcagtgacattcagacatgtgcatcactataaaggacaagggtcaactcaccatccagactagtttgacaggaacaattcagagatgaaagagctgctttcaattgctcaagcaatgaattttccatacaatgcacctttccagagtcatgatcaaaggaatccttgctgaagcctgactcacaacacagggaaataattttatgcctaattttttttctctcctgactctctctctctctctcttgctacagatatgtcagtactaatttagttcctcttataaaatagaattaaaatatcttacatttttggagcctgttattgtttataaaatatatacatttccaaggtgtaattaaatataataggataatctgtgaggcaggtactatttcccccagtttgccaataagaaaataaagattatttggctgtacattcattcattcattcattcatttattcaatcttccaacaaacatgtatcacactgaggcactagagtgacaaaaattaatcaaacaaggtccattatcttgaacagcttatagttataaaacatacaaccagacatattataacatgtgtttttaaagaagttttgtgagcttcagaggaagacaaaataaaatctttccagaaaaagatggagccttggaggacaggtaggacttagatatgcagaaatgagtgaggtgcattccaagcacaggaagcatgcacaagcaaagatatggagctcggaaagtacagacggcacaagaaaactgagttgttttgtatgtatgattgctgaaagaagacatgaagggagaatggtgaaaaataaggttgcaaaggtaggttataatgtttgagggatataagtaatctaaccaaagtaatcagcataagtgggactcaaacccaaattttactctgcagttggagctcttaccttgctagtgctatattccaaacttcttaacacagtatatagctcaatcaacttgaaaaaatagatacaggactatcaagagaactcaactcgtttttgaaagccatctatatcattctttcatttaagaactgggagatgtatattttaaggcaactgatgcacaaactctatagacagcgatctcagtatctgtcatattaaaagtaactgtgtttttctgaacactactagaattcagagcagaaatatgagtccccttgaaaaaggggacaggaagccctaagttgttaagcagttgcttatacctggatagatcttgttcactttattgtaaatggaagtgggaatcttggttgagtgaaaatcagaccggctaagttctcagttccatcaatgtttaaggcatgcaagtggtttggctgttatgcctatgtcaccttggcctcttctatgagggccacaacacagagttcaccccttgtaatttttgtccccagtgggtattcactgcctgactcagaactttgaaaagttggagacaaaggtaatgggcataaaatgacccccaactccaacacatacacatgctggtagtgatataaagaaatgtaataggaaagcataatttccttttttattctaaattaaaaaacaatcactttcctgttttatgctatagctgacacaagtagtagaaaaatttggaagcacaaactgcaacaatatgacagtcaagggcatggactcactgatgataaaaagaaaggagggtttacatttccaaatattctccacttctgttatctttttattagggaacgccatttgagacaataagttctgtctctggaataaaatctaacatggaaagcaaaatgaaatttatactccttattaattcattgtgcataaaatcaggtgtcattggttgtattgtgtaacggcttgctgaaaatcattacaaatacacacagcacaattctagtattactttaaaatcagcttccccttgaaaacaaaatccggatattttttataaaaatacattctctaattcttatctgggaaatggctcctaaatgaacagatgatacctttgcaatttgaagttaagagctgcttatttgtcactaaggcagttagttttgactatgcagttttcgttttatatcaagcaaatacatttttttattttcctgttttaaatattattttcatggttacatttatttagagaaaattatctatggtttacacataaaagacaagcatcaattgagcaaattatggcatttataattaaatgcttcttgtatgcagtctccaacactgctaaaggaagccatcactctaacaaaatattgaatatgtttagcataaaattgcattaaacagaccctcagaattcttattaatttatttgggatgaaataagcagattttttttttttttggtcacacgttttcatgtaaattcaccaattcaaaagacttgcttattattcttatttgagacggagtctcactctgttgctcaggctggagtgcagtagcgcaatctcggctcactgcaagctccgcgtcccgggttcacgccattctcctgcctcagcctccagagtagctgggaccacaggcgcccgccaccacgcccggctaattttttgtattttttagtagagacagggtttcaccttgttagccaggatggtctcgatctcctgacctcgtgatctgcccgcctccaccttccaaagtgctgggattacaggcgtgagccactgcacccggccgacttgctcattatttttaaaagcatattttacatgagtgataccggggtacttgataactgactgagccattgttccatttgaaataaaaatatggagacatttcaggtgagaatttttggcattaaaccaaagaatgatgaatagtacatttttcaaaaaagatagcaacaatattaaaaaatttaacaaacagagtcccttgattaacagagactggagtgaaagtgaggtgagactgtgtgaaactcacaaaaggccccagttaggttgatcagtggggttccaagacataactttgaaattaggcaatccttgactcttccttctctcttacctagtcagtatctcagcccatcggattttatctccttttctaaaattgaaatgctttgctctttcttactcagacttttccttttctcattatgagagctcagctcaaatatcacctcctcagagaggcctattctgatccctaatttaaagtaatcatcctcttagccctcaccccacctactactcactgcctcctacctcctccagtcattcctatctaatgtatcatcttcctattttatttacctgaggttacttatatttgttttcttgcttattttctgtccctcccactagaatgtaagatttatggaggtaaggacattccatgttaactgttgaatccctagtgcccaaactctgtggcaagtatttgaaataacacctatccacagtgtcctaattcaggtccttataatatcctgtctgggtacctgtaagagttccctggatggtttccttaatatcagcctcatcttcctcaacccattttttgcactagagctggattgttctctgtaattcaaatctaatgatgtcactccattacacaaagctcttcattggttcttcactttccaaatgaatattgtcgaaccatacagagtggtgtgcagtatcactttaagtagttcaaaaaagaatattttaatttaatagtttttaaaatttattttaatatgcgttaaaacaaaccatcaattagcacattaacgatttcacagatcttattactgaagatgagaaaaaataaaagttataatccatttacagacatggaaaaattaatgaatgtgtctttaaaagagttttgaatgtgatcagagactaatctaaaggataaagcccaatgccttctcttcagtttcacagagtccctgcctatctctctggcataacattcactacttcttgccttgcgctttatatcttggcaaattcaaattatttgcagctccgccaattcatcacattctttatggcctctctctttttagttcagttatctcctgtgcctagaatgcctttggttggctgctttctccctgtttactgtcacatggttagctcttctcattctgtgactcagctcatgaatcaccaacttcatgaagcctttgttgtttgtttgtttctctttcctcaggtttggttaggtactacttctttgttctcccttaacattctgtaaaaacgttttgtttatacctactgcattgaaaaataactatttgtgcatatctatccttcaagtgaaatattcctaagattagggataatgttttctttacattagtatccctagcttctattataggacctattctgaataggtgctcagttaaaataattagttaagagaaggggccataacatcaataattaaaaagttaaattaaaaagttgttcacccacagtatgagacacatcatatatttattcagtcagtagtcagtcaataaactatatatatatatatatatatatatatatatttactaaatgttaaaaagtatgggcacttaaaactagtttgtcgaagagataaatgaaaaggtcttagcaacatggcatagtaggacctgttggtggggaagaaggatgaaccaagactggagtgaaggaaggattgggtaatagctggaggtaacagttgattttattgattataaatgttacatctcatcagagatggtaccacagtccatacttaccaaatcaaaggtgcatgtgggaatgagaattggtggtgctaatagaatacatgtcagtgaaactttcagatatcagatgttctgttttttgtctttcagttgggagatggaatcagtgattatcaatgttcacctgataacaccgcaaaaggggccagggcaaactgctagtaggaactgtgcagagaccctagtatgaaaaaatttattcaataaacagtgtcttctatggaccaaacactgtggatatagagatgattccagtatgatattattatggtttataatgaccataagtgattgctataaaagaagggaactgttgtcgagcttcagagctaacccagggattacatctttgttagacataatagattaaggccatgtgactagaacactcttttcagaaaactttgttagtgcttgagaaataacattaaaatccaagcaaaagacaattctgggaaaatgatgaagtaggaagcaccagaaatctatctccctgcttagacaataattgctctagcagaatctgtctactataactattttggaactctggagtataatgaagacttgaagcgtccaggagaaggataattgggatatccatcatgttaaacatttatcctgatttgaccaatacacactgtacacaggtatcaaaatattacatgtagccccaaaatatgtacagctattatatatccattaaaaatgttaaaaataaaatttgaagtaaagaattaagtaatttcctttgcttcactaattagcagaaaatttgaacataacatacattttgggagtttggattataatcatttttaaggataaaacctataaatccctttcttctctagaccatttgagagactttttataaaaagcatcatttgaagatatgcttttatttttttcttataaagcttcaataatctcttgaagttgttcatacacttctacaatgcatttgctattccactgattattgtgcagtgctattactgaccctaccaatatctctggatcatgctacatttggagaataatattctcccatatatccaacatgcagtggtgggacaggcataggataacctctacagatagttgcaatcaaaaggagggaaaatggaagttgagcaagttactggtctgtagacattctgaaatccagttgggtgcagattgcatttcttgagtagggctccatcttattggagttgttcactattgttcttagttctactttctgggtttttgtttcctccctctgaatgatcctacttttcatataagaaacattcttatgcctgctttctgttcataaaagctcaggggcccaaaggtctcttaatatattgtactttctctgtcccttctattccaagctagggatgcttccaccagaataattatctaaaaacattgtgggatttgtgtttactaattgacaattcgcacaattagataaatgtcatatccacaaatctttctgacataagtctttgtctaccttgagttccctgtaagactgttgtatgactctctacaatcctgtccaacccacggcccatgggctgcatgctttgaatgtgacccaacacaaatttgcaaacgttcttaaaacattatcagattctttttttttttttgcgattttttttttttttttttttgagacggagtcttgctctgacacccaggctggagtgcagtggcacaatctcggctcactggaacctccacccctccaggtttaagcaattctctgcctgagcctccggagtagctgggattacaggcgcgtgccaccacacccggctaattttttgtattttttgtatttttagtagagacggagtttcaccatcttggccaggctggtcttgaactcctgacctcataatccacctgcctcggcctcccaaagtgctgggattacaggtgtaagccacggcacccggccttttttgtgatttttttaaagctaatcagctattgttagtgtattttatgcatggcctgagacaattctttgtccaatgtgtcccagggaagccaaaagattggacattgctgctctgcaatgcccttagattctcagaacccttattttttagggcggaggagactcaaggcatgcccttaaggtcttaggtcttctgtcatctgaaagtttctatgagtcactatatttgatcttttgagggcttaataaggagttttgtaagcatacccagggattacaccttagactttacttccctgatagcgctctggatttgaactctgacccagagctatttattaattttagtttcatttgacatctggagagactaagaacaaaaaccactttttttttgtacaaataatcttgccccctttgtaatgaacagtctgttcttttacttatctctgttttctcacattttgtcatctaacaagaagaagacaggtggcactttcaataatctgcctggaaatcttagattgtcattagatacttttactattttccatgttattgcaaccaacagaattgccagacattctgccaccatattacaaaagtctcctttcctccagcttccaatcacattttccatactttcctttaagctcccagggacgatctacccagcgcttctgctaacacctgcctttttagtctttccccaacattcttcatgaagcactttcactaacactttttcaatgcccttttagtttctgcctgctacttggttcaaaacctacaccatatgttataggatactataatatgacatgataatagcatcatatttccaggtattaaaatttgttctagtcctctattgttacataaaatagtatcttaaaaatgcagtttcagtaagacagtggatgggactggggtcaatgcaaaggttttctcactcacatgtttggtggttaatgctggctttcaaatgagactttacttgggttgttagccagaacagtacacaggacttctccacatggctattgtgcttccttaaagcatggtggctgggttctaagagtgagatttccaaaggaccaggcaaaatctacattgcctcctatgaccctagtcttgaaggtcactttttaataattgtttttattttaaaatttttgtgggtagatagtaggtgtatgtattaatggagtaaatgaaacattgtgatacagccatataatgcataataatcccagaaggataaatggtgtatccatcatatcaagtatttatccattctttgttttataaacaatttaattctacctttttagttattttaaaatgtacgataaattaatgttgactatcgtcaccctgttgtgctatcaaatactagattctattcattgcatctaactactttttgtacctattaaccaccccctgtccccactatccttcccagcctctgataaccttcattttactctctatcttcatgagttcaattgttttgatgtttagctctacaaataagtgagaacatgcaaagtttgtctttctatgcctgtcttatttcacttaacataacatcctccagttccatctgtgttgttgcaaatgacaggatctcattcctttttatggcttaatagtactctattgtgcatatgcaccacattttgtttattcatttgtttgttgatggacacttaggttgtttccaaatcttggctattgtgaatagtgctgcaacgaacatgggagtgcatttatctcttcagtatacttcttttggggtatatacctggccacttagtgtcacttgtgccatagtcactggctataccatattcaaacataaatataaatctcacctcttgatggaaaaatgtcattatcattttgtaaggaaaatgtatagatggaaagatgttattgtggtcatccaaaatacaatctgtcacagtctgtgatagctaacctgctaaattcatcttcagtctcaattttccattaaaagaaaagaaatgattttgagtgacactagctcccagtgtcagcaatttaaaaattaaaatgaacttgatgatgcttccctgagaatgccagaagtagtaaattaagaagtaaacttttcaagagaaaaaactgtcctggatctaaaagagtaggaatacagacaacaatactccctatgccagaataatttagcatgcttactctgttagattttactgagtccttacttagcagacaaaggatgaggtttattactttttgatgaatgagagttgagttagagaagctctgggtgaatatttcatctcactagacggtttgggacattaaattttgggcattaaattatgtccccatctcctcccgaaattcaaatgctgaagctctaactcctagtagcttagtgactgtatttggatataggccctttaaagtgatgtatttggatataggccctttaaagtgatgattaaagtaaaatgatgctgttatgatgggccccaattcagtattactgatgtccttataaaaataggaaatttggacatgctgagagacacttgagatgtgtttacacagagtggagggccaccatgtgaggaggaagcaagagggtgagcatctctctcacctataaggagagagacttcaaaagaagccaaccctgctgcaaccttgattttggacttccagcctccagaactgtgagaaaatacatttctactgtttaagccacccagtctgtgatattttgttatggcagccctagtaaaagtatacaccatttttaaagtaaggataataaaaccttcttctgacgatggaatcagacatttaaaaaacatcacactgtgcctgccattttataggtagcagatgaagaaatcaccctttctgtaataagattgtgctacatatcagtcagtagagaaaggtgaaggctcaacaaatatggaggccctttaatagtcttgtaatattttacttctctggatgttacatgatctctgtatagttccttaatattttattagataaacactgtgacccctttttgaagtcacctaacttacgtctacattcccctttcttgccgaatatcactaggtcccttctcccctacctgtcatgagggcttacttcctaacctgatgatcacagagcagttcttgaaaggagtcttgagataccttcaagtacaaaagagaacttgttattttgatgtattaaaaaactgagacgtgatagtctccaggtgccatctgataagcactccccctcatccattcctatctgccatgtagttcttagtaaatgacaaagtcttattttaaaatgtgactgtgtttatttcccactgagtacccaatgaaaggaagatcacccctatttacccttaccatgaattaaaagcaaaaacaaaatcactggattcctccacaggccatgtaagaatcatgttatcaaagctactttggtgccacatcgaaaaatggcagctgagaatccaaggaaatattgattttaccagcagaaaagggtctgtgaaaattaaaaagaatattgtttattggagagaaatataaaataataaaataggaggctctaaagctatgtgtacacatgaaatgttgaagatagaaccaaagatgcacttgtgggttagtaaagagttcttccctttacttctgaggctcgcccagttctacagaagtccttgagtcctcggtactgttcagtagtttgggaagcaaaactgaaccctatgcagtcaagatctggttcaagatagtatgtgcttttgaactggtatgagtcactaactggtgctgagtcttaagggaactcagagaaaaaggtaagttcttgatcactgtaaggttgaatacacatttatggggtggaacagaccagaccattgtgaagtattgccccatagactattcctgaataggtctcatctggtagcctgaacaatagatatttgtctttcctattcaggagataatttgaacatgctttgtgatcattctcagcagattcacttgatttgtgagcaaactgatgaaagtgataatccacagacctaattctacattttaagagataaaagataaaactcttcaagcgaggatattagaaatcaagctgtctgccaaagattaatattcccttccacagaatggagccgctgtgttgctgggaagcagctgcccatcaggaattacatttctctagctcccttcatttaagtgggaccatgtgacagagagctggccaagagaatgcaggcagaagtgatgcacaccacatacaggcctggcccaggggaaactttcatgcagtcttccactgtctttcccatctgctggctagatatcaacactgaggctgacttcggaagccatgtgttgaatcctgcaaggtctctgtatgaacccctgtgtccaggtcccatcatttggactttacataagcaaggaaaatatttgctattatgataaaccactacaattttggggatgtgtctgttcccacagctgatatttatcttaactaatatggacagagacataggaaaaaagaagttccccaaatatattttgtttccatatgcttttgtgtaccctcttctgcacttcctccccctctttgattcttacacatccttcaagaccaaggtcaggcatcacctcctccaagaagactttgaaacctccccaagctgagttaaatatggatactgcatgaaggattgtaatcttctgtgtatgtgatcatgtcccaatatctaacaacctaactggtacatatttgtaaaattaatatgtaaattaataaaataaatggagaaaggtaaatacttcaagcaaaaaataaaaagtacaagtcatcctgaaaatatgaaaggaaaagtctctactggctgtggacaatgtaattgcattaaatatttaaaaatatctaggtatgactagcctttctgctgcttcatatgatcttgtattaacctaaattattgcacccaaaatgtagcatatggcacttggtacaaatctgactctttcactagattgcgaatcccctgaagacaaagactgtggttttctttgtgtttccattttcaggtcccagaatggtgcctgaaatggtgtaggccctcaccacatgcccattcactgactcgttgactcactgactggctccaggctggccttgaattcctgggctcagactatcctcctgcctttgtccttttgttctgagtcttcctcagcattttctgccaacccttcttttcaggctgacatgggttaggaggtaatctgaaagctttcaccaataagaaaaattaattgaattacatcagctctattataaggaaaagggctattgagatataatctacatactgtaaaattcatctgtttaaagtatacaattcaatgatttttagtgtacttagagaattgtacagccactcccataatctaattgtagaagatttccatcatccaaaaaagaaaccttgcagcagtcactcctcattcacactcttcccacccccagccctaggcaaccactaatccagtttctctctctatagatttgcctattctagacacttcatataaatggaagcatgcaatctgtggggtggggtggggggaggttgtagaagctttatcttttgacaaatgctgattagccttgtaaagtgcagttgaatattatcaaacatgttctcaaaatgaacaaatataggaataagatgggggtttctataactgtctaaattactgagaaataataattaggggttgggcatggtggctcatgcctgtaatcctagcactttgggaggccaaggtgggtggatcacttgaacccaggagttcaggaccagcctaggcaacatggtgaaaccccatctctaaaaaaattagctgggcatgtggtgcatgcctatagtcccagctacctgggaagatgaggtcggaggatcacctgagcctgggaggttgagggttcagtgagttgtgatcgcacaactgcactccagcctaggtgacatgagtgagaccctgtctcaaaaaaataaaaataaaataaataataattaaaggaaccagcagctcaaaatatattataaacaattctcataattgatattttatccaaatatcaaaaattcatacatttttcagatgaagggtctccagagaaacagaaccaatagagtctgtgtgtgtgtgtgtatgtgtgtgtgtgtacgtgcatgtgtgtgtgtgagagagagagagaaagagaaagagagattgttataaaattttataacaaacactaacatcgaggaatgctagtgagtagacatgcagctatatggtttggcagggcctgccagtgctcaccataaatgtcttctccttgtcttgctggatacataatctgactctcttcctcaactgtcctttataggtaggtgaccatattagttagttctggacaatggaatataagcacaatttatgtaagcacaagttatgtgttttacttctgggctgccatggtacattttatgttaacctgatggggccacagagtgctctggtttttggccaaacattattctaggtggatctgtgagggtgtttctggatgggactaacatttgaactggtagactgagtacagtagattgccctctctaatatgggtagggcaatcagttgaagactaactagaacaaaaaggccgagtgaaaaggaattcccattacctgactgcctttgggctaagatgttgttttcttttctgctttcagacttggatggcaacatcagctctcctgggtctccagcttgctgactgcagatcttaggatatgtcagcctccgtaatagcatgagccaattccttataataaatctctctctctctctctctctctctgtctgtctctctctctctctcacacacacacacatgcacgtacacacacacacgtgcgcacatacacacacacacacacactctctctctctctcgctattggttctgtttctctggagacccttgactaacacatgagcctaaaccataaccccttccacagagaatccttgctctcttctctcatctacttactgaatggatggagaggatgctatgaacctagggaaaggtggggccacaaaatggtaggcatctggggtccctgaataaagcataagaagagagctgcctagtctaccttcattgtactgcaacatgaatgagaaataaacacttattgtgctgatccactcagagtatgcggtttatgtattatggcagctagtggtatttactgtagcatttattacatgctagatttttatgaaattgaagggtaattcactcaagtcaaaatgtaactaaaaattaactgtttcagtggaatgaatacctctttgcttgtgaattttcaaaattaaaagagaaaagtctgagtcatgaactgatagtagaggggtgctttaccatgaccagtgttctggctcacatgaagccatggagtctagcccaagtagctgaattcagtggcaatgttcagatctgactcatccagtctggctcttcttaagagacaaagaacaaatactgtctgttggcgggtacttccaaaataattagcaagcaccagcatacttttattatttttttctggctatacaaacgcccataactagtatatcaaacttcatgactgtgaaaaaataaaagaacttgtgaaaagtaagaaacattttgccaggaagcaatttcattaatagagaagtagaattgtatactaggaggaacatgggctttgaaagtaggctgtcataggtttaattcattcatcactattaattaattcatcaattaaacaagtgtgtactgagaacctactaaattgaaccataaagatgctgatactcaactttatttgaactacaaaaataatggttttgtatgattcagtctaatacataacagccactgttgtatgtgctgggccttcagtaagaataaaacaaagttcctgttctcatggagattaccttttagtggtgagagatcaaaagaaaacaagtcaaatgtatagtatgtgcagtaataatacaggcaattaagaaaaatatagaaggtaaggaagatgggtgtgttgtgaggggaggaatttgctattttgtggtagtcaggaaagcatctttgataaagccatgtttgagtagagaactgtaggaagtgcagaaataagccatttggctacctgggagaagagcattctaggcagaggaaatagcaggtgcgaagtccctgatgcatgactatgcttggtatgttcaagaatagcaatgccagtgtggctggagcaaagtgggcaaaagagagagtagtaagggatgagatcagcaaggcataggactacctcatgtaaaccttgccttacttttatagggcttctggttttcactgatttaagagttgaaaaaccttggagggtttgggggagagatgtgacatgtgttttcaaaagactactctggctactcttgtgcgaatagactgtagggaagagaaggtcgaagcaggccaattaaaaggctattattcccctaatccaggcaggaaaagaccatggcttggtctaaaacattaggtatgcagctagtgagaagtggttagcttttgttctatgaacgtagaactaacaagatttactgatgtatcggatgtgccatatcaaaaaaaagaggtgctaaaaatgttctgagcaagtgaaaaggatggagttttcattaactgacatggggaaacctgaacaaggaagaggttttatggctgtgagaatttagagtttcgttttagacatttaaagggtgaaatgcctactagacattcaaatggagaggtcaaatagtcaagtaggcagctgaatacaacagctgcagagagactcaggttaggaatataaactttggagtcatcagcatgaataagacaataaactattgaggttaattgagaaaaaaagaaaagaaatagcggagacaagaactaagcctggagcattctgacgtttaggggtcaaagaaaagagaataaaaggaagcagctggggatgtcagaagagatgtttagaatgcaagtcttcattcttatgagacctctccaggtttcagtttccataagtgaaaaatacagaaaataattcctaggtcagaggatttccaaaggctgaaaagaagtaacatgggaaagcatacataagatctagaatgtgcttaataaatgttattcctgactcttggtgaaattctgggtagatgccagatttctcatgcttccttctattttttggctcctcaatcaggtcctcaaatatgaaccctatagtccaacagtgttggctatggaagtaagagcctcattattcttcagttattagttatacatttttcagtgatagagctcactgttatcagatattcatctttactgtttgttctcttcctgtgttttgtgaggagtcaggtttaaaggagagtggtcactaatgtgaagctgggaaaatggagggaggatgagttctttatcacctggcaggagtgtatccttacttcaacatttaactgctcaccaaataatttaatttcagaggatttgtttcagtgctatggaagaactatctgtatataaatagctgggttaagtagatctttcactgcagctgttaaaacctattgttgtagctagacaccttgtagtgattcaagatcatctgtctttgaagaaagtctatgctttcttttatgcacatgtagtttcttttagttctgaaaataaaataagctttacttaggaagactaaagaaaatgtttactgaataaaccaggggtagctgaaataataccctgccacaatctcctgcttttatttcatttatctgctttcaacatttaccactgaatacttattgaaagaataaaggaaaaactaaatgaatggatgaattaatatctgaatggcttttttttgcttttccttaacaagactcctcctaaataatcctaaataagttctgggttaccctgaggattatcttttacaacaagaatcatgaagtaggaatactttttcataaagaagagataaatcccagagtaacaccgaaacttacctagtaaagtagtaaacaatctgtagggaatctcaggggatcatctgatcctagtatcaggctcaagcagattctttttcaagttcttatccctcctcctcttccccaccccaacccagttggatttaaattgtgtatattagagcctctttgtaaggaagaattgggcagcagtgcagagagaaggaagagttgggtgctttaccctactgctagcacttgggtgctcaaagtagagaaacaagaaaaacaggctactggtaagatggacaataaaatgagctgcattgggtgaactgtgacctagattataacagtgctttacaaataatattccaaattataagtccctaaaattatccaaatctagattttaacaatcccgaaagccattcattttagaaagattttattttcctgtatccttccctccatttctactcctgccaccttagtccaaaccagtgttttttttcttgccaggacaatgacaaaagcttttcaaccagtctcttcattgcttctgttgctcttctgtaatccattctccatgtagcacttggaataatccgactaaaatgtaaatcaaatcaaatcatttctctacttacaatctttcaatggctccctatagtacttggaacaacgtccaagctcctccctgtggtctttaaggttttttgtgatccggcccctccctgcccctctaacatcatattgagtcattctctccttcactattctccagctacattgacatccttttacatgtatggtgcttgtgtatgtttgtacatatctatatagtgtatatacatataactattttttattaggatataattggcatacaataaactaaacacacttaaagtgtataacttaaagttttcagatttagatatatgcatgaaaatataaccacaatcaacaaaattggcatatctatcatccaaaaatttccttttacccttttgtaatttctcactcatgtccctcattatcttctcatccaccaggcaacaaacaatatgctttctgtcactataggtaagtttagcttttctagaattttatctaaatgaaattatacagtatatacttttttgtctagctgcctttactcagcatagttattttgatatttatccatgttgtttatattaatagttcattcctttttattgccaaatagtgttccattgtatggatatagcataatttatttatccattcacctactgatgaacatttggtttgctgccaggttttgtctattagaaataaagctactatggacatttgtataaaactcattctatcgccatttgttttcatttctcttcaaaaaatatctaggtataaatgaccgagtctagagaaggtgaagcaaaatgactgaatagaactttccagcaattgttgcccctgcagaataccaaattgaataaccatccacataagaaaacaccttcataagaaccaaaaaccaggtgagtgatcatagtacctggttttaacatcataccaatgaaagaagcactgaaagagtatgaaagatgttggcgccacccctccctcatcccctggcagtgactgtgtggcatggagagagaatctgtgtgcttgggggaggaagagagcagtaattgtgggactttgcactgaaattcagtgctgtgctgtcataacagggactaacacagggcagaactcagctggcacccaaagagtgagcatttagaccagccttagccagaggggaatcacctagcagtattgtcagaattctgacaagcccaaaaacaagctaaagcgctctggagttctaaataaacttgaaagatggtctaggccacaagaattgcaatttgtgggcaagttctgatgctgttctaggctcagagtcagtgaatttggggtgcatacaacctagtgagatgccaaccacaggggcaagggaatgtttgtgccacccctcagccaactccaggcagcacagcttgcagctccaggattcacaccttccttctgcttgagaagaagagaggggagaggaggacttcgtttttcaacttggataccagctaagccacagtaggacagggcaccagggagagtctgacagccctcattccaggtcctggttcctggacaaaatttctaaatatatcctgagccagaagataacctgcttccttgaagggaaggacccagtcctggcagaattcatcacctgccagctaaatagcccttgggccttgaatgaacatgagcaatacccaggcagtacttgtcataggccttgggtaagacccagggccacactggctttatgtgtgactgagtgcattcccagcagctgtggccttgaggagagaatcctgtttgaggaaaggagagggaagagtaaaggggactttgccttgtagtttgggtatcagcttagccacagtggagtagaacatcaagcagtttccaagggtccccagttccaggccttggttcttagatggcatttctggatccatcctgggccagagtgaagactactgttccgaagggagagatccaggcctggcagcattcaccacaagctgactgaagagtccttgggcctggagcaaacatcagcagtaaccaggcaatcctcactgtgagcctagaacagtggtggccacagcgagagacttcttctgcatagaggaaagagtgggaagaatgttgtcttgtggtttgggtgccagctcagccacagtagaatagagtaccaagtagattcttacgtttcctaactctagacctgggctcctaaatggcatttcttgtcccactctgggccaggggggagctcaccaccctgaagggaagggcataaacctggctacatttgctgcctgctgactgaagagcctttgagtcttgagtgagcatcggtggtagccaggcagtggacacctcaggacattgacaagacccagtgttatgctggcttcaggtctgacacagtacagtcccagtgatggtgaccataggggtgcttgtgtcaccccctctgacagctccagggagcccagcatgcagagagagactccatttgtttggaggaaagcgagagaagagaacaaatctctgcctagtaatctaaggaattcccctggatctcacctaagaccaggaaggtggtatttctacaagtctgtaagagtcccagtgttactgagcatggagtgccccctaatgcagatattgcaacagtgactaaagatttagatcataacacttgaatacttggaaagccttcccaagaaggatgggtacaaataagctcagactgcaaagactacaataaatacctaactcttcaatgcacaaaaataaatgaacacccacaagcattaagaccattcaggaaaacatgacctcacaagacaaactaaataaggcaccagtgaccaatcctgagtaagagatatgtgacctttcagagaattcaaaatacctgtttttaggaagcttaacaaaatttaagataacacagagaaggaattcagaatcttatcagataaatttttaacaaagatattgaaataatttttaaaaatcaagcagaaattctggagctgaaaaattcaattgatgtacaaagaatgcagcagcatcttgcaatagcagagttgatcaaacagaagaaagaattactgagcttgaagacaggctatttgaaaacacagagtcatagaagacaaaagaaaaaagaataagaaagaatgaagaatgcccataagatgtagaaaatagcttcaaaatagcaaatctaaaagttcttaatctttaagaggaggtaaagagagagatcagggttgaaagtttattcaaagggatagtaaaagaaaattttccaaatctaaataaagaaatcaacttacaagaacaagaaggttctataacaccaagcaaatttaacccaaagaagactactttaagtcttttaataatcaaactcccaaaggtcaagtataaagaaagaaacttaagagtagcaagagaaaagaaacacatagcatacaaaagaacttcaatatgtctggcagcagaattctcagtggaagccttccaggccaggagagagcggcatgatatatttaaaaggatgactgaaaatgcttttatcctagaataacataggtgaaaatatccttcaaacatgaaggagaaataaagatcttcccaggcaaacaaaaggtgaaagatttaaccaacatcatatctgtcctacaagaaatgctaaggagagttcttcaatctgaaagaaaataatgttaatgagcaataagaaaacatctgaacatacaaaactcactggtcataataaataaacagacaaacacgtaatattagaacactgtaactgtggtgtttaaagcacccatatcttgagtaggaagactaaaagatgaaccaatcaaaaataataatggggtgataaagttaaagtgtatagagttattagttttctctttgcttgtttgttaatttgtttttgcagtcagggttaagttgtcatcagtttaatgtaatgggttataagatgttatttgcaagcctcctgataacctcaaatcataaaaaaccctacaacaggtataaaaataacaagaaattaagatatacctcctgagaaaaccaccttcactaaatagacaaagggaggaagaaaggaagagaagaccacaaaacaaccagaaaacaaataacaaaatggtggtagtaagtccttacttatcaataccactgaatgtaaatggactgaactttccaatcaaaagacatagagtggctgaatggatgaaaaagcaagacccattgatccgctacaagaaaaacatttcacctataaaaacatttcacctataaaaactcatcgagactgaaaatgaaaagatataaaagatatttcatgcaaatgaaagccaaaaaaagggcaggagtagctgtgctcatatgagacaaaataagtttcaagataaaaactacaaaaagtgataaaagggttattatataacaataaaggtgtcaattcagtaagagaatataacaattgtaaatatatatgctcccaacactggaggatcagatatgtaaagcaaatattatcagagctaaagagagagacagatcccaatacaataacagctggaggcatcgatgcctcactttcaacattggacagatcatccagacagaaaaatcaacaaagaaatatcatagttaatctatactatagaacaaatggacatcatagatatgtacaaaacatttcatccaatggctgcagaatacacattcttctcctcagcacgtggatcattctcaagtatagatgatatgttaggtcacaaaagaagtcttaaagaattaaaaaatattgaaatcatatcaagtctcttctctgaccacaatggaatgaaactagaaatcaataacaagaagaatgttagaaactatacaaacacatggaaattaaacaatatgcttctgaatgaccagtgaattaataaagacattaaaataaaattttcaaaaattattgaaacaaatgaaaatggaaacacaacatatcaaaatctatgggttatagtaaaagcagtactagagaaaagtttctagcaataagttcctacatcaaaaaagtagaaaaactttatataaactacttaattatgcattttaaagaactagaaaagctgaaaagctagaacaaaacaaacacaaaattactagaagaaagcaataataaagattagagcagaaatataacagaaacagaaaagaataatacaaaacgtcaatgaaatgaaaagttggttttttgaaaagataaacaaaaatgaaaacttttagccagactaagaaaaaaactaaaaaggcctaaatacaatcagaggtgaaaaaggagatactacaactgatactccagaaattcaaatgatcgttagagaattctatgagcaactctatgccaataaattgaaaaatctagaagaaatggataaatgattatacacagacaacctaccaagattgaaggctgaagaaatccaaaacctgaatagactagtaacaagtaattagatcaaagccatactaaaaagtctcccagaaaaaaaaaaaaaaaaggcgtggacctgatggcttcactgctaaattctaccaaatatttgcagaagaactaataccaatcctactcaaacaattctgaaaaataaggggactacctctaaactcattctatgaagccagtattatgctgatatcataaacaaagacacatcacaaaaagaaaactacaggccattatccctgatgaacattgatgccattgatacaaaaatcctcaacaaaataagagcagtccaaattcagcaacacattaaaaaggtcattaatcatgaccaggttggatttatccctggaatgcaaggatggtttaacatacacaaatcaattaatgtgatatatcatatcaacagaataaagggaaaaaaacataaaatcacttcaatagatgctgaaaaagcatttgataaaattcaatattccttcataataaaaactctcaaaaaactggggatagaagaaacatactttaacataataaaagctatatatgacagactcacagctagtataatacttaatggggtaaaactgaaaactcttcagttttgaagatctggaacaagacaaggatgtcctctttcaccactgttattcaatataatactggaagtcctagtagagtaatcagacaacagaaagaaataaaaggcattcaaatgggaaaggaagaagtcaatttatccttgtttacagatgataaaatcttatatgtggaaaaacccaaactaattcagtaaagtggcaagatacaaaaccaacatacaataatcaatagcatttctatatgccaacagcaaacaatatgaaaaagaaatcaaatcccatttccaatagttatgaataaaataaaatacttaggaatagacttaaagaagtgaaagatatctaaaataaaaactgtaaaacactgatgcaagaacttgattgaagaggacacacaaaaaaatggaaatatattccatgttcagggattggaagaatcaatattgttacaataaaatgctcatactaaccaaagctatgtgcagattcaatgcaatccctatcaaatatcaatgacattctttgcagaaatagaaaaaaaatttcctaaaattatatggaaccacaaaagaactaggctagccaaagccatacagagcaaaacaaacaaaactggaggaatcacattaccagacttcaaattatactacagaaatattgtaacaaaaacagcatggttctagcataaaaacaggcacatagaccaatggaacagaacagagaacccagaaataaattcacacatgtacagtgaacttatttttgacaaaagtgccaagaaaacacattggggaaaggacaatctcttcaataaatggttctgggaaaactggatatccttatgcagaagaacaaaactagaacctatctctcaccttataaaaaatcacactacctgacttcaaactatactacaaggctacagtaaccaaaacagcatggtactggtaccaaaacagatatatagaccaatggaacagaacagaagcctcaaaaataacaccacacatctacagccatcttatctttgacaaacctgacaaaaacaagaaatggggaaggattccctgtttaacaaatggtgctgggaaaactggctaggcatatgtagaaagctgaaactggatcccttctttacaccttatacaaaaattaattcaagatggattaaagacttaaatgatagacctaaaaccataaaaaccctagaagaaaacctaggcaatatgattcaggacataggcatgggcaaggacttcatgactaaaataccaaaagcaatggtaacaaagccaaagtagacaaatgggatctaattaaactaaagagcttctgcacggcaaaagaaactaccatcagattggctgggcatggtggctcacgcctgtaatcccagcactttgggagggcaagatgggcagatcacgaggtcaagagaccgagactattctggctaacacagtgaaccccatctctactaaaaataaaaataaaaataaaaataaaaataaaaataaaaataaattagccaggtgtggtggtgggtgcctgtagtcccagctactcaggaggctggggcaggaatgaacctgggaggcggagctttcagtgagccaaaatcacgccactgcactccagcctgggcgacagagcaagactccatctcaaaaaaaaaaaaacgaaacaaaacaactaccatcagagtgagcaggcaacctacagaatgggagaaaattttcacaatctacccatctgacaaagggctaatatccagaatctacaaagaactccaacaaatttacaagaaaaaaaagaaactaccccatcaaaaagtgggcaaaatatgtgaacagacacttctcaaaagaaaacatctatccagccaacagacacaaggaaaaatgctcatcatcactgggtatcagagaaatgcaaatcaaaaccacaatgagataccatctcacaccagttagaatggcaatcattaaaaagtcaggaaacaacagatgctggagaggatgtggagaaataggaatgcttttacactgttggtgggagtgtaaattagttcaaccattgtggaagacagcgtggcgattcctcaaggatctagaactagaaataccatttgacccagcaatcccattactggatatatacccaaaggattacaaatcatgctactataaagacacatgcacacatatgtttactgcagtagtattcacaatagtaaagacttggaaccaaccccaatgtccatcaatgatagactggattaagaaaatatggcacatatacaccatggaatactatgcagccataaaaaagggtgagttcatgtcctttgcagggacatggatgaagctggaaactatcattctgagcaaactatcacaaggacagaaaaccaaacaccacatgttctcactcataggtgggaattgaacaacgagaacacctggacacagggtggggaacatcacacactggggcctgtcggggggtgggggctggggaagggatagcattaggagaaatacctaatataaattacaagttgatgggtgcagcaaaccagcatggcacacgtatacctatgtagcaaacctgctcgttgtgcacatgtaccctagaacttaaagcataataaaaaataaaataaaataaatcaaatcaaaatggattaaagacttaaatctaagatttcaagctatgaaactactaaaagaaaatggggaaactctccaggacattggactgggtaaaagtttcttgagtaatatcccatgtgcacaggcaagcaaagtgaaaatggacaaatgggatcacatcaagttaaaaagcttctgcaaagcaatggaaacaattaccaaagtgaagaggcatcctacagaatggaatacaatatttgcaaactattcatctgacaaggaattaataaccaaaatatataaggagctcaaacgactctataggatagaaacctaatactctgatttaaaaatgggcaaaatatctgaatagacatttatcaaaagaagacatacaaacagcaagcgagtatgtgaaaagatactcaacaacactgatcatcagagaaatgcagatcaaaactacaatgagatagcatctcaccccagtttaaatgatgtttatccaaaaatacgagtaataatgaatgccagcaaggatgtggagaaaagggaaccctcgtaaactgtttgctggaatgcaaatttgtacaggactatggagaaaaatatgtaggttactaaaaaactacaaatagaaccaccatatgttccagcaatcccagtgctagttatatacccaaatgaaatgaaataggtatataagacagatatctgcactcctacatttattgcagcactgtttacaatggccaaaatttggaagcaaccttttgtccatcaacagataaatggataaagaaaatgtggtatatacacataatgtagtactattcagccataaaaaagaatgtgatcctgtcatttgcaacaacatggatggaactggaggacatcatgttaagtgaaataagccaggtacagaaagattaacttcacatgttctcacttatttgtgggagctaaaatttagaacaattgaatccacggagacagagaatagaatgatggttaccagaggctgggaagagtagtgggggcaggaggagaaatggggatggttagcggatacaaaaatacagttataaacaataattaacatttagtaattgataacataacagggtgactacagtcaacaataaattattgcacttcttttttttttgagacaaagtttcgctcctgctgccgaggctggagtgcaatggcgcgatcttggctcaccacaatccccgccttccaggttcaagcaattctcctgcttcggtctcccaagtagctgggactacaggcatgtgccaccacgcccggctaattttgtatttttagtagagacggggtttctccttgttggtcaggctggtctcaatctcctgatttcaggtgatctgcccacctcagcttcccaaagaattattgcacattttaaaataactaaaagaatataattggaaggtttgtaacacaaagaaataataaatgcttgaggggatagatagcccatttaccctgataattacacattgtatgcctggatcaaagtatctcatctaccccataaatacatacatgcactacgtacccataaaaaaattggctgagtcatgtggtaggtagatgtttaacatttaaaaatacagccaaaccattttccaaagtgattataccattttatattcctaccagcaatgtatgagagttccagttactccacatgttcactaacacttggtatgatcagctgttaattttaaattttgtaacaggtaaatattagcccaatggctaatgataggaagtattttttttcacatgctgatttgtcatctgaatatctgcatatcttctatggataggtgtccattaaatcttttgctcatttaaaaaaattgtcatttgtttccttattactggatttgacagttcttcacattttccatattaactcctttataagatatgataattggaaacatattctcccagtcagtggtttgtcatcactgtctttgcaatgtttttcagaaagctgaagttcttaattttgattaagttcaatatatcaaatttttcttttatggattatactttcagtgtcattcttttaaagttttattttaagtccaggggtacatgttcaggtttgttatataggtatacttgcgtcatgggggtttgttgtacagattacttcacacccaggtgttaagcctggtacacattagttatttttcctgatcctcttcctcctcccaccctccaccctccaaaaggccccagtgtgtactgttcccctctatgagtcgtgtattctcataatttagctcccacttataagtgagtacatgtggtattcagttttctgttcctgtgttagtttgctaaggtgtcatttttaagaaatctttgcctaacccaaagtcacaaagtgtttctcttatgttttctgctagcaattttagagttttcggctttatatttatctttgcaaaatatttaatttttaatatggtataaggtatagatgagtgcttttatccttttttttgaaaaccatatccaatttttccagaaaatttgtggaaaagactttcctttattcattgagtcaaacctttgttaaaaatcaattaaccatataaatgtggatctgtttctggactctgtattttgtttcattgatctatttatttttacattgataccacatggtcttaaatatcatgactttatactatatcttgaagtcagttggtgtgtcttacagctttaattttcttcaaagttgtttttaaattattctgcatttccatatgaatgtgaggatcagtttgctaatttctacaaaagcctgctgggattttgattgggttggcatcttttctggtcttttaaaattaaaagcttatcatcactttaagacttttgtattttgttcattggttcatttatcttcttttctctttacagggatctttcgatggctggctcctttgtatcattcgtatttcagctcaaaagtaacatcctcagagatatctttccttgattacccaatttaaatttatatccctcatctctttatatcaaagcattgttttgttgacttaacagcattaattatcatcagaaattaatcttgcctatttgtttattttgttgcttattatctgtctagccaactagaatgtgagaaaagagtagagaccttgcttgtcttattcagtttgtatccctgaagccaaaaagtgcctttgataagcggatactaaatatttgtcgaatgattgactatttgacaaatgtgcatttaagtaaagattcaactagtatgaaaatatataatattaactagaatatgttaacttatttatgaaatgatagttctctgggaagactgtgggaacttgactgtgacttaaagctgtagttctcttgaagattatgaattgcgttgggctagattatggcatttcagaaacatagatttttggtttttaaactaaacatctcaatttagctcattagctttgttagcagaatttaaataggtctcacattagagttattcctgattactttaggaatgtgaatatctagaacaaataaaatctttccccaaacattacacagataaaaggcagaaagtttcaggtccatgagaaattataggtatttcctaaataatatttaattaaaaataaatactagtcataattttgacagacagaggcagcaattaaaacatacttcatttttgtccttgattgcttaaagtagcaaacaatgaaatcaatttcttgagccctatccatgttgcaaaggtataaataagattttatccttaatgagatcatacaacacagatacaaaacctaaggctgtttcaaaatgttttgtagtagcgtaaacatagaattttatttgctgagctatttctctcactgagaaccttcattcattgaacccaccaaacttgtgttgagcaccagctacatgttaggaactgtgctaggcaatggagataagaaatgaataaaacagagtctcaatccttcaagaagtcacagattttacaatttcaattgcttgaaggaaaagtcacaactgaagagactggaaattgtggaaatggtcagctttttttccctgattttgttctactgtggtccttacgtggccttcattcaatacctaggcttcatggtgggcttagctttccccttccaagtgactcacaggcaactccagatctagtgttctattattagccttctcaaacctgattattctaagaagcacttcccactggcaacatggtaatcatgtttaaatataactcttcatgatcaatctaaatctccagatttttaaccaagtttccctgtggcttagataccttttttttttgctttgtttttaattaatccacgtttttataatcctatgtgacattaacatgtaaggggtgtgtgtgtctgtacgtgtggccttctgcactaaggcattagacagaaacaatttgaatgaagaccactggctcttctagtcaaacttcctctttctgtatactctgcctgtatctgtcatctgtctatacctgtcagatgtctgtacatgtcaggaataaagctaacgggatgtataacaactaataattcatggtttgaataactatagtagctttcatttattgaatgtttcctacgtaccaatgatatgggctggctgtgtccccacccaaatctcacgttgaattgtaataatccccacgtgtcaagggcagggccatgtgtagataattgaatcatgggggtggtttcccccatactgttctcatagtagtgaacaagtctcatgagatctgatggttttataaatgggagttccccaacacatgtcctcttgtctgccaccatgtaagatgtatcttgcttcccctttgccttctgccatgattgtgaggcctccctagccatttggaactgtgagtccattaaacctctttcatttataaattacccagtcttgggtatgtctttattagcagtgtgagaacagactaatacaaccaggaaccaggaaatatgcatgtccttactttatttttgtatcaatcctatgaggtagggacttttattttcttcattttatcaataaagctcaggtagggtaatttggcctagattacatcagtaagtgaagagaacaaggtttcagcttaatcctgtcaatctggccatagcctatatacttaggctatacaaatattaaagtatactattaagttacaaaatattaatattaaaaactaagaatggtttctatatcctctacaacccaattttccaatctttcagtaaccagggcaatgagactgaaattgttcattttctgtttttatagacatttctgttttttaaaacaagttgttagcatcaaatttcggtctctgtgaatctggaaacacaaggctatagctgacctgtcagttattatattatttgtttttgcaattttggccacaggccatttatcctatttcatgtttgttgctttttttttttttgagatagatagggtctcactctgtcacccagactggaatgtcatggcacgatcatagctcactgcagctttgaactcctgggctctagtaatcctcccacttcagcccttcaagtagctgggattacaggtgtgcgctaccatgcctggctaagttttctattttttgtagagacgaggtctcgctatgttgtccaggctggtcttgaactcctggcctgaagcaattcttctgccttagcctccaaagcactggaattataggtgttagccactgcacccagccttgtagcttctgaagagcaggaaggagagcttgtgagttaatatgaaacattaagatgtcaatatcatgaaataaaggcatacttttcatagcaaacctttccataaattactcttacgctttttctttctttattcctcttgaactgtaataaaaatgaaaactataacaaatataatcacttttaaatgtttcttagtcctaagcttctatcctgttgctttccagtaatgtgtttgtggttgctgttgtaactataacaccttaactttcaatgatctaattttcacagtaaacagttaccctattttccaaagatcacactctgacaatagaagttaggacatatctatatgcatacccatatttgggaaatagattaatcaactaacacagttttccaaataagtaattttttaaaaatccctttttttccattttgttaagccttttgtattttctttttgatattaggtattgacatgaccctgcctgcacagttccagtgataaacacttgctttaatgatttattgcctttcctggaaaggaacaatgaatgatctgaacttattgctgttcctatgcttggtgggcaaatcacattgagtttgccttcatggtcaatacagatggctgtaatcaaatcaattttgggacaagccacattgaatgctaaaagcctgatttgaatagcacagcctaaagatgatggaacctatgccactgccagctgattactatgctttagaaaaataaaaatgttttaattaattacggggatgacaaaaatctgtattaaaaggagtaaaattggaaatctaatcaagggtattaaaatccccaacgaattaggcctgaaggaaggatatctaaaagatgtaccaatgagttcatacagacctacagatacatctaatgaatggttgctaaataggacaaatatagctcattatcattttagaaggataattatagataattacaggtaaactatcatcccaatgctacatgtgatgtagatgacatgttatgctgggctttttgttttctctcacaacacttattgaatatccactaagtttagaacatcacagaagttcagatttgtaaataagaaaaaaaaaacaacacagaaaacatagaccaaagcccattataataaactccatggagcatctacatttttgcttgcagtacaattttgtttacatatttacaaatcactttcctatcaacagggaactagagactaataaaagggctcatgcccaactgttctggagaatttaagcaagtaaaatgttgtgttcaaaatgcagtaggggtaagaggtggataaaatgcatataacttcacttttgcttattctttctatggttcagccttgatctggtttggtgcacaaatgtgaaggtttagaggcatactttggctgtgcagtttaggtagtattttgatgcacatgtaaaggctagaaaaaaatttaaaagtgctatttggtgactagatgtattcggtttcagaactaataggctatatagagatataaaagaggatatttattatgggaattggctcacatgattatggaggctgagaagtcccatgaggtgccaccagcaagctggagaaccaggaaagctggtgtgtacttcagcctgagtccgaatctctgagaaccggggagccaatggtgtaagtccgagagtccaaaggcccaagaaccaggagctctgatgtccaagggcaggagaagatggatgtcccagctcaagaagagagcaaattagcccttccttcaccttttcattctatctgggctctcaacagattaagtgatgcccatccacactggtgagggcagattgtctttactcagtgtactgattcaaatgttaatctcttccaaaaggacccacatagacatacacagaaatgtttaccagctctctgggatctcttggccctgtcgagttgacataaaattaaccattacaccagaggaaaaaagaaaaaaactttgacaaactaagttatctttttaatacatgggtagaattaccactcacacagtaaagaaacaaagagctgttgaacagatataatgtattataatgcatttagtggaccattttagaatatagaaatggagtaaagggaaaaatctgtgatcaaaagaattttaccactcattcattcattcaaaatacatttatgtattaaatgtacataatagatttactcattcactggttcattcaaaaacattcagtatatgctatgaaccaggcactgagtgagccaatagacttggtttcccaaagtcagaaaaagatgaactcttaggaaaaaatacacaaaaatgaaaaacataaccataaaatcatcaggaaatagcaaaatttataaacataattacagctattaaataatacttgtataaaaaagtacacagtgttatataaaaaaaggcataaagcaacggtaaggcattggagagattggggtcaaatgaggttagtctttgaaaaggtcaaccaggagactgcatttaaaagcgggaaaaggatataatttgttcaagtgaagtgggaatggtgtatcaggaaggccaagcaattctaggtgggagaagtgtgtacagtagaaggttttcttagcagaaacacagaaaacaggtgtgggaaatatcaccagttcttaacttggcctgtctctctattaagaagagggtcacaaagtgttcacagatggagatattctctttccaatgggataacagtactgatttagttcatatgaaaagattttttacatgaaaatcatattttttggaataaatgatgtgcaattatgtacatgacaaaagaattgatttacaggggaattttgccgcagtgttatccaaacactaaattttttccatatatttaaaacatgatgctatttactaaaacatgctttatgcactctcctcccaggaacacatgcattacacaaaagaatgtatccatttgccttaaaacaaaacaacagtagcattaccatttcattttatttagctactaatgtcaagagagctcaatgaaaggaaatgttttttcagagttgaaaaaactctgattccccttgaaaatagtcatccaaggtcaatagagatcatgttattcagatttttagacaagaaacgaatgggggattcagatgacattgtgcttcagtgatatgttaggcacatgaattattatagtggcttgaaagagaaaaattcatctaagaatcttcctaattcccctttattcactgactttctcagtatcatctatcaaatatttcaaacaaaaaggaccacattgttaagtgacataaagaataaaatttggcagcacagatttggcttttcctctcttatgcaagtataaagttatgaatacaaacaaatttagttttcacttgcttttcatcatctaatcaataaaacacattctacataatccaaagcatactgaaagtagagatgacattaaaaagctgactataaaactaaatttcaaaagagcttaaaatctagtgccatgagaagtccagaagattagttattatgttctttaggctaattgagttcaaatgttggcttttatgaaatgtgcacaagggccacctcatgattaagtaatcttagcaaacgcacacaccggtcagaatagtcacatctgaacaaaaggcacataatacttatatgtggcaatacagcaacctctaagacagccatgtgattagaaatgtacacagcagtactgctgacctaaaaaattacatttgttacatggggaaggtgtatatattattggaagtcatggacttgccttacaaatctaaatttataaacacatcatagatgaaatgcaagtttggtcagtaaattggccatctgttccagatacttacttttctgtttcaaggagaaaaacagtctattctaaatattttcttagtcaacctcccatttgaggctctagtgaccaatcaatccatcaatcatttatgtatatctatctacttaaaacaaatatttattgaggttgtactatgccccaacactgttctaaactctggggtttcagtggtgaatcagaaaaggtgcctgtacacatcctagagaggtagacaaatttaaaaaaaatcaaacaataaatatttcagtattgataaattgtataaagaaaaataaggcaaagtagaagaacacagagactattttatcttattttatttttacgtatttcaatagttttgggggaacaggtggtgtttggttacatggataagttcttcagtggtgatttctgagattttggtgcacccattacccaaggagggtacactgtactcaatgtgtagtcttttatccctcacccacctcactcttccccacaagtccccagaattcattatatcattcttatgcatttgcatcttcatagcttagctcccacatataagtgagaacatatgatgtttgattttccattcctgagttacttcatttagaataatggtctccgactccatctaggttgctgagaatgccattatttcattcctttttatggccgagcagtattccatggtattctttatccactcattggctgatgggtatttaggttggttccatatttttgtgattgcgaattgtgctgctataaacatgcatgtgcaagtgtccttttcatataatgacttctttttcactagatagatacccagtagtgggattgctggatcaaatggtcgttctacttttagttctttaaggagtctccatactgttttcggtagtggttgtactagtttacattcccaccagcagtgtagaagtgttcccttttcaccacatccatgccaacatctattattttttgattttttaaaattatgaccattcttgcaggagactgttttaaatagagggacctgggagggtcttcttaacgcggtagttcacatttgagcagaaggttctcgttctctagtctattatattttcttataatttaaaattgtgcactctttgtgcagtgctgattcttggctttcctttcccccttctaccgttttcttttactagcttttgcctctcagagagcgtgagttaggaggtgaaactcatttatttgtgacaatgttgttcctgctgacagctttacaaagagttttgattgaaaagaaggctgaaaataagggataaaatgagatattcttggattctaatgatgcacattttctctgccaccctgaactcatatatcagtaaacaattgagaattgcctagctttctgagtgatctctgtttatcataggctctgggaatatgtctgatggtgatctcttataatacattaaataatatattttagtagtccattgtaatttgttcatctctgaatttggtaggaagtcatcctgatctttagcaatgaatgtgtactttgagattcccttgaattcataaaaaaaggttaatgtatccatattagtctgttttgcattgctatgaaggaatacctgagactgggtaatttataaggaaaagaggcttattggctcatggttttgcagactatacaggaatcatggcaccagcatttgcttccagtgaggcctcaggaagcttacaatcatagcagaaggccaagggcggtggggggcaggtgtatcacatggtgtgagagggagcaagagagagagagatgggggaggtcctaaattctttttaacaatcagttctcacatgaagtcattactgtggggagggtaccaagccattcatgagggatctacccccatgaacccaacacctcccaccaggccccatctccaacattggggaacacatttcaacatgagatttggaggggtcaaacatccaaactatatcagtacctattttacaaattgtatatttctgctgatatcaatttaaataaaattacattatttcataattatctgactcatgtcaggaattatcactaaattgatgacaaaagctttggacagtagaacaatctcaaaatattgtttccctagcataatgatgctgtctagcaataggatagaggattgtgggaatattttagctctgaaaaaagtggttctttacagttacaaggacagagaaaaactcaatatttctagaaaggaatataaagattcttactctcagaatccctggaaatacaaatataacaagaaatcttgtttcatcaaaattcttgtgaagttactgcagctaaaatcaggagtcaaataggggattctctctatacatagcaatggtcaagaaagcttgaataaccacagaaaggagcctagaatcaaagaagcccagggtaggaaggcatctttaaaatcacctggttctatacttcattaaaggcttgaatcatccagcaacttctctgccatacaatattcagactccagtaatggagaacccatttctttctaaagcagtgaactcctttaatggaaacctacataaatggtaaaatgtcctcccttgttgaactgaaatctattttttctttaacttccatttccataacagaaatttaactacactttgggggatgctttttactttcataaagcattttgactatgcacaagaatttgaactccaggggttttctggacctataatttagattttgggaggatatggtgggggcaaggcaggaagaaaagaaggtcttagtgttgtgcttcaatccagaaattcctgaagttcatcaccaacagttattggaggagttgttaataaagtaatttttaaatgttcactgttattgtttcttgtgtactgctccctcagcaacctcacaaggtgcaagtggggtaggggatgactgagaaggaagcattcagccattcctgggtctctagacccgatgccatcaaatactagtaaatctctgttgtaacccctagcaaagactttactaggcaggtttttccatcactgaacaagctgaatatttagaaagtgttttcttgtgtgtctccctacccccacccccataactttcaccactgaatcctttactagataagcaacacataagggtatttggagcccttcatgtaattgaatagggggatagtttctgatgatggttttacatgacagatggtttctagattatccaggtttttatcaactggatgctgtctagcatatcaaagacattttaaaacttttaaataaatatgtgctaagcaggtccaaagaggctaccacttctggtgatctggtcactgtccttttcccaatgcagtataattttatgagcactttgttaaagctgcatctctttgcaaaccagcttggttaaatttcctatttcattttcacatatctagtgttcattttcacatatctagtgatctgttcttatacagttgatttttttaacctcaaggaaggattttatatttatccttagtaaatttcattctaatggtttttatctagtgttatagcctctggagatcatgctgcatcttgattttgtcatcagtcagttaagccattactccactcccaggtttgtagcatccacaactttggaaagtacaatgtaatggtccttgtcgtccctggctctgccttcttctaacttttgcacttaaggtcaattaaaatgcatgaattcaaaatagtttttccttccaggatcaactctgcttattagactgaaggtggggacagaatgaatttagaatcattttattttagcacaggaaaaactgtataattgtgattgttggattcttcaggattgcatgatataatatttcaaatggcctctaatttctttaagtctcttttcagggaggaaaatccaggtttatatgcaaaaatgtagccagtatgcatatctgacaaaaactcgacaagtaggaatgaaagcagtgtagaccaaggaaaatggcttgacactggaatagagaaagggtgaataatctggagtcaaacaaaggtcccaagagagtgggtgaaactctccctgaatcttgagttcaaactatatataaaggtttgcaggaaaagaaacagaaaaaggcagtgaacaggcagtcctggagagcctggacaaagaaaaagattataataagagaaagacacttccttgtcattttatgggaaaatgagaaggaagaggcaaagaagtttgtgtgtgtgcatgagagataggggagggagttgggtagtgagagttgtggtggaaaaacacctgctttgtgctttttgattctttctggagcttagctcaactgaatgtcttttttttttttctttcaagaattgacatgctgatataagagctcaaaaaccagcaatttctaatgaggtttgctacatcaaatgtgatctaggccaaccttttttatttagctgtagtggaaaaaacaattctccaaaggctaattcttgctggaggtcacacagccaatttgtttcagagttgagactagagaatccatgtctcccaatcactggttcagtagtcttttctatggaggactccctcgactaatagttcaaacaacacaacatcaaataagccttgttctctatcaacctgatctatcttctgctgatagctgattaaacaaacgattatagcaacaaatgaatgattgtgactcgtttaactatatctggacctggaggtagctatttgtttttatattaggttttaaaaaatggatttaaatattataattctatagaaattatagagaacaagaatcagagcaatcactacatagctctatgaatttgctgcagagaattaagacataacatatcagatacatttgaagcaccctatgtattactttgtaatctatttctcatacttcttctttaaatgtgttgattatcatcttccatgaattaggttggtaaagaagttgacaaggggctttatatttttaaaatagagaaaatactgcaatataatatttgattacacgaataggggctggtacacaaatgtttgtccttcaatttccatttatgaatggatttgcttctaggctgtcttttccatgtcattatcatttgtctatttctgtattaattccacatcatcttaattactaatagtttcataagatttgatagctgacaaagcaagttctcccatattttcaagctaattttggctccttgtttttcctcattaattttagaatatgcttgttaagatccaaaaaaaactttgttgaaatatgataatggttttatactgtaaattgagagatgaataacatctctatgatattaagtcaagccattttggatatggtctatggtatcatttgtttccatttttatatccttcaaaactgttctgtatttttttccacaaatgtctttcacacattttattagatttgtgcctaggtaatttatagatttattgttattatgtaggaagaatactatatttgtataatatatatagtatatatgtatactatatataacatatatgttacctgtgtactatatataacatatatataacatatacactgtatgtaatagatgtgtatactacaggtatttacaaatactatcagttttcatgtattaatcctacagctaggaacctggctaaactccctaatagtttgtagttacttttaggttttctatggttgcaaccttgtaaatcccatgtaatttcagtttatgttttccttttcaaccattatgccttgtatttctttttcttacctcattgcattggccaggttgccattatattttaaataagagcagttatgttttagatagataatttttgtcaatttaaaaatttatcttccatttattgtttgctaatttggtttatttttcaattttatgagtgtggaattttatcaaatatatcttaagctcctactgagttaatgttatgtttttttccctttaatctgttgtcattaatagttttccacatattgaaacactcttatattttcattaatttttattgccctataaaatctgatattatcagctgaaagtcatgcttgccaaggattttcaaggttaaaaatcactaagtgtgagtcttgtctttaggaatcaagtggtgcatcttaatggatgtgtatgtgcacatatgtatacacattaatttagataaacacacatacatctagtcacacataaatacataaatatacatgcatataaaataaaatataaataatggtgcttatactttgtccattttatttcaggacaatcactgaagttttcattgttgaatactaacaaccttttgtaatagccatatattacaattggtgtagcaatgagaacaaaataaagtgaagctctacagaattttaaataagcctaagcagtactacaaacagcattcattttggctaaacactatgatgtcctcttaagaacattacttaaagattttaaagctcattttctctttagtaatcacgagtttggagtgaagtggcaatgtagggaataaaaagaacttactataaatggtatttgaaaattccttatgtggatccacatagtgttgctaggaaacatggtttcttagcatttggaaagctagaaaaccaagtttcttacctcttttggccacagaaatctgtatcatggatctgatttaagagagtttggagattagttggcttcaaaatattcggataagcataaattatgttttatgaccaaccatcccttaagaaataataacatgttttcaactcatgctcaaaaataggaaaatataccctgtatcatctttcattactgggatatcacataactgaaatattagaatagtggttaaaactatagtgatgattaattttacatgtcagcttaactgggccacagggtgtcctgatatttgatcaaacatgatggatgtttatgtgagggtatttctgaatgagattaatgtttgaattggtagattacttaaagcagcctgtcctccctaatgtttgtgcctcatgtcatcagctgaagtcctgaatagaacaaaaggctgtccctctttctattagcgaggattcttcctacttgactaccttcggattgagacattagctcttttcctgctttcagactcaaactgaaacgttggctgtttctgggtcccaggcttgcttaccttaggacaggaactacatcactggctctcacggttttcaggccttcacactcaggctgggaccaaaccatcagctagctatcctgggtctccagcttgccgagtcaccctatagatcttgggagttgcctgcttccataatcatgtgagccaattccttacaataaatctatctatctgtctgtctacatcctattgtttctatttctttggagaatcctgactaatacaaatataaactctatagccagattggttaggtttgaattacagctttgtcacttactgcctatgtgactctcagcaagttatttaaaatctctgtgcctcattttcctcacctttaaaacagggaaaacaatagcacctgcctaatggaactttgtgagaattaaatgagctattacatataagacacttagtaggacgcctgaccataataaatgttggataaatgttacctattattactgtgtggttgctgttgtcattcttgtattagaaaatgtattttcaggtggaactattacaaatttcaccatttcttacactcttaagacttcttaagcaaatagaatttactcttgccaatattaatctagagatggatagcccagtgagaaatttacattctcctgctaaatgggtttcctataacattgccagaaacccagcaagttgaaaaaaatatacagaaaaagaaagaaacaaatgtagactctgtgggtgagtgggtgcatccatggaattaaagagaaagggggacagtttaaatggaacgctggatgtatgtcttaagtgcatttgtatcaaaagaagggcatatatatgaaggtataaaatgtaatttcttcagcttcataaaaaccttctgggtatgaagagagattgatgaaacaagtatcaatatagaagtaaacaccatcagaattcagaactggaagtgaagaacaattctgtatgcaaattgaaaccaccagagggaacctaggtaggtggaatataattacccaaactggaaagtgcccaggaagctggattaataatctacattttaaagaagtgccaggcatttttgaagtcaaaaatgttcagaaacttttgattatgttttataatcacaaaatattttgaaagtacattcaatgtactagttggaaccataccaaaaataagagctcagtgagaaggaaagaggaatgtggtgctttttattgttatatatatttcatctttttatagtattgaggaggcttatatttaaatagaatgacagaaatgaattattccctcttgacgggtgcaaaatcttagagcattatttttctctcaaagcaaactataggattcaattccccattacaaggaaaaatgaaaaaagtatgatagcgagttttattagagagtgtactcgaagcatttggagaaattttagaaagagattgtcacaatagcatcgaaataaatcttaggaatgatttctacagtttgtaggcagaaagctatctaggttaaacgagtcatttcttcagccattagatctgcccttctgtaatagctgcacagttttgcacaaagggctatatgttagggccagcaaccaggagtcttgattttaaaagaaatgatgtcggaagtgctggctaattaacaaaaggcattggcaacatttacggacttataagcagtgaataacattgttcttttcattttatcatatgaaagtgttcacataactattatctgctatccttgaatggtgaggtgggaacaagaagacctatacagtatctgcataggaagtggtgaaataaatgtttacttgttttaaacagtctctttttagaagatcagtgtgttctttacagttacagtgagaactgtaagtctgcttgtctgacttttcgtgaaatgctcttccaaaatgacgacatagaccaagtatatattcctaaaacctgtgccaagcagctttcctatcttgtattagcattgagttaactagcaacatcataaaatagatggaagaataaagattaacctaatgaatcaatgaataggtaaatatttttaccacagacaagtcaagggtaagggtatttatgaccctctatataagaccatctttctcatccgtgacatggaacaggcatagaatgttggctttgtgttaagagggaaatttatagcattaaatgcccacattagaaagctagaaagatctcaaatcgataccctaacatcacaattaaaagagctagagaagcaagagtaaattaatccaaaaactagcagaagacaagaaataactaagatgagagcagaactgaaggagatggaaacatgaaaaaccctccaaaaaatcaatgaatccaggagatggttttttgaaaaaattaacaaaatagatagactgctaactagactaataaggaagaaaaaagagaagaatcaaatagacacaataaaaaatgataaaggggatatcaccactgaccccacagaaatacaagctactatcagagaatgttataaacaactatatgcaaataaactagaaaatctagaagaaatgaatagattcctggacacatacatcctcccagaaaccaggatgatatcgtatccctgaatagaccaataacagtttgaaattgaggcagtaatagcctatcaactaaaaaataaaagtccaggatcagacagattcacagctgaattctaccagaagtacaaagaggagctggtaccaaaccttctgaaactattccaaacaactgaaaaggagggaatcttccctaactcattttacgaagccagcatcatcctgataccaaaaccgggcagagacacaacaacaacaaaaaacttcaggccaacatccctgatgaagatcaatgcaaaaatcctcaataaaatactggcaaaccgaatccagcagcacatcaaaaagcttagccaccacgatcaaatcagcttccttcctgggttgcaaggttggttcaacatacgcaaatcaataaatgtaatccatcacataaacagaaccaatgacaaaaaccacatgattatctcagtaggtgcagaaaaggcctttgataaaattcaacatcccttcatgttcaaaactctcaataaactaggtattgatggaacacatctcaaaataataagagctatttatgacaaacccacagccaatatcatattgaatgggcaaaagctggaagcattcccttcgaaaactggtacaagacaaggatgccctttctcaccactcctattcaacatagtattggaagttctggctagggcaatcaggcaagagaaagaaacaaagggccttcaaataggaagagaggaagtcaaattgtctctgtttgcagatgacatgactatatacttataaaatcctatcatctcacccaaaaactccttaagctgataagcaacttcagcaaagtctcaggatacaaaatcaacgtgcaaaaatcacaagcattcctatacaccaacaatagacaagcagagagccaaataatgaatgaactcccattcacaattgctacaaagaaaacaaaacacctaggaatacagctaacaagggatgtgaaggacctcttcaaggagaactacacaccactgctcaaggaaataagagaggacacaaacaaaaggaagaacattccatcctcatggataggaaaaatcaatattgtgaaaatggccatactgcccaaactaatttatagattcaatgccattcccatcaaactaacatcgacattcttcacagaattagaaaaaactactttaaatttcatatggaatcaaagaagaccccatatatccaagaaaatcctaagcaaaaagaacaaagctggagtcatcatgctacctgactttgaactatactacaaggctacagtaaccaaaagagcatggtactggtaccaaaacagacacatagaccaatggaacagaacagatacctcagtaataacaccacacatctacaaccatctgatctttgacaagcctgacaaaaaaaagcaatagggaaatgatttcctattcaataaatggtggtgggaaaactggctagccatatgcagaaaactgaaatcggaacccttccttataccttttataaaaattaactcaagatggattaaagacttaaacgtaaaccccaaaaccctaaaaaccctagaagaaaacctaggcaataccattcaggacataggcatgggcaaagatttcatgacaaaaacaccaaaagcaattgcgacaaaagcaaaaactgacaaatacgatctaattaaagagcttctgcacagcaaaagaaactaccattggctgggcgtggtggctcacacctgtaatcccagcactttaggaggctgaggcgggtggatcatgaggtcaagagatcaagaccatcctggccaacatggtgaaaccccctctctactaaaaacacaaaaattagctgggcgtggtggtgcatgcctgtagtcccagctactcaggaggctgaaacagaattgcttgaacctgggaggcagaggttgcagtgagccgagattgtgccactgcactccagcctagtgacagtgtgagacttcatctcaaaaaaaaaaaaaacaaaaaacctatcagagcaaacaggcaacttacaaaacggaaaaaattttttacaatctacctatctaacaaaggtctaatatgcaaaagttaaaggaacttaaacaaatctacaagaaaaaaacaaccccatcaaaaagtgggaaaacgattatgaacagacagtgctcaaaagaagacatttatgcagccaacaaacatatgaagaaaagctcaacatcactgatcattagagaaatgcaaatcaaaaccacaatgagataccatctcacaccaatcagaatggtaattattatttttttctataagttttattaatatttgaatataattcacataacataaaattcatccttttaaagtatgccatttggtgattttttgtatattcagaaagtcatgcaagcacaaccactatctaatttttttttattatactttaagttctagggtacatgtgcacaacgtgcaggtttgttacataggtatacatgtgccatgttggtgtgctgcactcattaactcatcatttacattaggtatatctcctaatgctatccctcccctctccccccaccccatgacaggccccggtgtgtgatgttcctcactctgtgtccaagtgttctcattgttcaactcccacctatgaatgagaacatgtggtgtttggttttctgtccttgcaatactttgctcagaatgatagtttccagcttcaaccatgtccctacaaaggacatgaactcatcattttttatggctgcacagtattccatggtgtatatgtgccacattttctttattcagtctatcattgatggacattggggttggttccaagtctttactattatgaatagtgccacaataaacatacgtgtgcatgtgtctttatagcagcatgatttataatcatttcggtatatacccagtaatgggattgctgggtcaaatggtatttctagttctagatccttgaggaattgccacactgttttccacaatgggtgaactagtttacagtcccaccaacagtgtgaaagtgttcctgtttctccacatcctctccagcacctgttgtttcctgactttttaatgatcgccattttaactggtgtgagatggtatctagttgtggttttgatttgcatttctctgatacccagtgatgataagcattttttcatgtgtctgttgggggcataaatgctttcttttgagaagtgtctgttcatatcctttgaccactttttgatggggttgtttgattttttcttgtaaatttttaagttctttgtagattctggatattagccctttgtcagatgagtaggttgtaaaaatgttctccctttttgtaggtttcctgttcactctgatggtagtttcttttgctgtgcagaagctctttagtttaattagatcccatttgtcaattttggcttttgttgccattgcttttggtgttttagtcatgaagtccttgcccatgcctatggcctgaatggtattgcctaggttttctttaagggtttttatggttttaggtctaacatttaagtctttaatctatcttgaattaatttttgtataaggtgtaaggaaggaatccagtttcagctttctacatgtggctagccagttttcccagcaccatttattaaatagggaatcctttccccatttcttgtttttgtcaggtttgtgaaagatcagatggttgtagatgtgtggtgttatttctgaggactctgctctgttccattggtctgtgtgtgttttggtaccagtaccatgctgttttggttactgtagccttgtagtataatttgaagtcaggtagcgtgatgcctccaggtttgttctttttgcttaggattgtcttggcaatgtgggctcttttttggttccatatgaactttaaagtagttttttccaattctgtgaagaaagtcattggtagcttgatgggaatggcattgaatctataaattatcctgggcagtatggccattttcacgatattgattcttcctatctgtgagcatggaatgttcttccatttgtatcctcttttatttcattgagcagtggtttgtagttctccttgaagaggtccttcatgttccttgtaagttggattcctaggtattttattctctttgaagcaattgtgaatgggagttcactcatgatttggctctctgtttgtctgtgattggtgtataggaatgctgtgatttttgcacattgattttgtatcttgggagtttgctgaagttgcttatcagcttaaggagattttgggctgagacaatggggttttctaaatatacaatcatggcatctgcaaacaggggcaatatgacttcctcttttcctaattgaataccctttatttctttctcctgcctgatttgccctggccagaacttccaacactatgttgaataggagtggtgagagagggcatctctgtcttgtgccagttttcaaagggaatgcttccaatttttgtccattcagtatgatattggctgtgggtttgtcataaatagctcttattattttgagatatgttccatcaatacctagtttattgagagtttttagcatgaagcgttgttgaattttgtcaaaggccttttctgcatctattgagataatcatgtggtttttgtctttggttctgtttatatgacggattaagtttattgatttgcatatgttgaaccagccttgcatcctagggatgaagcccacttgatcgtggtggataagatttttgatgtgctgctggatttggtttgccagtattttattgaggatttttacatcattgttcatcaggaatattggtctaaaattctcttttattgttgtgtctctgccaggctttggtatcaggatgatgctgtcctcataaaatgagttagggaggattccctctttttctattgaatggaatagtttcagaaggaatggtaccagctcctctttgtatctctggtagaattcagctgtggatctgtctagtcctggactttttttggttggtaggctattaattattgcctcaacttcaaagcctgtaattggtctattcagggattcaacttcttcctggtttagtcttgggagggtgtatgtgttcaggaatttattcatttcttctagattttctagtttatttgtgtagaggtgtttatagtgttctttgagggtagtttgtatgtatttctgtgggaccagtggtgatatcccctttatcatttttttattgtgtctatttgattcttctctcttttctccattattagtcttgctagtggtctattaattttgttgatcttttcaaaaaaccagctcctggattcattgattttttgaaggtttttttatgtctctatctccttcagttcttctctgatcttagttatttcttgccttctgctagctttttaatgtgtttgttcttgcttctctagttcttttaattgtgatgttagcgtgtcaattttagatctttcctgctttctccggtgggcatttagtgctataaatttccctctacacattgctttaaatgtgtcccagagattctggtgtgttgtgtctttgttttcattggtttcaaagaacatctttatttctgccttcatttcgttatgtacccagtagtcattcaggagcaggttgttcagtttccatgtagttgagcggttttgagtgagtttcttaatcttgagttctagtttgattgcactgtggtctgagagatggtttgttataagttctctgttcttttacacttgctgaggagtgctttacttccaactatgtggtcaattttggaataagtgtgatgtggtgctaagaagaatgtatattctcttgatttggggtggagagttctgtagatgtctgttaggtccacttggtgcagagctgagttcaattcctggatatccttgttaactttctgtcttgttgatctgtctaatgttgacagtggggggttgtctcccattattattgtgtaggagtctaagtctctttgtaggtctctaagggcttgctttatgaatctgggtactcctgtattgggtgcatatatatttaggatagttagctcttcttgttgaattgatccctttaccattatgaaatggctttctttgtctcttttgatctttgttggtttaaagtctgttttatcagagactaggactgcaacccctgcttttttgtttgtttgttttccatttgcttggtagatcttcctccatccctttattttgagcctatgtgtgtctctgcacgtgagatgggtttcctgaatacagcacactgatggttcttgagtctttatccaatttgccagtctgtgtcttttaattggagcatttagcccatttacatttaaagttaatattgttatgtgtgaatttgaccatgtcactatgatgttagctggttattttgctagttgttagtttgtttgttagttgatgcactttcttcctagcatcgatggtctttacaatttggcacatttttgcagtggctggtaccggttgttcctttccatgtttagtgcttccttcaggagctcctgtaaagcaggcctagtggtgacaaagtctctcagcatttgtttgtctgtaaaggattttatttatccttcacttatgaaggttagtttggctggatatgaaattctgggttgaaagttcttttctttaagaatgttgaatattggcccccactctcttctggcttgtagagcttctgctgagagatccactcttagtctgatcggcttccctttgtgggtaacctgccctttctctctggctgcccttaatattttttccttcatttcaattttggtgaatctgacaattatgtgtcttgaagttgctcttcttgaggaatatctttgtggcattctctgtatctcctgaatttgaatgttggcctgccttgctaggttggggaagttctcctggataatatctcgcagagtgttttccaacttggttctgttctccccgtcactttctggtacaacaatcagatgtagatttggtcttttcacatagtcccatactttttggaggctttgttcatttctttttaatctttttcctctaaacttctcttctcgcttcatttcattcatttgatcttcaatcactgataccctttcttccacttgatcgaatcggctactgaagcttgtgcatgcatcatgtagttctcgtggcatggttttcagctccatccggtcatttaaggtcttctctacactgtttatcctagttagccattcgtctaatcttttttcaaggtttttagcttctttgcaaagggtgtgaacatcttcctttagcacagagaggtttgttattactgatcatctgaagccttcttctctcaactcatcaaagtcattttccgttcagctttgttctgttgctggcaaggagctgtgttcctttggaggagaagaggtgctctgatttttagaattttcaacttttgtgctctggtttctccccatctttgtggttttatctacctttggtctttgatgatagtgatgtgcagatggggttttggtgtggatgtcctttctgtttgttagttttccttctaacagtcatgaccctggaaatgctgcaggtctgttggagtttgctggaggtccactccagaccctgtttgcctgagtatccccagcggaggctgcagaacagcaaatattgcagaacggcacatgttgctgcctgatacttcctctggaagcttcatctcagagggacacccggttgtatgaggtgtcagttggcccctactgggaggtgtctcccagttaggctactcaggggtcagggacccacttgaggaggcagtctgtcctttctccgatttcaaactctgtgctgggagaaccactactctcttcaaagctgtcagacagggaggtttaactctgcagaagtttctgctgccttttgttcagctatgccctgcccccagaggtggagtccacagaggcaggcaggccaccttgagctgcagtgggctccacccagttcaagcttcccagccactttgtttacctactcaagcctcggcaatggcggacgcccctcccccagcctcgctgccgccttgcagttcaatctcagactgctgtgctagcagtgagtgaggctccatgggcatgggaccctccgagccaagtgccggatataatctactggtgtgctgtttgctaagaccgttggaaatgcgcagtattagggtgggagtgtcctgattttccaggtaccatctgtcatggcttcccttggctaggaaagggaattccccaaccccttgcacttcctgggtaaggcgatgccccgccctgctctgtgggctgcacccactgtccgacaaaccccactgagatgaacccagtgcctcagatggaaatgcagaaatcacctgtcttctgcatcactcacactgggagctgtagactggagctcttcctattcggccatcttgggaccatccagaatggtaattattaaaaagtcaagaaagaatagatgctggtgaggctgtggagaaataggaatgcttttacactgttggtgggaatgtaaatgagttcaaccattgtggaagacagtatggtgattcctcaaagatctagaagcagaaataccatctgtcccagcaatcccattactgggcatatacccaaaggaaaataaatcattctactataaagacaaatgcacacgtatgtttattgcagcactatttacaatagctaagtcatggaaccaacccaaatgcccatcaatgttagactggataagaaaatgtggtacatatataccatggaatactatgcagccataaaaaaatgagactatgtccttagcagggacatggatgaagctggaagccatcatcctcagtaaactaacacaggaacagaaaaccaaacactgtatgttctcactcataaggggtagttgtataatgagaacacatggacacaggggggtgaacaacacacaccaatgcctgttgtggggtggggaatgaggggagtgaacttagaagatgggtcaataggtgcagcaaaccaccatgacacacgtatactcatgtaacaaacctgcacactctgtatatgtatcctggaacttaaagtaaaaaaaaaaaaaaaagaaaaagaaaaaaatctcagtacaaaagatatgtctcatacaggaacaaaaacaaaacaaaacaaaaaacaatattggctttgtatctccacctgcctgcatctacttttaccactgaatacctcgctattccatgctatgagaaccctatgattcagttatatcaaatgatttgccatgctctgaagtcacccaactttcacttttcatatttgcctttcttcagtgatatggtttggctgtgtccccatccaaatctcatcttgaattgtagctcccagaagtcctacatgtgggagagacccagtggaagataactgaatcatggaggaagttttccccgtaccgttctcacggtagtgagtaagtctcacaagatatgatggttttataaggggtttccctttttgcttggttcttattctctcttgcctgccaccatgtaacatgtgtctttcacctcctgccatgattgtgaggccccctggtcatgtggaactgtgagtccactaaacccctttttctttataaattacccagtctcgggtatgtctttatcagtagtgtgagaatgaactaatacactcagcttgagttgctcttcctttatattatcctccaaaaagtttctacttatcctgtaaggttcaactgaagggtcagcatactgatatatcctcttttaacttctggacagagttgtgtatctgttctattatgcttcatttgagccctacctatttctatcacagcaagtgtcactgaactgtgaatatccacttccattacaacggagttccttgagtgaaaaatacataatacctatgagtaattaatttctgcatggcattcatgcagccatattcattttatgtgcatcattttactatcaagagttaaaattaatggtcagtgattttcatttcttgcaattttacttccttagccagcataggttcctggcatcatttcttctcaaccccaacagaggctcaattccagtactgactggaatgcttttcatgcatgaagaatattgaaaagagctctttcttactttcatgtcttatttaaacatgttacttgctttattttttaacctttaatgactatcacttgccttatttgtcacatttggactaaataatcatttcattttgtcagccagtgttaattcttatggcttgttattgaaactaagcaaattcaatgtatagcatgagtaagatgggacagagaaaaagggaactctgaagaaagtgagctattgactgtgtccctacaaaagtagagatcaatatgtaggtaagaggtaggaaggaaggctgagaagaacagactagaaaggcagtgaagtgagactcaagcgatttaaattctcatcttgcttcactttcaacttcttgtataatattttttttcctctttgggcctcatttatctcatttgttttttgagggcgatgtacttaagtcttttgtatagcaccagtatgattttgcaatatccacacataattgtattagtatttgcttaaataaaaattaaactagtgctcttaactttatgccattcccacaataatcataagcaatgatatctatataataaaccaagttaatgagctatttatttttgtgtgtacattaattacatggacattaattttttaagtccatcctatacacctaaaataacaacagctgacatttatctaaattttgctgggtgccatgtgctgttctaagctatttatttgtatttactcatataatcttcacaacatccattttaatactaattttacaggtgggaaattgtggcacagagaagttaaggctttataaaaagccatgtagcttgtaagtggcagagtcaggactcaaactcaggcagtctgtagtcacacttgggaacaatgaactagaagacatctagggtcctttccagcatcacgaccctctgattttgcttttctctggagcacactcttctcagttcctaagagagtattttatttctacttagcttaataaggtcctttcaaatagagtctatattaggctgtatttgatttttagccttttcactgtcttttatctcctcacaattacataaaattgttcacttagccagttatgaacaatgcagaagtcaaatttcattgcagtcccagaaatcactttatctaaaagtactataaaaaacattcattcttgactatgaagaggctgtacaaagttacctcttttcaagagagtcagtctgcccttgaaacttagtaatttactaaccatcatttttttttctaaaaagaaatatcaggcacagaaatttagagttgaaaggagcttagctgttatgtggtcctaacaccaaacattgaaatatccctgcctagactccctgaatgttggtcattcaccttttggagaagaatcttcagaaagtgaaattactatgtccattattaggtgttccattcattggtaaatacacctcattccctttctgaaatcagatatgccgtatatgtacagtatgtaccacataatgatatttcagtcaatgatggactgtatacacgatggtggtcccataagactataatgaagcatatagggtcttcaaaaaattcatagaaaatgcatattatgaaaaagtatgcatgaatttccaattttttacacaaaataaactcatactgaacaggatctagttgagtctctaagaaagatgagacatcagtttgaaaagagcccctatcacagcaacatgaatcctgctaaaattgaggcaagaacaaacattgaatttacactgaagcttgggtgtgagaatggtgaaatcattgatgctttatgaagagtttatggggctaatgccccaaagaaattggcagtttacaaatggatagctcattttaaaaaggagtgagaagatattgaagatggcacctgcagtggcagaccacccacatcagtttgcaaggaagaaaattcattttttccatgctctaactgaagagggtcaacgattaacagcagaaacaacagcgaatgccatagacatctaaatttgttcaggttacacaattctgactgaaaaattaaagctgaacaaactatacacttgatggttgctaaaattgttatgcccagatcagctgcagacaaacggaaattttcaataagtcggatcaagattctgaagcatttcttcaaagaattgtaataggagatggagcatggttttatcagtacgatcctaaagacaaagcataatcaatgcaatggctactaagaggtggcagtggtccagtcaaagcaaaagtggaccagtgtattagtctgttttcatactactataaagaactgccaaagactgggtaatttataaaggaaagaggtttaactgactcacaattcagcatggctcggaggcctcaggaaatttaaaatcacagcagaaggtgaagagaaagcaaagcaccttcttcacaaggcagcatgaaggagaagtgctgagtgaagtgtgaaaagagtccattattaaaccatcaaatctcatgagaactcattcactatcacgagaacagcatgagggaaattgctcccacgattcaattacctccacctggtctcttccaagacacatggggattatggggattataattcaagatgagactggggtggggacacaaaacctaaccatatcaaccagtcaagagcaaatgtcatggcaacaggtttttgggatactcaaggcattttccttgttgactttctggagggtcaaaaaatgacattatctgcttattatgagagtgttttgagaaaggtagccaaagcattagcagaaaaatgcccagaagcttcaccagagagtactcctccaccacaacaatgcttcagctcactcctctcaccaaacaagggcaattttgtgagagtttcaatcagaaatcattaggcatccgccttaccattctaatttcactccttcttctctctgtttttgaatcttaaaaattctttaaggacacctgtttttcttcagttaataatgtaaaagagactacattaacattgttaaattcccagtacaggacttgagggatgaactaaatgtctgatattgttacgtaaaaagtgccttgaacttaatggagcttatgttgagaaagtttatatatttcttacttttatattttaattttttttttacaaactttttgaagtccccttgtttaaagaaacctgatatatggcacttgatattagcattgcagttcaagtagggaaaatagttgatatgcagtaattgtgctgagagagttttccacataaggtggatgcctaatgacaattttccacatgaaaactatatttttatgtatatttgatgcagatgaaacatatataaaatataaagttcacaaatactatatgaacatcatagagtatatgtatacaaacctagattttatatataatatataatacataatttatatattatattataataaatattatatatatttatatacaattatatataatacaatatataatatattaatgttatattataatatatcaatatatattaatataactaatataattaatatattaatatacaataatatataatatataatatataattatattatatatttattataattatataatatattatctattatataatataatttataattataataattataatttattataattatataaataattataatttattataattataacatataaaatatgtaattatatattataattacatattatatataattatatattataattacatattatatataattacatattatatataattatatattataattacatattatatataattatatattatattgtctataaattatatattatatattatattataattatatatgtaaaatatatatattatatattatatataaaatctaggtttgtatacatatactctatgatgttcatacaatgttgaaattgcttgctgatgtatttctcaggacatatccccattattaagcaacgcatgactctgtgtgttagggaggtatatgtatcccccccatatatatatgccactcattggtcttaccttgttattttcaagcaaaataaaagtcggttttctttttccaaaagttgtatatatttatataatagataatattcattttagtaaaattaatatcttttcatggaagataatttagaaaagtattaaaatgaatacaaatcatccataatcccagggatcagcactgttgctaatatttttatattttcttctcttaatgtgaacatatatgcatgtactagtattctgaatatatctatttttaaactaacgggattatttatatgatcctattttctgtgtgtggtgaggctcctcctgatactctactacatacagatgaataaatttttaataatttttggggaaaatgaagaacatcataaaggtaagggcatctacttccagacaaaatgggataactgaccaaatgtgcactccttcctaaaataaaaagtgaaaatatataaaatgataatttgcaagacactgaaaagcaggaaatgaagggccaaaatctctgagaaacagcaaacaagttgagtcctatatttgccccagtttattgccttgagagagtctctaggctgtagtgcaggagaagggtaaccaggagatgaacttgacagtctgagaagacagaggtaaacagagttgtccagatagtatctaacggggtgagcaaaacgtcgaagatccatagaggaactccctcgaatattcagtgcatgcatgtgaggaaataacccaacactgggggaaaaaacacctaaaagaattagtggcaagactgcccagtgcccacacaggaccaggaacagtgcttgctcccattagtcagattagaattaggtggagtacacagaaggttcttgcctcaacagcaggaaataattggccttagatttagtattgctgtgttctggcctaacatagttaaaaagaccccaaaagatcaaaatgtttccaagtaagtcaatttcatcccaaaaaagccctcaaaaatatttatagaaatataaaaatatatccaacatcaagcaaggtaaaatttatcatgtctggtatttgatcaaaaattacaagcatgaaaacaagtaggaaatatgacccaattaagaaatataataatcaaatttgaaccagaattgacagatgttagaattggcatatgagaacattaaaatattgaaacttacatcaaaactgtgttccatattttaaaagataagtagagatctgaaagatatataaaaagactgaaaaaacttctggagataaaaattcagtctaagatgagaaacatactggctagaataacaagtaaattcagcaatgcaaaagaaaacatactaatgaaaacttgaaaacatggcaactgaaaatatcaaaaataaaactcagaaaaaatagaatccaaagaaaaatgaacagagcctcagtgaactatggagcaacttcaagtggcctaatatatgtgtaattggagtaactgaaaaaaggtttggggtatgaggacagaaaaaaatatttgaagagataatagctgacatttttccaaatttgatggaaactattcttatttttcatttaacattatgttgtcagaattcttctttctttctgtgtatcatgtgaaaacacagttcctgaagactacaaaattccctcccatggatgttttatgatttatttagccatttgtgcctgtacattttgattatgatttttcataattataaatgatgttgtaatgaatctttatacccataaatgttgatctgcatctgatccttgagatatattccttgaaatgagtttacagggtaaggttctacatatatttttagagtcttgatatataattttaagccattttccagaaagatcatatagtacttgtacatttgtacagtatatgtagtatgcattgtatattttaccacattctggtcaacaaatgtctttattaaagaataaaaagatattactgaaaaagacaaacttagctacttttgtaggtaaaaattataagccttaaaaatctgcatttcttatattattaatagctaaaatattgttcatgttcattgcaaatgccacttcatgtccttaggccatttttctattagttttaagtgtttttcttacatcaatttctaccagctgtttatatgttaaggatattaatattttatatttgtgatgaacgtttttcaaagattagacaaaatctacatgtttacatcatatgatgtattaataatttccagagctcccaccctctttaaagtgcattcacatttatcattgttcttatgtcctaaacttgcatctatttctcccttaaactgatattttctattttggttacagagcccaaacctaagaattaagtgtacactaatttcatgtatatcagaatctgttctgcttaattcttcagttcaccttatctaagtaatttctctttcacatcataagagaattaaaagtaattaagatccaatccaagggctatggactagggtaaagcctgtggtacaacttaatggaagaaatattttcttccttaggagttctatcagttatacttgagcccattgttcttgaaagagttaatgtcttatttctaaaatatgtctattatagattcaagtaaatccagctacacttacttaatgcacatatccagtacataagagaaatggaagattcctagcctgagtgccaggaaatgcagtttagatatggccctgccatctttccagaacttgatttccttcccagctacaaaatgagatccaaaccagatgatcctcaggaaccaatccagctctgaaattcgacaactttgtgattgttctataaaacaaatattacatttccctccaaaggatcttctgggattatttgcatctgttttagaaagattggaggtgggaaggggtcaatttttaatggctgcaggtgttttacaaatgtcaaagatacattgcttgcactgatagctaggtttaaaatcttcagaaaataaatgcataattagatgtttccagcatttatatagtgaatctgttcggtctttcatgcttcaaggagctaatagaacctaatgcttcctttgaaatcagtggaagctctaaacccatctaatgtgctagcttataactaacagaaaaattgggtcaatttttatcccactgatgaaaaataaatcaaacaagtgtatcttttaaacagcatgtaaaccatttaatacttagtgtactaggttatgtgcatagttttgggaaacatgaaagtgtgtgaccaaacagacttcaaatacatcatttttatacattcgagggtggttatttaaacaatgcattgatgaatccattggatattgctaggggtgggaaaaaagctttgtaatcacttgcatccaaataatacaagtttataattttatttttataaactttatgattataatcatattcatgtatatgaccgtgcatgtgttactgttaataacaacttgtgttttaagacataaaatggttttataatatgctcatggattcctggattgaacctgacacctctgggtttacttaacgtcctaaaaaaagaaacagtactctaatatggggctagatattactgaaaaagtcaactagtagcagtaaatgtcaaaattcaccttaaaatggcatctctaattataagtcgacagtagcaaagcattggcagtttccatgatattacatgctttacaacctcctgcagctgccagccaaatctccgtttctcttctacatttgcttttccttcatgacatttaatcagtcaacaatatgaacgctggagttctcctaagccaccctacagtttaaaatcctgactacttcatgttcttctgaaagtggggcggggagagcagcaagtctttcagaatgagatctgtacttatcgatcacagcatcagcagggaaattggcctttgtaggggtgaatgtggttcgttcactgagaaaggaaaaactattttgggttaaaatgaaggcaaaacaattcaggcagctgaagaggcttctgaaaactggaaagatggaatttccagggtttgggcaatgaggcagagactaaatttatggaaagcagacaggagaacaacttcaggttagtctaaaaaaggaatctggagagagcttatgtagagaaaaatcacacagactgaatcatacgtggggaatgaatagagggaaaacctgactctgggagctgcgattatagaggaaataaaggcagtaaagattaaatatcagtccctaacactgcctcaaaaaagcctgacaatatattcacagctgggtataacctctgcaggcaccactaagtagtccttccgttctattgagttccttccacagtttgttcctcccttaaacctctcatgagaaatcctttccctcgatatgctgtatagcgtgttaaagtgtagtctgaggaccagcagcattggcatctcctaggagcttattagaagtgcagaattatggctccactcaaatctactgaaactgaacacaatttttccaagatcgtagatgattcatgcgcacattaaagtttgagaagcactgatctacaacatatacgatgtgctgtctaagacttttttactgcatatcaaaacataggcagatagattacaactgtacatcatttattcattctcttaacaaatactcactaaacacaggccctattctcaaggagttggcactttgctaccagttattgaactcccttccgttctctgcattgtgtgaggtgtcagggctagaaggataaatatggcattgtccctgcccttaattagatcatagatatgttaggaaatagttaatgcaaaaaagtgtcatggttttaatgctaaaaacgtgtacctggcactgggattacaggagaacaagtattggagacatataaggaaggtggtgatcaaggtttttagaaatggaaaagtttttatagaggtgagctgagctttcaaaaaaaaaaaagctttttttcttttttccaggtggaccatggggcattgtgggcaggatgaaggaagggttagaaagaagggtgtacaagggagaggaaacaatcttaacaaaggctcaagggcaagaaacaggttggcctattcagagaactttaagtaattccatatggctggatgataggttttgaggagggtggattggggtctggtggtcagagataaggctggagagcttgacaggggccagatttagggggctgtattgtagcctaagcactttgggattgatcctacagagcagcaataagaagtcactgaaggttttccagtaaggcaataacaagatcacgtttgtgttttagaaacatcactctggaggatgtttggggaatggtgattagccaatttggctgaagcacaaagtacacagagaaaagtaaaggcagataaggctggaaatgtaaatttggatccagatcatagaggatactgactgccatgctttgtactttgtaggcagtggggagacactgaaattttctgagcaagagaatgctttagactgggaagagactaaagacagaaggccagttagaaagttattgcaataatttaggcaagaggtaataagaacctgatgactctgagaatagaaattaacagatagattcaagaagcaggtgcacaattataagcacagtttcattactcattttaggataccacaatttcatacataaatcagatctttataaatgtcttcattttcacatcctaatatagcatttacttctgtaccaatcactgggtgagatactcttaacgttctttgggtcaccaaggaaaaaatctccttcctgttgatttagtttgcaggtccctgtctcagttccatgtggaagccgctgcatgcctctaagtcacccaaacccaaaataaaaattttgttacagaattgttctctatttgcctctttggttgtttctcaaccctgaatatgttcctaggaaggcttcttggttattctttattcactttcaagaaaatagccttcccttttcccatctccagccccttttctagtcccacatttttttcacttagaagcactgattccactaggtggtaggtagggagatcaaagtcacatttccagttctcagtttttttttttttttttttttaacaatgtgagtaagttgtagggtaggtacatgttgatcgcatttcatatacctcaactgctgccagattggttttttgtatgatttatggttatggagctttatggctggtgtgaggttattttgaatttatttagaaagctctttcaagtgtttcagtttcacatcatagaatatttataattctgggtcaggcatcatgtttagcttgacttccaagatacagaattccaaacagccatttgctcctctaaatagatagatagatagatagatagacagacagacagacagacagacagacagatagatagatacatagatacatagatacatagatacatagaaagatagaagcacagtatatctgtttcctgtacatcaattttcctggtactggatggcttcattctttctaattcaagacccaccaggcctcgagaatgattagaaacattcatgctttaatattaatacttacaaaatctccctgttcttatctgagctttgcatttttgttaagatgcttagccagaatggaagctgcccacacaatgcttgtataaaaattatacttgctcaataatattcatatctccacccactcttgagtggaacagaacaagcattatgatatgcatgtacacatttgcataaaaatataccatacacaaattcaagtttgcatgcccagttccaaatgcacaccaccatagaaatgcacatttgaaaaagcatgcaatctcaatgtccagacgttttcctccctagagagtgatttttttcctaaaatgaaagaataataatagccttaatttatgtagtacatttttttccattctcctccctttacaagagatgagtcaattattttatgagcaacttaaaaaagcataaattttttcttcctttacgtatggagtaaggcaaggtgtcccaggagactagttcctcatgcaaattcaagggtgaagtgaaatttgtcaatatattcttccttttatgacagtctttccttctcttacagctacctcaattctttgccagccagctgagagatctctattgaagaaatctcttggctaatctcccagtttcccatctcttactacaaaaggtttcaattcacaaaacacaggctgacacaatcctattgagtcctcgcgatggtcttgcaattttgtaaactcatagagcagatgttatatttatttaacaaacatattttccacttctaagagttctttcttttttctatttacgtgttgtatttttatttcttcctagttttcttcttcagttttaattttttaagcttttaaaatttttttcatttttaattttcatgggtacatagtagatgtatatatttatggggtacataagatattttgatacaggcatataatgtgtaataatcacatcacagtaaatgaggtatccctaatctcaagcatttattatttctttgtattatgaacattccaattatattgttttagttacttttaagtatacaataaattactgttgactatagtcaccctgttttgctatcaaatactagatcctattcattctattttttttaacccattagccatccctgctcccacctggttcccagctacccttcccagcctctagtaaccaccattttattatctccatgagttcaattgttttaatttttagctcccataaataaatgagaacatgcaaggttaatctttctgtgcctggcttatttctattaacataatgtcctccagtcccatccatattgttgcaaatgacaggatcttattatttttatggctgaatagtactccattgtgtataagtgccacattttctgtggtacattttcatttccatttgtctgctgatggatgtttaggttgcttccaaactttcgctattgtgaatagtgctgcaataaacatgggagtgtgtagctatctcttcaatatactaatttcctttccttggggaatatacttagcaatgggatttctggatcatatgatagttctagttttaattttttgaagaacctccatactgttctccatagtggctccaccaacttacattcccacgaacagtgtacaagagttccgttttctccacatcctcgctagcattcactattattgcctgtcttttggataaaagccattttaattggggtgagatgatttctcattgtggttttgattagcatatctctgataaccaataacgttgagagcaccttttcttatacctctctgccatttatacgtcttctattgagagatgtctattcacatcttttgcccattttttaattggactactagatgtttttttcctgtagagttgtttgagttccttatatattctggttattaatcccttgtcagataagtagtttgcaaatattttctcctattctgtgggttgtctcttcactttgttatttcctttgctatgcagaagctcttcaattggatgtaatcccatttatccctttttacttggcttgctggtgcttgtggggtatttttcaacaaatctctgcccagttgaatgtcctggagtgttttttcaatattttcttgtagtagtttcatgtttgagacattagatgtatgtctttaatccactttgatttgatttttgtatacaatgaaaaataggggtctagtttcattcttctcgtatggatatctagttttgccaccatcatttattgaagaggctgtgttttcccaaatctacgttcttagcacctttgttgaaaataagttcactttagatgtacggatttatttctgggttctctattctgttccatgtgttggtttttatgccagggaaaatattcttcatacatgaaggagaacttggatatactattcaagggtaaaagattttttccttcagcactttaaatatgtcatgctactctgtcctggcctataagggtctccactgagaagtctgctgccaggcatattgaaactccattgaatgttatttgtttcttttctcttgctgctttcaggatcctttctttacatttggcctttgggagtttggttattaagtgtcttgaggtagacttatttgaattgaatctgcttggtattctatcacttttttgtaattgaatactgatctctttatctaggtttggaaagttctcttttattatacctttgaataaacttcctatttcaatctctcttcatcctcttgaagaccaataaccattagatttcccttttgaggctatttgctaaattttgtaggtgtgcttcattgttttttcttttgtttctctgattgtacattttcaaatagactgtcttcaagctcggttattctttcttctgcttgatcaattctgctgttgagagaatctaatgcattctttggtatgtcaactgaatttttctgctccagaatttttgcttgatttttaaaaattatttgtctttttgttaaatttatctgatagaattctgaataccttctctgtattatcttgaatttcaaagagtttcctcaaaacagctatttggaattctctgtctgaaaggttacatatctgtctctccaggatgctcactggtatcttatttagttcatttggtcaggtaacattttcctggatagtcttgatgcttgtggatacccatccgtgtccaggaatttaagttaggtatttattgtagttttctcagtctagacttgtttgtacccattcttcttgggagggatttccaagtattcaatggaaattgagtaatgtaatttaagactttggttactgcagccatatctgcattagggggcaccccaagcccaggaacactgagacttttagagacttacagaggtccagccttggtggacctgagagagaattgggtgagatctgagagaattccatggattatcaggcatagaattttgttgtcttcttttactttccactaacaaacatagtctttcactctgtgctgagctgcctggagatagggaagcactccctggagggcacaaacactcctgtggccacctccactgaaattgcactgggtcagatctgaagccagcacagcactggatcttgcccaaggcctgtggtgaccactgcctgactactgatgatgttcactcaaggcccaagtgttcttaagtcagaaggcggtgaatccagacaggcttgtgtacttcccttcagggaggtaagctcccacttgtcccaggatgggtccagaaatgctgtccgggaaccacagcctggagtcagaatccttaggaatccgcttggtactattctactgcagctgaactggcatgcaagccacaagacaaagtccttcccattcttttctctcctttcctcaagcagtagtctcccctgtgggtaccactgccccaggcccatgttgtgtactgtgtggctattgccgatattcactcagggcccaaaggctcttcagttagcttgtggtgaatgctgccaggcctgagtctctcctttcagggcagtgggctcccctctggcccagggaaggtccagaaatgtcatctaagagctacggcctggaatctgggactttaagagcctgctttgtgctctactccactgtgaccaagctggtgcccaagctgcacaacaaaatctcctttattcttccctctcctttcttaagcaggagtctctcctcgtggccagctctgctcagaatatgctgggccatgccagaagccagcatgtctctgagtctcacaaggcacgtggcaagtactgcctggttaccactgatgtttattcaaggcccatgggctctttagccagcaggtgatgaatcttgcctggatgatgtccttcccttcaagatagtgggttcccttctggtgcagggtatatctagaaagacagggaagatagtgcctggactgggagcctcaggagttaggcaaactgcctaagaccttatttgactgtggctgagctgttatttccgagttgaaagatgaagtcccctttactctcccatctcgtctcctaaagtgaaaggaaggagtctctctcagaactgtgggcttcactgccttgggctgggtgaggagtggtgcaagcagttccttggctggtgtcccactaggtcatgtacaccccaagtccaatggcttggaaccaagcaaagggctaagatttgcccaggaattacagtccttgtggcatagaccatctttcaagtttatttaggacccaagggcactttagcccacagtggtggggctagccagaacttgggttccacaagctggaacggataattcccctctgactagggatgctctaagtgctccctcataggctcttgctgacttctcccctgtgttgctttccactatgatggggcagcacttagttgcaatgcaaagtccagcaatcactgcattcttcctctcccaaacacacaaattctctctccatgccacactgcattgtcagggaatggggcagggttggtgtaggcaattcacagctgtctttcctaccttctctttcctagatatgatgttaaaaccaggtactgtgattgctcacctaaattttggttgttataaaggtggtttcttgtgtggacagttgttcaatatggtgttcctgaggtgggggagtacaatcgctggagggttctattcatccaccttgttccacttctctccctatttcttcaagcttttagaaagtatctgttaggatgtattaatttcataaattagcttttgaaagttgattttgttagatgcattactcagttttagatttccttatgtatttttgaattctggttttcaggcgcccatcctccctacttctgccttgcccctgaccttggcttttgacagtaatcctagatccagtctccactttcgcacaaaacttttagtcctctaccaaacagaaactgagactctgcgtcagaccatagtagttcctaggtctcaatcctgtatacttcttaggtttctattccatttgagggtcactgaaatgttctatcttgcttttgaacttggccctgtcttttagattttttagtcttaatttctttcccattgttatgtattataaacttatggggtcatattgacaggaagtttgtggcatcctcattttatttatttatttttaattttatttttgtatttcctcagagacctttgttctgaacctcattttacagatagaaatgaactgaaaaaggttcattagcctgctccaagttgcaaacctaatcaatggtacagtctgggctaccatttaagtctttcacttggctctgatgatcaaaatttatttcattttacagagagctgctctcagtgaactgctgatcagctgtgataaagcaaaaaaagtaaataacttagagtcagagaacctgaactcaagttctcactctgccaattactagtttctcttggcctcagtttgcaatattgtataacagcaatacagtcatgtatcacctaacaacagagatatgttctgagaaatgcatcattaggcaattccatcactatgcaaaacaaacatcaaagagtgtacttacacaaacctagatggtatatattttttatttatatatatgtatatatattttcttatggaaaaccaaatgccccagtaccattagtaatatcaatcatttcccctacttgatctgcaatgccaatatccagtaccagatatcaggtttctagatatgctctattttaacattatgacccaaacattgctatgtgacaaatgactatattaccaattaccttacacagtggtcataaaattaatacatgtgagaacttttaaaaaaaatgcaaagcactatgtaaatgtgaaagtttaaacagctaaaagatttgtcttttcaaagatatataaataatatgtgtttacttctgagaaataataaaatacagataagcataaaggaaagaaattgtttgcaatgtaatttagcagtgtattcttctagatttatctcaatatatatatttaaattagcaacttaatcgagcgcacttgtcaaaattttatctatatccatctatacagtaataaatcatgaaactgtctcctcaagaagttttggggaagggttttgacacaaaatcaggtaaagtaacattaggttatttgccaaatatagcattaattgtcttaccttgatttgtcacagtctttgtgttcaggtctcaaggacaaagcttccatttagatgaagcctttcaacaaactatttgtggattactcttctatacttcatggttgcaagctagagaatcctctttagctatttggagcagaagtgaatcattctaggtattaattagctcatggaatcttttggagtgctagagaatcaagctcagatgtttcacaaccagaaacaaggcatccagcgttaaagccaacagatgaaatatccacgcacactacccgactattctagaagaactgcacattgatttcacacatgagtaccagtacctacacctagatttaagagatttcactaaaactgtccctaaagaaccagacatctctatcaccatgcttgccacatgtggctactgccttctctgttcccttctgcatctaaatttgctcagtagaaccaaattcccaatagaaatgtagcttcaaggaaatctagaaataaagttctgttttgttctgttttaatttttcagctctatggtaggaaggtgagatataatggatacagaatgggtaatcagtaagccagtctgcagtatctggtaagtactgtaagtaggtagaggtaggcactgtaatttcccccattttacagataaggaaattgagccttagaaagattatgttatttggtcaataataaaggtatatagaaggaagcaaggatttcaacccaggtattctgatcaacattcaccttttaactactacaatatttaataattacttcattacatgacttctccttagaagaatatgagtgactgaagaacaataattctttctaattcagtaagtatttttcagtatcaaattctgggggctgcattcattcaaaacttcatttagtcattcaagacttttaattaaatacctactatgtgccagtactcttctagagacctaggaatatggtggtgaataaaacgcgcatagttcctgatatcatggaggtcagcatttagtgttagagttatcaggtgaaaaagtatgcattaattaaacgcgactaaaaagatatatgaaaataagagagcatttaaatgggagatttaagctagcaggtgcaggcaaagaaagatttcctagggaagctgtttgagttatagagacctgtaagatgagtaagtatcagctagcctaagggacaggttctgggaagacagtattgtaggcacatggaataaatagagtatgagatgtcctggaggttgaaaggaggtcaggggattgaaagaagtcaagtgtggctaatcatagacagtaagtaaaaactgaccctgcgataagtctaaagaggtagaaacccaaccaatgttcattgaatgaataaaggtgtgcaatctctagtagatggtagctgtgatgccttctaaacttcctgcttccactgagattccatgattccaaaagaggcagtatatctttgtatatttagaaaagaaaaggcgaggccagagtggtaaactctcctaaaattatcaaaacatattgatagtctacattaacactttagaatgaatcacttttgtggatgctatggattctgcaaggagaaaattagaatggacccatttgtctaacacctaaaagtaaaatgggaaagactaacagaataatttagaataattaaaattaagtagattagttttttctcttcttctttatttgacctttgagataatgttttgtctttatgaataaagaaaaatctttagaaatttgcctaaagctccttctcaaaacaataagtgtacagaatgcttacatcaagaatactataatttatttttaatatatttttaatcaaatagaaaaaatcaaactgccctatttctgtcaaaagaaaaatgtgaatatattccatctatattcagtaggcagaatcctcaaaataactaataccaaatacaagttttcaaatctttcaaagatttacattatgtattccaaagtaacagctaaaatcatatattaacttacacatatatcttttaagtctaccaataaaatgtgtgaccattgaaacacatttagtgatgagcaggagccacattcaatgaagaaaattaagtagcagtccagcctctctagactacatgagaatagatccaatatcccatgattcacaattgtttttaaatacatggtttatttctctattatttgaagtttgtttttttacacatatatctgaacttcaaacactgtctgacattcctgaaatagctttaatattacttttctttatctcattgccttctctcccaggtcaatggacaaagcttaaggcttccagcataaggctaatccctttatctgtcctctgaatctcattgtcagctgctttttcagggaccttacttaattattgctctcctctcagcatctacaaccttttcctctcaactaaatctttactctcaccatataaccatgctaaaatctctgtgctggcaaaaacaatcaaagacaaataataaaataacccctcaagtattctctcctcatctgcaattcttgtcttctcttttatttacatccaatatttttgaagagtcattggtacctaccagcaattctttctcacctctcactcacctccactgcaaactggcttttacccttatgctccaatgaaattactcctgaaactgtcacagtgaccttttagttgctacatgcagcgggcacttttcaagttgggttgatccctcaggagcatttgatactattaaccagaaatttcctggagcatatagaactgtaaggaacaataagccatgttcccagaatcaccacatggaagggcacccaattaacactcaaataaactattctttgtgcactaaataaacctgcattgtgttagaccaatgggatttataaaactgttccagcacatagcattacttaccttgacaaacacatgagtcttattaggtcattcttaatctgtctccctgattacccaccattcccctgctgtgaactctatgccctagctacacaaaccactgtgtgtgtatatgcatgtgtgtgtgtttgtccatgctattctattcttaattcctttcttcctattatttgttgacacattcttttagtctcacttacagcctttgagaaagcttccctgtttctgacaagcatatttactccatttcacctcatatatctctctttgtagcactcatgctattgtatcataattgttttctgtctcttaagaatggattcttaggtttttggaatatgtaaattacaggaattctaggcatgctttatcaaaacaaggttgaaatgataaacactgggcccttacataaaattttgtaagaacatcaggttctgacaaagaagaacgaatttgtggttttatattttgtttccctttagttaaaccctagatatcaaagatttataatttcttaaaaataaaatcttgcctacttttgggcaacaaatacatgaaccaaatatcctttgtatctaatttccttagaggtgattttctatgcataacagaattatcttttgcaaattatatttgcatatgatcagtcacattttttgtatttcaaatgtattaatatttcaattagctaaaagcaataagaaaaagatttatctagtctgctgtggaagtgctaatataattttaaaaaacaactaagagcactaattttgttgtcaatttcatatccttataattacctcttaaataggctgcacttctctcatggtaatcactgctgttttcaaatggcttgcaaagaagaaaagcatttaagctaactcctagaacagatgaaactatttattttgacatttgtcggctttggaccatgtcctttccaattctgaaaaagacaacctgggaacttacgtgtttagaacaaataattttaataactttggaggtgatttaaaatggagccaattttaggtgtcagataaaatgatcctaattcatcttatatcaaagatactgggcagtgacattggttggggtgtggtcaaattgttactatgccaatcactcagtaaaggagtctgaatcgtcagtggacaagatctagagatctgagaaataactcctttctttgcagccctctctatgatagacactcaagaatgagagaaaatgtagggtcattcttttaggcatggtcatatcaattcaaaggaagacaaaatagtttaggaagtggattctaatgcaagagatagtttagaggaagaatggaaagtgacgttagtatagtttatgaggtagtggtttcagttgttaaatacagataaagagaacagaagaatataaatattctaaactgtatcagaaagaatcatggaactttaaaagcataaaggactttagagagacatcattttcgttcagtcctttcattttaaagaggaggaaactgacctttaaaaaggttaaatcacttgacccaggttgcacagagagttagtgaaaatagtgtctgtgggttcctatggtggggatagggaagaacatgtaagggaagaaaggaagtgggtctcttttcattctgatccagaaacgcaaatcctttaaaaggtaggcagacctttttaaaaaaacagctggcatcacctgcggagctgagccaaatgctgtggttggtacccagcctgagcctaaaaaaaatgctctttgtaaaatttctctttgtgcacggataaccttcacaaaattagttcatgcttgcttttaaattactttgcacctgtcctaatcatacctgaaggtggcaatgtcctaagagttacatagggtttgtaaaattgggctactggcattatttttaggagcactctgccttacttaatttggagaacattttttttcctactaatttcgatgccacatgctttataactcaactttaattttcctccaaagatatccaatttattatccttgtctttagtgtatatttgcttcaagagacagtctccacaatgctgattgggatatcatatgaattccataaattcattttgaagtccttggttttagcttataggatttctacattttgactcacttttcttatgtattttcttgatagttacccccctgcctaaacaatttaactcttccttttctttttttaacttagccacctccctaaatgcatgtatacattctctctctctttctctctcacacacgcacacacacacacacactctctctctctctcctccccttccccaccaccacacacataaaatcataaaagctgttttcccaaatggagaggtatgaagcatgtgagaggtctggagaagaccaggagtcataaatgtgcacaagccaacttaaaatatgttatgaaggcatcagcgagaatgtcagagtaggagactccaatagccttactctccactgaaaagcaaaaaacaaaacgaaacaaacaaacaaacaattctggcaaaactgtcagaaacaaagttactgaaattctggaaaatgggatgtctgtgaaattctgggatgttattagatcatggggcagatttcccctttggtattgttttcgtgagttatcaaagatctggttgtttaaaatgtgtagcacctcccccttctctctcttcctcctgctctggccctgtaagacgtgcctgcttccccttcacctactgccagtcaaaggtttgcagcaaccaagagaattcttaatcaagagaaagggccactgtaacccagtggaagaggtttatagtattttaatttatttgtgtccatccccaccattgctggcttaatggtggtcctgaagaaagcaccttgttctaccagtgtgggtcctggtaccagagggagcagaacagattttgttctgaaaaaactgtggttgcctgttttgacctatcaggtggtttcctgaaggactaacacaggggacttgcctttattttgcctaactcagaactctcccagggcacaaacatggctgcacagacagcatctatataaatacttaatagcaaatcaaccagccactgctacgcccatgagacaaagaatattagatgggataaacaataaacaaaacaaaaaacttgagaagaaggctgggaagtgagatgcttgggggagtaagggctttgagaagcttccacatattcccaggtatctagaaggtcacacacatgcgcagaacaggccacatgatcaaatgatcttgagaagatcctaaagtctcacctttgggtgaacttcagactctgtgaaagcaggaaatgaagttgaaggcagagttgtaaactgcttagctgagtgttaaaggcctgccccaacatacacacagagcccagttgcaaagactgagagagtttttgttttatccaggcatttaaggaaatctttgtcaaatcactagctgaccattgagttagtagaacagagatttcagtgaccacagaggataaaaaatactgtcagtaaaaaattagaaaagtcactaaacatacaagtacaacccaagacaagtagcaataacaaaaacttggggacaagaagaatcggatttccagttactataatatttaaaatgctcagttttaaacaaaaagatattagacttccaaaaaaaataataaagtgtggcccatttacagggaaaaaaagaaatgaatgtgaactgtccctgaggaatcctagacactagatttactagacaaagagattaaatcaactgtcttaaatatgtttaaagccatagacaaagaaccaaaggaatatatgaaaccaatgtctcaccaaataaagaaggcagaaatgatataaaggaaacaaattctggagctgaaatgtacaagtataatactgaaataaaaaaatctctagaaggtttctacagcacttttgagcaggtagaaaaaaagaatagaaaacatatagataaatcaattgaaattatccattctaaagaacagaaacaaaataaatgaagataaatgaacagaacctcagcaacctttgggatatcattaagcatatctacctatctagctatcggaatcccagaaagagaggagacagaataatggacaaaagaccaaataatggctcacagtatttctacattttggctcacttttcttatatattcttcttgatagttaccccctacctgaacaaatcgagtcttccttaaaaaaagacaaaaaaataaaaaaactagctacttccccaaatgcaaatttaataaaagaaataaatctacttattcaagaagcccaacaaataccaagtaagataaactccaacagatctaaactgacatattataatcaaaccatcaaaaaccaaagcaagaatcttgaaagaagcaagagagaagtaactcatcaggtacaagtgatcatcaataagaataatatcttatttaaactatagaagacttaagacagtgaaatgacttatttaaattgctgaaagagaagaactgtaaattaagacctatattaagcaaagctatcctttaaagatgaaggagaaatttagacattcacaaataaacaaaaggtgaaggagtttttcactaacagactggtactgtaagaaatgttaaagggagttcttcatattgaaacaaaaacacactagacaacaacttgcagctacatgaagaaataaaaatcaccagtaaaggtaactacataggtgaatataacaaacagtattattgtaatttcagtttgtaactcctcttctttttcctatgtcatttagaagacaaatgcataaatcaataattataaatttatgctaatggggacacaatgtgaaaacatggaatttgtgacaataacaacacaaacacatgggagagacctatattaaagcagagttttatatactattgaagctaagtgggtattaattcaaactcgattacttataaatgtaagatactaactgtaattccaaaagtaacctgaaagaacaagtgagaaatgttcagaaaagtaaatgagaagggaaccaaaagggattacaaaaggaaattaaattaataacaaaaatgtaactaatatgaaagacaataatggaggaattaaggaacaaaaaggttataagacatcagaaaacaaatagcaaaatggcataagtaagttctttgttagtagctactttaagtgtaaatgaattatactatccaattaaaaggcagagattagaaaatgatccaaatatatactgtctacatgagactcattttagatccaaagacacaaataggttgaaagttaaaggatagaaaaagatatttcatgcaaagagtaaaaaaagaaaaagctggagtggccacactaatatcatacaaaatgtactaagtcaaaagttgttataaaagaaaaagggaggcattatatattaataaaagggtcaatccctcaggaagatgtgacaattaaaagcatacatgcacctaacaactgagtcccaaaatatataaagcaaatttgacagaaatgaaggcagaataaacagctctacagtaatcataggagatttcaataccctattttcaataatggataaaataactatacagaaggtcaataagaaaataaatgacttcaatgatactgtaagccaactagacctaatagagaaatacagaacattctctggagctagatatggatgatggatatacaacactgtgaatatactaaatgccaatgaattgtataatttaaaatgtttaaaatggcacattttatgttatgtatattttatcacaataaaaaacgtttacctattgatatggtttggatctgtgtccccacggaaatctctgtcaaactgtaatcctcaatgttggaggtggggcctggtgggatgtcatttgatcatggcgcagatctcccctttggtgctgttctcatgatagtaagtgagttatcccaagatctggttgtttcaaatgtgtagcacctcccccttctttctcttcctcctgctctggccctgtaagatgtgcctgcgtccccttcacctactgccatgattgtaactttcctgaggcctctccagctatgcttcctgtacagcctgtggaaccatgagacaattaaacctcttttctttgtaaattatacaggctcaggtattttttttatagccgtgcaagagtggagtaatacagctatggacactcacaaggaaacaatgcattattagaagggattaaaaactatgatgaaaaaagagcaccaaattatttaacttaataaatccatcacttctacaaacacaagacaactgtagacatcccagttctgaggcaggagggtataagataaaagaagctgctaaaaattagtagtccatatgaaaataaaaacaaaagctaaaaagtggaaaaccatgaaaaagttttctgtgtgagaaagaaatgagattggggtacaaaggtactgctttttaaatgaagaattctaaaatgatttaaagctttaaactgtgtgaatgcctaacttgttttaacatcaactgatgtttaatattaatgcaaacatcaattaattaaacactccaacccctcaaatgtagtgtaggaaaaaccatactcacttcttaggctcagtattttcaaaatgattggatcacatccacgtctttctgaatgcattcagctacggtcacttagttctgcattggttttgtgtctgtcttaatagcaatcactccaaacctaatagtctcagtcacagctctcaagtatttttctcttttcccaaatcattctcattttattttgagaactatctcccttatagtaatctaggtttatgagtcattttcaaaatcacaaagtgctttatcattccactttttgaaaatctctagaatgtaagtattttggaaaaaatcttggtattttccaccttgtgagtctgctgatgggcagccagtaaagtcagtgctgttgaattaaaataggcaacacaacaagacaagggacattggtcatgcaagtcttatttcctgaggcacaagactttgaaatgagtcgtacaggttttacgatgatcaactctcagaggccaaggcccactaaactaactatatactaaaaaatgagccattgtaaaggaatattttcttgtaattttaaattaaactttttgggggtggtcttttataatttttaattttggtggtaatcctggagtttatttgcactatttttagtttttaactttttttttttatttttgagagttatgggaatgttagtgtttcaacctgtgatggtagaaaacacattttaaaataagacagacctgggtttgaattacaaagaacttctaagtcatgtaagcatagataaattagtgtcttttcttaccttcggttttcttctctataaaatgataatgtccagttttccttgttgtcatgaggattagaaataatacagataaaagagcaatcacggtatatgacaaagaacaggtgctcaaattggtggctttatatttatagttaaagcatagaagtattaaagtcctcatgcctcaattagaccagttcttacattttaccagaaaggaagctgagaatcaagaagagtgatctgacatacatcaataagataaagctagataattccagagattagtactgaggtttcctgcttaagcaacaatctcttccttcccttgggctctcttcactatggatgaagtctactatttaaaggaaagtttaaaataatttattgaacataggagaaagcatacctcagaatattcggaaatgtgacttagatgcaccttctgagattgaaacttgaccaaagatgacccacattttctgaagactttgccaatgtctgcttgttagtgacttggaaaaagtagatactgaatatgaaaagtacaatttcttcttgcccttcattaaaacaaaataaaaacatgttctttactccaagactaagtctgacctgctattatatttgataaattaaagttcttctaagattaaaaaaaatccctttagcaaattgttccagctaacatagtacccagcatacaataaacatttaataaatacttgttggatgaacaagtgaatgtgtacgttctcataatgctaatgagaagtaatgattaaaacaaaagtataaataagaatgacagaaacatcaagcattctgatgaggatctgggaggggggagtctgctatgagaacagcttgctcagacagagaaacaccaaacgacttcaaaaaaaaccacactgacttgagttctggcataactacctcactgcaggcaacaaaaattctgctttgcctttaatcaatgtaatgaaactgtgccttaacatgcttccttatttgcatatctcttgtaatccgtgttgcatacaatacaaaaagatttattataaagaaattaatatatcttgagaggccatccccatcaggcaaaagacccatctgaagataaaaatcacaccatttataaaaaccttagaaagatcttacaaatccatgaattatttacttaaaaacttaaacatccagagattgagttctcagctctcattggcaaatttgctcctctaaacatttcctaatgcacatgaaaactatttccctgagaatccagttctctaagtagtcgagttatagagtctattatagatataactaaagattctcaataacttttaaaaactaaattatgacatagtctgatgaagggtacatttcaccttataaactgcttcatattgtaattcaaattgtaattagactcttcacccctaaacagggatgttatccccacaagtttcactgtacacaaaactgaatcacattagcccaagccccggttacccttctcctaattagaatctttgcttctccccagtatgaatctcacaaggataccagaccaatctcattagaggcaccacagtatgatgtggtctttagaataagatatacatgggtgaaatgtggcttcactccattttatctgtgagctcttggatgaatctcttatctcccttatgtctcagtttccttacctgtaaaactgagataataccaatcttataaatttatgaaggagagtaaatgtgtgtgttgtctgtaaaaatcctggcatatgataagcacataataaatggcactggctattactatcatcatcttgtaacatactggtttctcatgtcacttcatacacaaaaaccacaataagatacccaggtcatatcaaattaaattcaatctcttctattgtgtttttaatgctttctatattctgaccagtttcatcttctctcccagaattccagagcataaattataactctggtcaatttagtttccttttaatctttttcacttagcatgtcaattcctgcatgtcaataatgttgctattattttctttcactttgcttgctccattatgccaggaccttcacattccttaagattttagatcatgtcccatccatttcctctatgaaacagactcttaatgacactagctcactgctttcttctctagcttctagggccaggtcccttagaggaactgggaaaggatggaatttctgtgtgatgtactcacatttttctctatgagagcctgctcttctttctatgtaatcctatcactttgagcatttattttacactgttatggaggccactagtgaatactaaagtaattttcttttccattgatgttactaggattatagtccaaagaaaggatgcatctatgtttatgcaaattaacttgatttcagctaagcttcttattggcacactgggttctctcctgcttcatgcaagataaaagaagtatcacaaaaatcttatgaactaactggtaaatataagttaaataatagcacagtgtatatactaacctcaaagaatattaataaatgggtctatacaaccaggaaagagatctttagttatatatcactggggtctgaaatgaaccaatgaccctttttctgttcattagagacaacatggggtagtgtggcaagtctcatatactaattcctgggttctactccacatactctgtagagtaaagcctagaaaacatatgaaaatgttccttgtatggttttggatgcaccagaaatcataaatatagtggtcaaactacatgcttcaaaaccaaagatctgaattcagagtttgtctctgtctttttgtttgtacgtgatgttgtacttacctgaacctcactatttcctcatgttgagtgttaagtgacatgatgtatgtatagtgtctcacatataacagacactcactaaataggaatcatttatctattatttggatgaatacccaaaagaaatgctcattgaacccactgttgtcacaccattaagaaagagaatgaatacaataaatgctaaaatgactttgagtctcgtactactaggccaaacacccataatattaacatggataagattactaagtggatttaggttgcaaaatcaattgcataagtaaaggataggagacctgcagaataataacagttgacaggggagaaaaaaaccacccagaagtttttattgactttaagttcagtaagagataagtatatgactcaaacaatctttgggataggaaatagaaagttgggagggtattagcatatccaacggtgtttgtaccttccacagctcttagtacagtagcttctttacagaaaaaacacaaaggcattataatgatgtgtgatgtcaataaaaggtcaatatgatcactgtattactattaataactaacagtatgatatctaatacttattgagtgcttattttaggcaatataatatgccaaatgttttgcatgtgttatttcctttaattgataaaacatttatctcaaaatctttgtaaataaccatttctttgaatccccaattttaaacccagacagtctgtgacctaagagagcggaattgctaaatcatgatactaactcccatttaataaggtgactgtgcttcaggtttcataattggtaagtggagattgggatagtgctagaattatttccttggctttgatgctaatttctctgtgcaattcactttaacaattacttcagatctgcaatttgaagtatttgcagtcttattcattgttttcctgccacaaatttattccttaaccaaagtttaggttcattctgttattttaatgcctttttagttgtcttttgactaaaaggtgagtaatactaatttgggagaatcatattattcagaattagataagcctcactgccctgcaaaaagaagctcacttctgtttgcttggctttctgatttggtggcctctgcatggagattcagatttcatttctcatttacatttgtcgttttgtcttctaatagtttgcccccttataataccatgtttgctaataactctgctttcatgctgtttgccaatgcagaagggaatatttttctttaatacattacatttcttccctccctacttaagaactatttacccagcttacaccatgtacctgtccatttatttggaatggtatatgttttgggatccttttatctcctttccatatttgaataattatagttattgatctctgtggcaaacctacccttcgtagtgttttatttatatcttttaccttttctcagtgaagagaaaaggatggaaattataataaaattattaaaatttataaaatccagggtctaatcagaggacagaaactacaataattgaacaggaaaagtttaatgtataaagaattagcaactacaacaggggattagaatattgagggattggtcagtaaggagtaaagggtactcttaaaatatacaggaataacagatataaggaacagccactactctagaactgatatagatgcccaacgaagacgcttgcctaccctgaaggctgagatctggaccttgtcagggagggcacagccatggcttgtggaatggcaggcactgaatagaatgctgtgccagcgtaagttgctgaagatctgcccttcagaactttatggaaatctgctctctagaatgccagggaaaactgtttataggcatgtgtctctctggagtctctcctctatgaaattgtccaaagtgggtgctgctgaccaccacgcactggcattgtgcgagcctgatggtgcagttgctgtttacactgaggagcctgctgagagagcatgccagcatcaggaaggaaaattccttcctcctgtgcttcaattgaccaagctgaacgttgtacacgctggcaaaggaaaatatttaaagggctcatctccatttttgcagaacaggcaatggagtataaatttgcagatgagatacaataacttgataactggtacaccaggtaacctgtatttaacaggaatcctggagggccatctggttcaatttcctatcttccagcagattgatgcctaagctatctaagacagatggttgttaatgctattaatatttaaacatgagttccctttaaaacctgctttactctttaaaaaccgaagccagttaagtctatacgtgtttactagagagaattttggaaatactaaaaaattataacagaaaactaaaataagctataattccagaatttagagaaaactaatgctagtattttggtccatattcttctagacttttttttttttggctactcatgtattcatttaaaacttatttagcatctattaggtctaggcacaatagtaattgttaggtgtacagtgacaaacctatcaaatgcctcctcgtcaactgagaatctagtgaaggaatcaaatacatctatttatgtatatataaatatgtataatacatgtatctatttataacactttttaataataaaattgggttcattttacatatgctgatttggattcagctttattcatttaacattatattaaaaatattttccatgttactataagtttttggaaagtgtcatttttttcatgactaaataattaaattttatcatttaaatatggtttgatttcccttttttctattgttaggcaactttttagcattttaaataatacactttgcattatacccatccctgcatgatagttaaccctgtggatataaccatgctcctgagtttaaatctcatctccagcatgggctgagtgatttagagaaaaaacacttaacttctctgacttcagtaagatcatagtacctgcctcatctgggtgttgggtggataaaataagtttaatatacagaaagcacctagaacgctgcctgagaacataagctatttaagtattagtattatactcatcatctgtttatgtgtctgtgtctccctgagatgtaattgccttggtggttttgcctactattatgtccctaacacataacacagtgtcttgtccatggtacaaaatttaatacttatttaataaattaggtgaaaaaaccctcatatataaatcacattactagttgaaagagtataaacatttttgaggatcttgatacttgctaaattacatttcagaaaagtatcaactcatattgtaactacaatacatgataagaatgcccttcttagcctgctcttagacattagatattacaactttttaatgttttctatttttttcataacatattgcattatactgctgctttaatttgtatttattcaattgctaatgaggtggaacatgtttttccaattgaatactattcttcaaattgtctattttctttcccaattttctactaacataaggatgtttttcttactaatttttaggaattccttttattgttaagatagttaccatttttttaatttttatataggttaacatttacttcttaattttcatacactgctttgtggcattcagctgatcttaatttttatgtagtaaaacatattgattattttctttataattagttgcatgattttattactagacattctcccccatgtagaagtcagtaaacacaagacccatacttcattcaatgttatttgaagttaactatttaatccattgaaatttattttaccccctctaaatagtgactattctcaatatcatttgtataattcattcttcccataacatgttgatgcttcccctataaaatatcatggtttttatatttagtagggtttttatattctattaagtttcataaatttctacattctactggtatctacaattttccaagtggtaagtttaattcattacattttcatatttagtagggtctttaaactctactactttccatggatatctagaccctactagtaccacagtttttaactggtaagtttaacacattctagtatcttgccgggaaaagttcctgcctgcccctcactgtgcatgtgtgtgcatgcatacacacacacacacacacacaggcacagaattctactccatcacacatcatccaaacaacaaatattatagaatgccctatatgtagtcaggaattgtgtcagatgacatgaatagaacaacaggtaaaactgacatagtcccatcccttatggagctaaaagaatgtggaggtagaactaaacaaacaagcagggaattctactacagataggctatcctagggcaagtagagtatgctatgagcagccactggtacagccatgggggagaaagaaaagcttgccacagaagatgaaatgaaactaaaatctaaagtgtgtgagatataaagagaaattggccaggcagaaacatcaagacaataatgaaataaagaaattgatctctctaccccattgttcttttcaaaattcttttaaatatatttcatccatttattcattcaagttgctctaatgatccagtatctcatttggtttggaagctcgggatgaaatattgctctgttatccaactttatgcatttcctctataattcaggcacttgatacaaactagtctactacttttatatctggtatctacccttaatgtacatgttagctcccattttcctacctttctctcttgttatatttagtaggatattttattatttaagtagatagtttcatactcattattctccagggttcattgcttactacctatgtggcttgaataaaaccataaataattactttctaaaaagattgaaagaaatatttgtagttaagtgtgccaagagcataaaaaatacagcttataaaaataatacaattattctttctataggagtgctgaggcttatgaaaatagtttcttattgttaaaaaagatataaaaaatgttcctttaaatgaatgatttccatatataatcagcttaacaatatctttaaaaattgtgttcatttacataggtaccactcacctcgtgtaacggggaatgcaaaatatgatgtcattaacccattttgaccaaatatgcctaaagaaaactaatgcttcaagtatcgatcaacatttaacagtatttttaatctttatatatttatttcaggcaggatactagttaatttagtgtaaaccacgtttaattatttctgtttattttatatatcctgatagtaatataaataccaattacactttttacagtcttgtttctctattctttccatggttttggtaaagtgttaatagtatttcattacatgttttcacttgcagggcttgctgtagaatacagctcagtttaaacagtcaattaattttagcagaactgaaattgaatgatgaaatatttctaggctgagaagaaaactacagtaaactcttagcttttctactttgaattggaatttttgctctttttcacttctcagagaatacctaatcccgactaaataattaactgactggcagcaaaatgcattaattgtggagaacagtaagctgggtttgacatccatctttgtcactaacagaatctcatcatggcaagagtcacttaatgtcttcaggtcacactattttattatttgtgaaatgaattaataggattacagactcttcaaagtccttactacctctaaaatgttaaaattctgactctaccttgtacataaaaagaaccagtaattccagtgtgagtgcaggggtttctaaaggccaaatatcgaatactaaataatatactatacataattgcatgatttgttcacaactattcatcccctccctcatcacagcttctctgtggacaaagtatattccctgaccactgattttgggctggtccctgtgatttgctttgacttatgaaatattgtgaaagagacagtgtggtaatcccaagaaaggctttaagaagtgctacatgcttctcatcactttcttaagattatgtcctctttcataagcacagcatgtacaaaatagtggttttcttgagcctgggtctctcaatgaaaagatgtgtggaatagaacaactgacccacgccaagctgaacctagtctgagccacttgcaaacttgtgggcaagaaataaatctttgttgttgtaagccattaagattttgcggtttactggagatcattctgttaagtgaaacacgccaggcacataaaaacaaacacacattctcacttatttgtgggatctaaaaattaaaacaattgaactcatgcatataaagactagaaggatggttaccagaggctgggaagggtagctgggggactgcggggaggtggggatggttaatgggtacaaaaaataatagaaagtatgaagaagacctactatttgacagcacagcagggtgactatagggtgactacagtcaacaacaacttaattgtgcatttaaaaataactaaaagagtgtaattggattgtttgtacacaaagaataaatgcttgaagggatggatacctcattctttatgatgtaattatttcccattgcatgactgtatcaaagcatcacatgtacccccataaataatatatacctactatgtaaccacaaacattaaaaataaaaaaaattaaaatattttgtggtttgtcatcacagaaaaagttgacgaatcaagtactaggtgtactttttagaaaactgataaaaacaaactatttttgaaagtctcatttcaaacgctttattaagtaactccttattatcagggcttttgttccttccttgatgcctggtattgtactgtatcacctaaattaaacataggaaagaagagaaggaaaagtatgttgaatgggaagttaataatgtgtctctaaagctatttctcagaattagtaagtgttcagagtacaaacagatgagaagtttggagtcaaccttctagcagtgttgtcaatatatcatcaatatgatatggttaataaactagctttaatatgattcagtgaatcttgtctgtttctttaaatttgaatatctatatggcattttcaaattgattgaataaatgtattattaaaacctctaaaatcacataatcattgggataactcgtgatttgtttacactttgtaatagcacactgggggtgggggaaatgatgaacatttgaccacatttaatttcaaaggaaaaatttgaatatattttctgttcgcatttccttaacattcacataagtaattaagatgactaaatacttatatcagtacatgaaagcatctatggaaattccaaatgccaggaagaaagtgaagcaaaacatatatgccatgtaggaagataattatacattttaaaagtacattatcaatccaaaataattatgaagaaaatcctaataatcgacttcattgtagacaatatcctaacacatcataaggacattgcacagcttagtgaaatgagatagcatattgctaaaatctattggtgtcttaaaaagtggaggggattttatgacaactataaccttagcaattttatctatacctataaaataacttgatataataaaaccttatactcaccgccaacattagacgagttaaaatttcctgtcagtctgctgagagacttcattatacattatctttacatatattatctcatatccaatcttcataagaaagatcctacgagaggggttctgtcattgtccttactttatagataaggcaactgaggtttagaaacataaaatacattgcccaaactaagtggctaaaggtcagaaaatatgacttaagaatttaaattcttcatgttaaagtgtgcctaataaatggaagagatgaaaaagtccttcaggtcataagcttaatttgaagatattaaatgtctgtcatatccaaagttacatagatggaagcagaaattaaacaagaacttgaattttttattacggtatcttaacacattttactatatatttataaaaatatctgctataaagttcttgaaattttatttccaagcatgtattttacctgcaaagtttcagggtgatttttatagtcccatatcttaataaacgcagtcaagttatctgctaatttttacattttctcctctgaagacagctcaacaacctctaaaagatacattttatcccagtagggggtctaggagcatggaaataattaagttttaaaatgtctttgttattttattcatatttgatgacttaattaagggaattatgagataaatacccaaagcaagttgatcttaagagtaaataattattatttccactagggtcgaattgcacatctcagtgatgtttaaaaattattgtaacatggaggatggttatagatatcctattaaattgtcaaacatattgcaaagattaggcaaatttttttcattacctcattatggttaatgcagataaaagactccttcctctacttagcctataaaaaaatgcttagaaactaaatgtttagaagacttcacaaattccacttttagtaaaaaagacaagtgatagaataggaaggtaaaacttaaaggagaaactagaaactaggcagtaaaggaagggagaaattatagaagaaattatttcccttaataacaaatatttcaataaaatgtatttagtaaaatctttaacagacttgttcattattttaccattgacttaagtaaaaaagcagatgaaatgctatgattaacaaatgacatgatgccaaaggaaataaataatacagcgtataagtgatacaggctaccaagaaatttaataaggtgaaatttagaagtaataaagacaacattttgcattgagatgaaaaatagtcagcattccagcagaggcagatttaccacacaggtcatgaagcttaagcttcaggacccttgatttacaccaacacctttcagagcctgtacctaatgtatatatgataatcctattattaaaggggacctctaaaattatataagcttccgacctccaaaaacctgactatgcctttaagttttaattccaataggataatacaaactatttaactctgaatccaacaaacctttatgcaacaaacctttcagatcaaacaaggacaaataaaatcaccataacccataccagagcatatcttagagacagaagccaacttacatgtaaacgggagatatattcatttgagaccaccaaagttggctccagagcccttaccttagtgagatggaggggacttgtatatataagaggaaaactaggcatgtttccaaatagatacaattagcctccctctcaccaaggggagggctctgaagccagctttggaggtcttaaatgaatatctctcccacttacatgtaaattgacttctgtctccaagaatgcccccaaaaggagagagtccaatcagtaccacccttaaagtttgtaagatcctgggcaaatattttattttttgcaggactcctgtctatataaacagtttgattaaagatgtactgcaaattcatggactcatgcaaagtacagtgatttattaatgaagagttagaataatgagtagacaagcagtatatatatatttgtttattgtacatgtttattgtacaatcagtgcacatgaagattctttgtagtgtctgattactgcctatttctgttcagatccagaaaccataccttcatgttccctattgtcatatgtcccatgcctaactacttccgcatctcccatctgagaaaaatgtagcaatgctattattgttactgccatagctctttggaaactgtgtgtatttaagcaacacagaccattttgtacctgtagttctctaatatcatttacttaatgctgtacataattactcatgacactgcatcatctatcatgcaccctgtggattctgacttcggtgactctcttgaaggttgttatggcattgatggtcatgaacgcaagtcattcccagagtatttcagataatgtgaatgatggtttgttttctggtcatgtttttactgatggtagttttatatcataaacttatcttccaaccatgtgtttcctcaactatttagatcaaaaccactgcattactgattgcattgctgactgcttttgattattgctatactcccaccttccacaaactgccaccaatgaggaagatagacaagggtcctaggggcagtgagagaagagactttctatttctgtaaatgaatgtccattgttcattcagcatggcttagaattggtccccccaccccaaagaacacaatatcactgcatcaattgtagaatactgattgaaaggatccactggccatgctgagcaacaatctagaagagtcttaccggaaaacagaatgatcattcccagaggactgcttgacatgtggcatggagcctgcagagggattggggtaagcatcttgggtgccagtggctgggagtacattgggttgaggatacctcctgcagctcctgccgcccacaagggctgcccacatgggcagacacacaccagtgagcattaacacagaggcccaaagctcaagcccaaaggtcagtgacaaatagttggtagcccagagctctgaaactcatcctatgtcagacattgagtcacccaagtacatatatcagcacaatctgatagaccaatttcatgtgatcccacaaaagaaatactgtggtagccagcaggagggatccactagccaggctgctctcctgaaatcaaggctggccatgggtcctgggacaactcagaagggtgtgagccccagagttcttacaggtcaggtggatgattccgggtatagagagtggagagttgtagagtgcctcaaaggtaagaaataggaacccgggcccatatggatggatcagggcccttaaggcacagggcctgaggcaaaaactacacttccctgggcctaagggtggttctgggtccaattctaaatgagaaagtattcagaacaggtctgatccctggggatcagagtgctgaatgctggggagtcagaagcaacttagcgggcaagaccagaagtggcggtctctatcaggtacctcttctgatggagaagggggcactctaaatattaatagtacaagagttccttggaggtttgattacaaaggagaagaaagaagttgcttaaaatagggtcgtactgaaacaaaattgtataaaaaaataagaaaagaaagagaataataaaaatcaacaaatgaaaaaataaacaattttttacatcctttacatgtcaacagaagtagcccttggactaagaaaatcagcgtcactggacctggatctatttgccctaagagctcatcttttctcttcttctgttctctgtattacagggggcagccccctctggactgtgtttctctagactcccaaatcagccgggctctgggtgggcttgaacagccatttagaagcacttgtgcaagactggaaggtgttaggaagggagaagtcaggggtatttctctccctttctttctgccttgggaagtatctccattgatgactgtcccttttttatggttccattatttccttggttttcttggttcccgggctctgataaccaccatttccttttgtctctcagcctcaggacactaatggcttcttgcttttgctagcctgtaggtcacctcgctgcccccagtatggctcctctattatttcatcatctgtgtaactaactctctgctttatatccctgtgttgtaaacctctataattaaaacagtgtggtattggcccatgaatagacagaaggatgatgaaacaaatagaaagtccagaaatagacccaggtatatatagaaattgggtatatgacaaagttggcatctcaaatcgctgggaggaaagatgatctttagaataagtgatattggttcagcttgatagacatttggaaaaagtaaaaaaaattgaattctatcttatacattatctcaagattaattttacataaatgtaaaaaataaaaccatataagatctagaggaaaacacagtgaaatcccttatatcctaagagtgagggagcctttctaactatgactcaaaatacggaagcaataatggaaaagattgagaaattcaactacttaaaaaaaagaaatggccaaaaaaaatcatcataaacaaaatcagaggacaaatcacaaaccagatgaaaatattgcaacttatatcacaggagaaggtctaatccagtgtttctaaagctcagcactactgacatttggggatggataattctttgttatgggggctgttttctgcactgcagggcattcggcagtacttttggcctctacctactaaatgccaatagcacccctttcccaggtgtgacaaccaaaaatacttccagacattgccaaaaaacgtggggagaggagtgaggagggaggcaaaatcatccccagctggggaccactagtctgttctaatatataaaaagatcttaaaatagtgaaggaaaaattcaaaatccgaatagaaaattgggcaaaagacgtgggcatttcataaaaagaagagaaatggcccctgagcacctaaaagattgcttaatctcactcatactaagaaaaatgcaaatgaatgctattctgagagatttcttacctagcagattggcacacatccaaacatttgaaagaagtctgtgagctacacattactgatggaagtgcaaaatggcaaaagctctttgaaagagaattaatcggtattttaaaaaattatattcagattttcttttgacctaggaaccccacttctatgaatattccccaagagagagagttccaggagaacaaaccaacatatgtacaaggttacttactgctgtaaaaggctgcaagtaattcagatttccatcaatagcaataatggaataaacaatgacatactacccaatgaaataccataatgcagaccttaaaggaagtgaagactgtctttatgtattgataagaagtaatggtcagaatgtattaagtggaaaattcaaggttcagagcagagtatgtgtgtgtgcttgtgtgtgtgtgtgtgtgtgttgtaaaaagaaaattcttaaaaatgataacatagcggatgaatgggaggaataaagtagggaatagatggaaagaagaattttctgagtacacctttttatataattttgacatctgaactatgtaaatgccttatataattttacaaatgaaaatagaaaagttaaatcctaaaattaaaaggaaaccagaataaataagcctaactctattttaaattagtaatacgactcggagagaaaattatttcaagtgacttttggcaaagcattctgattatatttttatgactacaattttaggatatactgtaagcacaaaaagtgattcaaataaattttaaatttcactcaatagttttgttgtattggggacacatgaatgtaaagatgggaacaacagatactcgagactactagaggaggagggtggaagggggcaaaggttgaataactacccactggatactatgttcacgacctaggtgacaggatcaatcatatcccaatcctgagcattatgcaatatagccatgtaacaaacctgcacatgtaccccatgaatctaatataaaagttaaaatttagaaaaaaataaaataattaaaaagtatttaaaaatagttttgttctcattagaacctactttatatgctaggataaaacaaacatgaatgtcttagaaactaagattttcattataaaagaaaagagacaatataagatcaaagttagaaacttataatattaaaatttaatcaaaatccttcatatgcagtaagtattatatatgcattatagatgtataaaatatatgcgtattttttcttgcactatctgttgtcatttattgtaaaacactgaacatataaaaattcacaattttacagtggttgagaaaagaaaacggaaaagaaaaaagaataagatgaagagagtgatagagagacacacgactatcaaagctcactaataaaccaacttttcactctaaaatttgacaattaaaaaaataattcagaatatcgcacctttttgggaaaagctgtcgccaatacccattttattttggaaagctctttataagagattaacagccaataaacgtagaaggaataatattattagagaatcagaattttgcaatcccaatgaaaccactgttcccatcaaggatcatcaaagaatgataaacccttacgtgaaagttcactggggaatacctgatgtcattcccaacagttcatttaccccacagtttacttgctaattgcaaagggcaaacagaccttgcaatgaagtgatctagtagtaaccaccctaaaagtgataaaatttagcatgaccaatagagcgaagcctgatattttatgcttcctaatgtgatgcaatataaggtactcagaatcacctatgaagtaccatactcttgccaaatgcttaagctagatgtgcccaagactttggacctaatatccaggttataaaaagtacaggtataaaaggacaagttaaacaatcagacaaatatagaatgtgatatattttacaagacaattgtcatcatctcaacaaaaagtcagtatcacaaaaataaatgttggtggactgttctagacttaaagaaacttgagtgatgtaacaatcaaattaaataagtgaactctggatcctggtttgaaaaagcagctgcaaggtcattttggggaaaattggataaattagatagacagatgctagatgaaataggctgattagatatcacttgattaagaaattataattttctcagtgtgcaaggtattacggttaagagaatgctcttttctatatgtatactgaaatatttaggagtaacattatctccagaatttattttcaaatttttcagcaagcaagatagaaagatagataaatagacagatagataaatggatagaaagatagatagatagatagatagatagatagatagatagatagatggacggacggacagacggacggacggacagacggacggatagacagacagacagagacagatagatagatagatagatagatagatagatagatagatagataaaatatggcaaatgttaactcttgaatgtaggttgttgggtgatgggcatacgttaattacactgttctttcaacttgactgtttgaaaattttagttaaaaaatgtggtgaagaacattgtacaaatataggatgagatacgatagaacataaagaagacccttataagtgtgtaggagattagtggggcatgattgttattcttagattacttaaggaggcacaaaaaattagtcttcagcagctaacggcatagatatgatagggttgcactagatccaccttctagggccaaaaaggcactggtggagctgtctcagctgtcagtgctaacaacaaagttgattagacaaagatctatggatctagagtgcttggccatgacttaaaaaatagagagcatttaggggaaatattggcagggatagcctgcctcagctattattgttatggcttatggaacatgatgatgggtacagcaccaagaaatcctgtcatcatggacctacaaacagtaaggatttaggctgagttttagcaaagggaataaagaaagcagctagaaacccaagaaggccagtggatccagatgagttactagaatctctttaaaagacaggcaacagacacacagacatgcaatgaattcaataaaaattatatagtcacagcacattttcccagtctcaggaggtttttgccctctggatggaaggtaattgtttgttaataagtacctggcttcactacacatacactagtttcagggtgaaatattactttaattaactagttgaaatttcacaggtctagaatttaattacctgttggaactgtagctaagatatcatggtctcataaaattttactgccttttaaaaatgaccataatttatcagaatcttgggggaaattgtgcattgtgcatgaaaacaacaaacattggaatatagttagtcctaagattgaagaagagacttacaagtacttcgatgcactctactgaagttcagatgagaggacagattctgtttcagtgacaaagacaaactgggtttcatattcactgttgtcttcaccttctgctatagagtttctgggttttttgtttgtttttgtttctgttttgtttttttttcttgctaggctccctcaaatcatgggacagtttctggttttggaccccaaggaaaatctgaaggtagatgaagttgtcctttgtcaaactacccctgctttttttgtgtgtgtgttagctcactttgtatggcatttagagcctgtatgtcctaatctatttcttcattatgcaaagcattgaatagtttcccagattctaattgtccttgtctaggtagcatgtgtaccagggtattatattttactgtatgttgtctctacacatgccgcaccagattaggctcccaggaagccctaaactcttggtgatagtttgatggaggaaggagagtaggatgaagcctttcctagtccctgagctttagtgatctctgtaaacgcacaatttaagagataagacatgtgagaagaagggtaggattaaagatctgatgaattagttgctaatctatttcttaggcaagtaaatttatccctcttggtatgtgtcaacttgtctaggtcacagtacccagtatacacatgtgcacacacacacacacacatatacatactgagagagagagagagaatttactggttttgtatctctgaaaaagcctaatacaatgtactccctcatctgtgagaaccttccaaattcttcagttttacaatttcatatctaaagaacaggtctttgttgctaaattactgcctgaaaatagttaagctctaattattaaggaaaaaaacattcctgtgaaaaatattttctttccacttataatgcaaaggtaaacttcaccagtatataataagaataaattattaataaatggcacctgtactaataataatgctttactatttgttaaaatattccatagtactgaagacatttaactacgttagtaaatgacccaaactaacactattattatttctttaaaattggtgacacagagggatgactaggcaaagcatagaggattttcagggcagtgaaatattctatatgataccacaatgatggatacatgtctacttacatatttgtgtaaacccatagaatgtacaacaccaagagtgaactctactgtaactatggagtttgggtaataatggtgtgttaatgtaggttcatcatttgcaacacatgtaccactctagtgggggatgttcatgatgggggaggctgtgcacttgtggggagtagggaaatatgggaaatctctgtaccttccactcaattttgctgtgaacctaaaaagaaaaaatatgtcttaaaaaaaaaactaatgacccaagtgtgaataaaacatggattacatagaacttaagggtttaaaatcaacttgcaccatactgaaaccacttagggttcttatcatgctgtgtttcttatgattcgtttgtaattagtcagaatatactgcagctgtttgtgatttcagggaagaataagatgtttataaagagaaaatgttccattatctctgctttttaaaattcctttctttgtaaatgatattttatgatatgttttccatcctcatttcaaatcctaaacaagactgttaaataggggtttgtcatacatagaaaaattgctacatattagcttctttccccacttcctcccctagttttatacatccatacacacactcacgcacattatttttatatgcgacaatttctggctctgcataaaatgttactgcaaaagtacactgtgtcaagttttttcagctgcttacattcctactctggtaccagtgccagggtttcagggcactacaatttcctttatatctcagtggttattttgaaattatcatgtctcatctgcactccctcataatgtatgccttccatgtcatattaagctgcactcttttccctgccttaattccctaatttctggaatgatattggaattggttatgattaaaacagcaagggtctatattaaaagcaagtatcttcctcatagatagatcatgaaagtttgaggtaccatgaaatatgatgtgaaaatcaccttcttcaaatatccaagaagatcactagtaaatttcaagtgtaggttcatttttacatatatcttacttacccctggagttccatagcagaggtggtagtgaacttgaccactagtgagaaataagaggaactatggggtaattgttcccaaggaaagggcaggaataggccattatgtgcatgtaactgtaaagagtcagtagatgcatcaagaggtatcgtatgacaattggaagatacagaaataaattcccagggtttcaagataattgggagaggaaaaaaggaaagacagtgtggtggacatcttttgtttttgcttgactagaatcctccttcattagtaacagcatctgagaaactatcccttccctattagacgggtaagagtctcagttgcaatggcccatcctcccctgaccaagaatgtagatttggtccaatacaggcaagtcagacacttcatgggatatgaatctttaactgaacaacacaaaggctgaaattttttccagctgatttatctcaatgatggtgttttaaagagactttttcattagtttcttctccctagatatccctagttgctccagttactgctctttttgaatacttgtttcattttttgttttttttttaaatcctgcttacattagttgcatgcaatcttacaagcttaactgacaaatcattaccaacaaattagatttctttagtgacttggcgaaagtgagaaagaaaactacctttgagaaagggtggactggattaaagaatgaaaactttcagccaaatagtagagaactttgcctaagaatgacttagaactttggtccacttcaaggaaaggaaactaagccagaatgtaaatcaatgcattgcttctttcattgagaaagtcatgtaacaaaaaaaacaccagctgaactaacctggatgcttagtgatgtatttggatttacaccatgctgccagttccttacaatttcagtctcagtaaccctgatctagcttaggttgttttaatccaaagaatgtgctgattgagactttttattggaataactagaatttgacacatgatttccagaagtatagaggttcccagaaaatacataaatgaatggaaagaatagtacagcaggcccttgaataatgttgtttcattcaaatgtcatttcattataatgttggtgaggaaaaaaaaatctattcccagttagagccactgtctgtgtggagtttgcaggttttccccgtgtctggatggattttctctgggtattctggtttcctcccacatcccagagatgcacatgttaggtgaactggtgtgtctacagggtcccaggctgagtgagtgtaggtgttaatatgagtgtaccccgtgaagggacagcatcctgtccagggtgcattcccatcttgtaccctgagctgcaaagataggctccgaaataatagagtaaataattgtctggcttgtttttattaatcttaaatgtatgtatagttcacatttatttcaatgtttaatatgggaagtgttttggtctttattcagaagtttggtgatgttttagtaaccagaaatatgccatagaagctacaattttctagctgaacaaattacagcaatataagctttcttatggttatcttaaaagatcttatggttatctaaaagatcttaaatcacacatcttctttgtgtttctggtatgccaagttttgttgtttatgggtttcaatgtgaatttgtttacttatttattttatttttttacctaagatccaggaactatagatcaatgtaaattaaataaaaaattgacttggattcttgtccttgattaaactgcaattcatgtgtttttgaatttttaaaagtaaattttctgttgtaaagtaataatgacggctacctcccaatgggacacattctgttttctagagtcaatgaattcaagtccacttggagtctatgagtttggatcaccttatcttaaaggctacttggtgaacagagttgaagttttaagataatccgttagttgagttaaaaaagcacttgggtatatcagggcttcttaacttcagcactactgacatcctagagctagataattctttgctgtggacagttctgtacattgtaggatgttttcagcagccctggtctgtatccctagatgccagtagcaatcttccttaattgcccaatatgccctgggaggaaggggtaaaatcaccccaagttgagaaccactggtgtatatcattgctataagggcattggtttttaaacctgacaaagctgagctcacctctcaggtctgtccctttcttacgttgatttgggaaagttactattttccttgtctgagaaatgttgatatctcctgggaattcttgaagagattagaaaatgtacttagcttcatgactcacctatagtaaaaactcaacaaagtaatcattgttagtaatagtatcataattcctaaatcctaaatacagattttctgatctaaatgtgcaaataataactaatcaaatttccaactgtgttatttgacaaaggtataatgaactaaaactctaagacatgttaaaaaaaaaaccctaaatacaataatttctaaatgggacaaaggctttatagctaactctttgaacttgaaactattttcagaaaaatgactggagtaatgttgctttccatacataactgttgaggaaatgtactaacacagacgagatcaaactgaaaaagaattatatgtccaatgttctagtcctagaaagaatacacacacttcctctctcttcctctaaatccatagatgttagcagtgaaagatactaagaaaatgaagaactagaacgtggaatattgtcacatggaactaacataagaagtaaaatgtaaatgaaggaattttatacatgtgcatttcaaatgatctcgaccacaaaatcagagaaatgacagacgaatacatgaattatcaaaccattcgctgttcaaaaataaacttctgaactttagtgtttgcttaatggaaagttctttcttttctttactcagttatgacctcagacatgcatcagaactcaatgcatatgataaaacattatcatgccaactctgtggatacgaaaaaaaatgcatgagtggagtgacatttaaaatgctgatttaaattccttagcataaatttcaaccatctgggaattttatttgctttcctcttggatcctgttgcacactcaggtgagcatagctgttatccataaacgaacagttgttttgaaggggcagttgtacagtctctttaataccaagttcactttatctggggtgttcagatagtgctttcattttcaggtttgtggaaaggtgaagagacaaaaagctcaaatgctttgttaggaaatgctgctgaggaaaggaatcctgattattgctttgaacttcaaagtatatcagtaacagggtctcttaaaaggaagtctcttgagagttcagattacagtgaataatcttagaaatgttcctgatgaaattaaattgcatggttcaagtaatgggctactctcccatatgagccttgccatgattaaaactgctttaacactaaatcgcacatggatgccttgtaaatacaagatatttaacaaatatttctcttgatgacagtctcatctcacctcatttcagcaaattaaagtaagttgccacggctttaaagaagtcacacagctagttaattgcaccgtttgtccaggaaactcattctcctgaatcaatcccagtacagctctgggttggattgattaaatcatggatacattgattgttttaatgaaaaaagtttacatgttcatttaatctaagacaacctgcaccttacacacacacacacacaccccacccacacacctatcttttttttttttgagatggagtctcgctctgtcgccaggctgaagtgccgtggtgcgatcttggcccactgcaacttccgcctcccaggttcaagcgattctcctgcctcagcctcccaagtagctgggactacagtcgcgcgtgaccaggcccagctaatttttgtatttttaggagagacggggtttcaccatgttggccaggatggtctctatctcttgacctcgtgatctgcccgcctcagcctcccaaagtggtggattatgggtgtgagcctgagttaactaaaatgttgaaaagttaagggaattggtcattattcttcagcatatcattcttgaacaaaatgcggtttctattatactctggcttttgtggggctagcagtatctgaagaaacactgcagaaaacattgtagacagttttatttcctaggaacatcagtaagatttccacaatataaaaacttaaaaaaatattcagagcaaaaataattaaactaccataaaagtgttctttgccaacgaattgtgactagtacaaagcattcagtcataataaatcttttaagcttttcaaaagcaactccagaagctaagtttcaaaatttgtttagacaaaagcaaatttttaagaaaaagagtgtatattttcttcaagctacattgaaggcatttgcatgtttaagtaccagtgaaccatttgtttatgtttaaaaatgtttaatcacgttagtgtttttttagtttgattttattttccaaagatggctacaacaatatctcccatcccatactttcttctagaatcttgtaaatttcccattaagaaatacaatctgattcctgcccccttaaacctggacaggtttgtgacttgcttgtaacaacaatacaagatttcccaagctaggtcagaaaaggtagtacaactttcaccttatagatggaatactcaggccattcctagcctttccagatggcaaacaattctttaattaaaagagagcctcaagtcaaagatcaaatccagggtgggactataagatcatttgtgaagacttcaaaaagatctaaggctatacctcatagatcatttaagaaccacaaaaggctctctgaggatcttaaaaacatgcctcataggtcctccctgttaaacaatatagggtttctaagtatctaaggaagtgtctttcatcagacttacagggaacacaaaatagagaatggattatcttaaagagatttgtgactgtggcttttgtttaatggactgaaacccaatgagattcatagaaaatccacgaagttcttaagaattgtgttgctgaaaacactgccagtttaaaagagaaggccgggcatggtggctcatgcctgtaatcccagcactttgggaggacgaggtgggcagatcatgaggtcaagagatcgagaccatcctggccaacatggtgaaaccctgcctctactaaaaatacaaaaaattagctgggcgtggtgacatgcacctgtagtctcagctacccaggaggctgaggcaggagaattgcttgaacctgggaggcggaggttgcagtgagccgagatcacgcactgcactccagcctggcaacggagtgagactccatctcaaaaaaaaaaaaaaaaaaaaagaaaaagaaaagaaaaagagacagtacaaaatgaaaggaagcctctgaattctagaactgctataggcaggaagcaaactgagaagatttagttttatgcataggtcacttattataacaataaagaaaagattactcaaagaaagtaagactccagagggcagagccaaaagtcgtggccaactctcagagagtagaaccaaaccctactgacaaaactggcaacacgtacctggctggacttcagaatttctattggccagtgacttctatgtacctatactcttccatccatttgtaatggaagcatctattgtggttaacctatgcgtctggcctttacatgatggatatgtgggaggcaccaagaggaacagtacttgaatgctttgcttaaggaaactgacttaaggagactcaactgcaaaaggacctaacttaattagagaaataaaaggtttgcttctcgaggtctatttacagactaagaattacaaaataaaagatctagtgtatgtggattaataattttaataagcgaaagtggtatgtactttctaaagtatatcacaaatgtgatataaagagataattgagaggcagaataatgtgttggtcaaagtgcaagccctgaatcagaatggatggaatcaaatcatggctccactcacctctagttctatcaatgaaggcaagtcagttatatgctctgtgctttcatcccccatttgtaaatcagacatgacaatagtacttacctagggttgttgtgagaattaaattagtgagaatatgcaaaacatttagaaaagttcttaataattatagagataatttacctacaaaaatctaattgacaatgatgacttttattgctgaaaggaaggaaacttttaactcctctcaaattactgggagttcaaaaatgaatcttgttgagtgaagaaaattgctacagaagactttggaagtgattacacaagtacaacatagtaaagctagaatcttctgccacttgtcaaaataaactaaaaatagatgaagaataataaacactaagttgtgaatcctagtgtctacttacgataatttaatgacaataaatctaggcagatctactgggttatgctaagacattttcctagctgtatctaatttgattgactttttctgtttaattagtgaatattataattatgtgttctgaaagttgtatgaatttcataccatcaaatagcactaatgcaaaatagagcaaaatatcaagacttagagtctcttttgtgaacttgccttcttgcaaagaatatagttaactccctggagtaatccttatttgtctacataatgaatgctgtgggaaaatgaggcacttccactcttgttctcatcggcattgatatgaccttgtctgatttagttgaaccaagggcattttcaataattacaagctcagaggtctaccacagatcctctcatgggaggattacttaatgtaggcaaagtagatacaacccttcatgtctggtccattttaatttattggttgcctaaatattcaatcagagctttcaccagctatatttgtagagctgctcaaatgtttttataaaagtaagcacatagaaattacaaacggtgcttcttttcattcttgcaggctgacacctacaaaatatattttgttaggttataaatagttaaaaaacttttttgagctacaatgcttttaattgcttaattttgtagtttttagaaacatgttctagaaatatttaggaaacaatatcacatcctgtggcatcaagaaaggcaggaactttgtttttctaattaataaagaaggctaaaaagagtcagttgttaaataggcaatgggaaaccataattgtaatccatgggaaccacggatttttgctggaatataaaggatgatttaaaattagcttaagatttcactgattcttaatgtattttgttgatatattgattagaaaaaaattacatttagccacacctaaacttattttggcttgtttatcaaattttcagattaattcttgttgatcagtttcctttcctccttccttccttccttccttccttccttccttccttccttccttcctttctcatgctccacaacaaacatttgttaggcaacagttcatttactaacaccataataggtgctagagattccagtagaaatcataatctctgtcaccatgaagttcatgaatttacaataaaaacaaaaccaattaacaaaggtgggccccgaattcaatgactggcctccttataagaagaggagaggatacagagacccagagaagaaggccatgagaaaacagaggcagagattgaaattatgctgccacaagaggaggaacacctggaagctggaagaggcaagaaaggattctttcctagtgcatttggagggagcatggtcttgctgactccttgatttcagacttctaggctccagacttgtgagagaataaatttctgttgtatcaagccacccagtttgtggtactttttgtggcatccttaagaaacgaatacagacatgttcactttgaagtacctttgggacaactgagtcgaatggtcaaaagaaagatgaattcagggatttggaattccagcttaggctggagataaaactttgaggattatcagtatgcgatttggcaataaagccatataagtggctaagatcatccaacgcactgtgtagaatgagacaagaattccatctagggccatgaagaacagtaccttttaggaagagaccaaggtggaggtgctcacaaagggagactggagaggtagaaggaagaccaggatagtggaggggcacatgcagagggtttcaagggttaagtgcagcagactggtcaagtaaaataaagactttgtccgttgcatttaggaaaaggcagttgtggtgacctaactgagacttcagtgcaagagtggagtaattttcaggaatgactgagagatccaaaagtgagtccaggaagtgtagacagctctttccaggggattgaatgtgaaaggtggaaaaccgactgcaactagaagcaaagaatgaagaagacctttcacattgcttaattgtcactatttggattttcttacagatgattatgctcttaactaatgagacactttgatgtttagacaatgatgataaaacaaaacagtacctcattttaattgttgttgtccacaaaactgctcactaaattatggcaaagcaactagaacatgttttacagatacaaatctaaaaagtcagtaaatgagaatctgttgttggtagaaattttctgcataatttacaaagagggaaattataggcagaataatgttttgaaatgcaaaacatctgactcatagtagagatgaagagcagtgaatgacccatgagagaaacttatcttattgttcacacacagggtagagaaaattcaaaccgataaggcatcaggcaaagcaaaactgctttaacgaaggtgagtcataatgccactcagggagatgaatcaggtgcccacatgtccaatcactttcataattacagctccctacatcttttaaattaaaactgaagtcaggtaacaactaatgtccctttagaacaaacttagccaaatggaaatagacagagtcctaagaagtaaaatgagcatatcaaagagatgcagcttttctggaaaggaaaaaaagaaagaggggcagtggctcacacgtgtaatcccagcactttgggaggccaaggtgggtagatcacttgaggccaggaattcgagaccagtcaacatggcaaaaccctgtctctaccaaaaagacaaaaattagccgttcatagtggcacatgcctgtagtcccagctgctccagaggctgaggcacaagaatcacttgaacttgggagatggagtttgcagtgacctgagatcataccactgcactccagcctgggttgcagagtgggactctgtattaaaaaaaaaaaaaaaaaaaaagagagagagagagagagcttgcacaaaagcaagccatccctttaagtgtaatgtcatgactgctggccccaaaagacttttaaatgcttttattgtgccctctgttccaactgattttgataccttcccatcatggaatcactacagtagtttttgctcaacatgaagtcttagatatattatacctgaggcccctaaggtttcctgctcaagccaggagagtaagcagcctccctgccccctcccacccacttcccttctagctttcacagtcaatcaaaagcctagtaaattctacatcttagacatctaccctctgtcctttcccagagatacagcctgatctaagctgctactgacttacctgtaacaactagtttcactcatcctggttgcctcctttaggcaaagctacagcacagctagcgtgaacatggaaacatacaaatcagatatcattctgttgcctaaaccttagatggtttcccgccaagaccaacacaagcttatatgagcctctgtgagaattttgaaaaaaaggtaattgcccctactatgggataagcagaaaagagccacatttcagacccgatttaccctgtggttaggcttatttatgtggcgatgaaaatgcagcagacgttgcctgtagaataaaatccagactctttaaaatggcttatgaagccctctacaacctggcccctgccaatctctgcagtcacctctcaccattctttgatcttgctcttacagatcagtttcagttccttgaccatatcatgttctcacttatatctttgccaaacctgccactgtttggaatagtcttccctcctttgtgaccacataattcctgctcacttttcaggttttgacaaaaatattacctccctttacaggtcttccccgatgcccttgattaaaaatgctttcttgccatacactcccccagatcacctaaatgtgtccttgcataacagtcattaggattcattgaaattgctggcataggctgagtgcagtgcgcatgcctgtaatgccagcactttgggaggctgaggcaagtaaatcacttgagcccaggagttcaagaccagcctaggcaatgtggtgaaaccccatctctacaaaaaaaaaaaaaaaaaagaaaagaaaagaagtaactgggcatggtgttgcatgcctgtagtctcagctactcaagaggctgaagctggggggttacttgcgcctggaagtgtaggctgcagtgagctgtaatcgtgccactgaattccagcctgggcaacacagtgagaccctgtctcaaaataagagagaaattgctggtataacgtcaacattttctaatgaactctcagctcaaagagagcagagattttgtctgtttgctccccactgtattatctgtatatagtaatgtgtctgatgcttagaagctcaagaaatatttattgactgaataaataattacatgaataaaaaagcctggaatccttgttacagtatagtgggaagaggtctagtccaggctcttccactaacttattggttctgtgactgtaaacaagtttcctaaccacggtgagcctactctttaaatgtaatctttaaaatgttgacaataccgtttgtcctatctaccatcaaaattgtcatgaggctcaatgaagctgaggacaactaatgtgtactgacagcctaccacgtgcaaagctttatgctaggtactgccatctgtattatcttgaaaaatagaagaatctctgaaagactgtcatttacccaaagatcatttttcatagtaagtggcaaactaaagacttaagtaggaatttctgtgattccaaaggctcttttcttctcgtcccttcccttcctttccctgccctgccctgccttcccctcctctccctcccctcccctcctctcctctctttctccttcctcaccatgttccatcaatatctatctgattaatacttcaagtcacaggacaagcatcactcgttttgtgaaaccatctctgattcttctgaccagatttatgtgctcctataactatgttcatattgtacttactataataacattagttttaaatttttttttaccacaaagtttttgtgagaggggagcatgtcttcccactattatattatttccagtatcttgcctggatattaacattttataagtactaaaggaatatttgttaaatgaatgaatgaacttactttctctggcttttttagaaaatttgataatacacctaatttttgttcagtgtttacagttttatatttaatttataaacagcaataattgaggccccaaccacagtagctcatatgcttaaagttgttaagatagtattatgaacatacgacatcagctcttgcccaataatagacgtttggttttagattaatatatttaagattaatcttaaagtgcaactaataggctgagtgtagtggctcacgcctgtaatcgcaccactttgggaggccgaggcgggtggatcatttgaagtcaggagttcgagaccagcctggccaacatggcaaaaccccatctctactaaaaatacaaaaatcagctgggcgtgctggcacgtgcctgtagtcccagctactcaggaggctgaggcacaagaattgcttgaacctgggaggtggaggctgcagtgagctaggattgtgccactgcactccagcctgggcaacagagcgaggctgtgtcaaaagtaataataataataattttaaaagtacaaataattattgcctgaaagggaatatgctaaatatgagatacagggaaatgattcaggttcacttcaaatttaatattccagttttaatttgatataaggcaacctcagggaacaaacatgttgttagtagcaaactacttagcttagagaacttaacatagtatttattgtaatgttcccctgttctagaaaatcataactaataatagaaataaaacccagctgcatatcaatggccaagaacatatcaatggactagaaaatatgctaaggagactaaaacagacctgaacatttccttcaaatttaaataaagtaagtactttttacttattactaagatctgaaagatatattaaaaatactttgaaattacgtaacatgtgatctaaattgttcatctaaaacaacagcttgtcaaaatgctaatcactaggaaccgagaggtttgtttagttaatagtgcttcctttcacatgtgcttatgtgcttttcagaaggaaatctgaaatctattattagctttccatagtcaactcctgattatccgagttaataaaatagaacccagacatctgtgctaatagagagaacacagacatacaatagacctgattcagatccaaaaaagcagataacacaaaaattacatctttgactccggaataaatgttgattctttgtagcatatgtgccttcctaataacactccattagtttttctactatagcacaggggaactatgctacggaaaactcacctacacatgtaagtgagagttcactctagattgtgtgaacgcattgttagatgttagaattctgtcagtggtattcattccgcacactggattctgatcatcactaatatgttgaaaggtctcattctcttcaatgctccaggccctaatacaagattcccaacctcataaatggctcctgtagaaagtaacaacatcagggtgaagaaaaagtcagttatgggaaagaaaaaaaaaagccatgctatgctttgttttgacctcgtgaaagaacagggatcactcaagtttttactgttattttcaaagtcaagccttagatacttgttcactaaaggggaagaaaattataaattattgtacattattagatacatggctttctagagtgaaattaatgattttggaaatgctgggccaattactttataaatgtctaagaaaaatgaatatcttcctcatgtaaataactgcaatcttttcatctgtaaaatcagatcagttatgtaacaaaaacttacattaaaaatgacatatctccctgaggcaacttatgaaataacgaatgaaaggtaggctcatgcttccgaagaaagcaatgtagttcagaaaaaactacagagctcaccttactatatacatagcaataggcacataggtggcagaatcccagcaaagcaaatattctttcagtgattcaataatttgccatttattgagcacctattataaggtcagtcatcatgctggacactgtggatacactttatttgagacatggtccctgcatttaaggagctcacagacatgtaaataattttgtgtaagagatgcaatagtcgaagcatgtgaagaacgctagggggagtatggatgcaagaattggtgggagttaaagaaggcttcacaaaggaggttactggcatagacataatgtttgtaccctcccaaaattcatatgtttaaatactaactcccaaggtgatgggattaggagtggggcacttgggaggtgattaggtcatgaggacagagccctcatgaaggcgattagtgcccttattaaagaagcctggccgggcgcggtggctcacgcctgtaatcccagcactttgggaggccgaggtgggtggatcacaaggtcaggagatggagaccatcctggccaacatggtgaaagcccatctttactaaaatacaaaaaattagccaagtgtggtggtgcgtgcctgtagtcccagctactcgggaggctgaggcagggttgttgcttgaaccccggaggcggagattgcggccactccggcctgggcgacagagtgagactctgtctcaaaaaaaaaagaagaagaagaagaagaagcccaagggagctcctttgccctgtccactgtgtgagaacacagagaaaatgctccgtctatgaaccagaaagtgggctctcaccagaaccaaatctgctggtgcctcggtgtggcctccccagcttctggaactcaggaaagttaatttctgtggtttgtaagttacccagtttacggtattttgttataacagcccgaatgaactaaaagagttgtctttagccacagttcatgtaagaattgtaatttaccaagtagattagatgccaaggcattccaagatgatgaaaaagtacttaaaacaaggagccatgaactctaagaacaacatacttagaagtccatgatatatttggatagaggtgaacaggaagttatatccaaattatcaaggactgtgttgagcatgctaagacatttggatattcttatataaaagttattaagcagggacaaagcataagatgttcttaaacagcggaatggcatgatcagatatcctttttaaaaaaataaaaataaaaaaagaactctgttagctttaagagactgtcaagtcctggaggtgggaagcctaaatgagagacatcaatagtttatttaggtctggatgatccctaatatagtctcccaccctctgtcttatgtcttaagatttcattatcagagctttagctttataatttagtacctattaaagtaaaaattggtattttgggaatgataggatagaaaattgcataagtggttaagttgagcttggggatgtggggcaaaggtgacagttttaaaatccttccctctttattgtgtaatctcaaaaagatcaagggactggtattgatgggagaggcaccttgaggccagagcagatggagagagggacagacactctctttccaaaatcagaggagcatgggatatgtttgttttctgcctctccataatatggcacaacgaacttagtggcttacaagagcatgcatttattatctcacagtttacaagagtcaggagtctgggtggcttaactgggccctctgctcagggtctcatttagatattggccagggctccagctctcatctgagggccagggtccttttctaagctcacagactgttggcccaatttgcttccttgcagctgcagagctcatgtggtttattctccaaagctagcaacaaagagagagaaattcagctgcatcaagttgctaacttctatgcccgaaatttaaggaatcagcttattatcagttcatctctcttttgattaacttaaaaccagtgattggagaccttaattacatctgcacaatccattcacctttgccctaaaacatctgggagttatatcctatcacctttgccattggctagtagcaagttatgggcctcacacacactcaaaagaaggacctcacacaaaggcctggagacagggagcaggatcacagccttcttagaatcctgccaatgacagatttgaagagttgaggtcactagagtctaggagaggcaaggaacaatcagtctatccagtaggtagaagtaactggggagaatgtctggaacaagttctgttacaggctggctcactgtggcatgacacctaaaagtgaagcctgcgtttgaagggcctggccccaggtaaacacatgaggcacccacccaacatagacaagtgcagagagcaagaggggaagatgttctccccaaagaagactgtacagatagaagatctgaatagagaaaaaggacttgtagtttgaaaactgttttcaactagggggaaggaggggattttctccatagcaccaacctgggaataccaaaagactcttttcctccttttgttttaatttttcaattaccgtaagcttttctctcacagctttatttttaactttaatgatcacacatatatcacacaaatataactaatacgcagggagatttttcaagagatataaacatcctggttgagaaagtcaggagagaaaaactactaagtaaactaaaaatgacaagataattagagagaagatatatacagcaataaatttgaatttcaaagaaaatttcaggtaacaaatctgttatattttcacgtgcattaatagaagttaaagcaagagaaaattgagttaataaaaaattgatttaaaaaaaaacagattttcaacacaaaatctctctgaaactactgcgcccttgcctctgctgtaattttggaaggattagcgcttgtaggactctggctgtccccagcagtgacacaccttcccaccccaggatacataaaactggggcacagagcagatggaattttcagctctgctcatcagcaggttgacctgcttgttccaagcaattttgtgaatttaagactctggtgcctggctggactcatagcacccgggtgctctgcaatttgtacagaattctaaaatttcaggctctgcttgttgcctagatctttagtaataacagcaataaaaaagtaataatacccacatgtattaagcatttatgaagctacattaattaagcatatgttgtgtttatgtagtttgcagttaatggcactggcttaatgtaatagggatagtattttttaaagaagaacttgatatatttccatcttcaaattgtgtttcactggaaactgctcctcttccagggctggacagggtacctaatgccctcacggaagaaaaggtgggttagcaagtcaatagacttaaaaatcagagtcctgctttagaccaatcagaatgacgtatgaagatctattgtatagacaaatgagaagcccatcccagaagagaaaggacataccagcttctggagaatttcaaaacggaaaaggctgaatgagatggggaggatagggaaatagttctacatttgtgtctggaactttcctttctgggcactggcctcgagagaatgtagcataataaataggtattgggcaaacataagaaaagagagctctgggttcccaatcccatctagattctgggcagggccacatcccattaaacttgatagttccctgtggtaaggactagcaagattttggggataaatctttctgagtcccactgatattcctaaattacgaatgagacccagaggtacctggagcctccagaagggggcctcagcaggcagctggtctgaaagccaactggactgccctggggccagcttggcaaggggagaggtgaccgctgcagaggctaggaaagacagatggccgacctggcagagactcagagggaccactttgccagtgcgaggcgagctgaggtgaccagccagaaagagctccaggctctggccagaatggtcttgacctaaatatgccacctgcaggccacaggtatactggaagggatgcccactccctattatcccttttcctgtgtgtctctccggccccatgtaccagccattcattcgttaggagtttgaacaaaaagctaattcaaactttctccatcctcctcaaatatctcatctttgccctcttttgttactctccaaagacagccttgctcttggttcacagagaaaataagagccaccggacagtaaaatgcaaatcagatcatctctcttcgtttaaaacacctatcaatgacttctcattgctcttaggataaataccaaaatcctgaaggtagctacaagggtttgattgggcttttactcgctttgcagcttcaactgctgtcatttctctcctttctctctgacctgcagtttcatgttaatttctaccacagggatttttttaaatatgctattccttctttaaagaataatcttccttccccaccttggcctacttaattcttctttgtctttcagagccccactcattgttggcatgagatcagtcacccccttgagatactctcacagcactttctcatggcacaccctgagtaaacatatttatttaatattgcttaggtaagccaatagtattatatcaactaatttcatttggagtagcaagtcccatgcactagctaactaacatcaccccattatctaactatatattttcataattttaagtgctgaaaagcaatcaacttttcttcatcaagcatctcgtaacctgtaccttgccttctacctgatgtgcaatttgtcacaaaggcactgggtgaaagtcatcatgtgacaccacaggaaaacaggaaaaagtacaggagacacatttcatgatttatcaagaagtgacaagaatataatttaccattacatctatatgcagcatttgatataaaaatacttgcctctagggtacctaaaatcctggtctattgaaagtactgaacttaccaaccaataactcagctaatatatttaatgtatatatttttaggaaaacaggtcccaaagatgtaatctcgcatcatcctctctaaccctttactttctccatatcagcttgccccgaatcttagcttggagttgagaggtcatctcagcagcctgttcctggccttcctgtcggctggaggccaaagcctccctcagctgcctgtgtccagtggctgctgtaataatgatgtctcagcttcaggaggtctatttccaggccatgtgagctaattaaaacacaggccttcatttgcctttctggcaatccctgatcagtgtgagaggcctatgccaccctctccattctaattttagttctcctctagtgttttctctcctttgcagaaaagcgtcctatgctgctaagcacttacaggcttttgtttttgttatttctcccacttggaaagaagcacttttccactttactccttttgggttttctcctcccatcagttttctcctgcaggaggtgatggtttgaaactactagcaaaactgaagataattagttacccaaggtagttgacttgcttagcaggtgcccttgagaaagtgctaatgcacaaaattcttcatgtggaaacaactttttggacacagctttctataaagatagagaacacctgttatcactggcgatgctcagcttcttttcccccagcaattcacaacacaactatccagagttcagaactcataaattcactcacaataggctgagatgctatttttcggtcttttaaaacggatactctttacttctgataagcataaaattatcacatggcttcctcccaccctaccctccctcactgaaaaaaaatcattatctcaactatctactctacatatctacttgaatatccaacagattttcaaattaaaatgttcaaaactgagatttccccatctccactaatatcagctccatctttccaaaggtcaaaacaccaaatatctttgaattacaactttggtcccttttattttcttatatcctacctccaattcatccaaatatatatgtagatagattgatagatcaatcgatagacagatgatagatagatagatagatagatagatagatagacagatagatctacctttaacatagatccagaattctaccactcctcaccacctctatttaaaaaaaactgttacccgaggaaagaagaacacactggcaaccattaaggggacccaagagattgaaatatcttagcagatgggttctcaggtcattcaaaggtttcacatgagaatgagacacatagtggccatgtgcagagagagccccttagggaagtggccttgaatgaaacacctctcttagggagactttggcagccagggaatgacatgaggagccttggcacctcaaggaagagtgggacaaagtatagaagaagtgaactcagataaaggtgatctatattacaatgtgttaaacaaatggaaagattaaatattatgaacgcagtgaatgttatgtctttagaagtatcaaacatttcttccaggaaattgttgtactgatttaattgcagtatttaagaatatgttgatggaggagaggctaactcagctgctcagtcccatggtcttaagacaattgctgataattataatcattcctagttccttgtgcatcccattctttgaatccaacaattattccaaccctcttctttaataccttgactccagcaatactttgaccccactggaatctccagtcctaagatcttattgatttttcagtgttaattatctccttgttctctttcacttccctcttcatcttgaagtctatggttaaatattacactcccttgcatttatatttccttgctcttcaatcacttcaatataccaatttagcaaaaccacaacctatgtaaaattcaactctccaaatactctgcacctgcatcctccagctgacataggctggagaaaaacacagaaccacattggatagtctaattctaaatgcatgaacacagactttaaataggcctttaatgctgccaggtgatcacatcatatacctcctttgtccactcactgtttcttctaaacaactatttcacactgttctctctttcctcaaactctacatttccttctctgtctttggtttcaattgaagctgctgctctctactttgtagaaaaactgaaaactatcagaacagatcttccccagattcccaccacatggatctcctgccagtatttgcacccacaaccaaaacatctgttcatgctcctgtccaaaaccagtctctccacttggttaataatagaattcatcatcccctctttctcctccatcgtaacttaaaaattcccctgtgaagaaattccttcaagggtagtctatcattactctaagtcctctcctccctttctcccttaaaaccaccacatgaggctctatcatttccaaccaaattgctcttgtcaaggtcagcagtgacccccccacccccaatattgttaaatccatgaacctattctaacttagtcctcatcctacttaacttatcagctatatttgacagagttgatccctctttccttcttaataactttcttcacctgacttcagaacaagacactcaccaaaagatttccttctatctcacaggttgctccttatcagcttcccttgctggtgctgcctttcattccatccttcctcaagctcagttattggtcttcttcctctacacacgctgcatatcatctgtataatgacgacgttcacatctatacctgcagactggaccttctgctgcctacttgacacatctattcagatattcagtaggcatctcaaaattaactcctggtatttctcactgtttaccaaaccttctcttccccaaatctcttgtgtgtcaaacgataggaaattcattcttacagttgttaaggagaaaggtcttggagtcatccttaattcttctcattttctcatataccatgtccactccaccatgaaattccattggatctgccttaaaaatatgtccaacatctctccatttctctctaactctgctgattcacctgtgatcttagctgctttccctctcttactgcaatgctacaattgccttctaactggctttcctgcatccacccttgttccctctccccatccatgatcgacattatagccagattaatcctcataaaatagaagttagatcatgtgacttttcttctgaaagaactgaataggctctaagaaaaatcactctgggttaaagccaaagtcctgaaatggcttattagggccttacataatctatccctcaccctctcttcttacctacaaatattctacatttcaaggaagagcatccacctttcactcatcagcttaagctagaaactttagagccctccttgaaatatttcccctcatctttgcacatccaattaccatgacctgttaattactctttccttgtatctcttaaaccaatttacattttccctttgctatgaaactatttctccccttctccaatgtcatttcatctcaaatctactacatattaatactagagtgaactttctagttaaatgtgaacctatttatatcattccccagactgtataacaccaaagctttttaattctaacaaccttttttgatgattcacaagttgaagctttaatcacaattcaagctactttttaaatggccctctgttataataaattcattggttcacttaaaagtgttttgcagcatacgatttatttttgaagatgtattagtctttgttctgttaaatgccattttggtcaagattaattttttgtgtatgcaatcatttataaaatgaaatgtagattaatcagtaaatttaaattatacttctaagtcaagaaaaggtcagctatctcggcataagcttggtcagctaccttggcataccttgtacagacttacaacaggcccccctatcttaaagctactacagatttcaaataatagtattaaaaacaaaaataatattaagcaataactgtgataatattaaagaataatattagttgccaaggtttacaaaatgtattaacataaactcatttattactacaaatacctaaagagtagatattatttccactttcagaggagcaaattaaatgtcagaaaagttaaaggttttgatggaaaatatctagcaaatcagtgatggaactgactcttcaactcattctctttatatacccagtggcaatgtctgtaaagcataacaaattaaatatgtgtaagctaataaaatgctacttttgcaagtacaaatgccttccttacaagttttcctttttaatgtaaagcaaagcaaattgtgctttcacattattactaaatatcagtctatcctaaaattgtttatgtaatgtggaggtgatatattatcttagaaaaccactgtaacatggtattggaaaccatttcaactgttaaaaggttagatttcagttctgtttaaaggtcagacctgaaaatatcctgatgattacaatttctccacacattttggatgatgccactgaactcctggcagcagcaaaatgtgtttgttctgatcctctgcttctggtggtcagtttcagagtggagaaaaggcgccagggctttgggactagacctaaatttctattgcttttaattaaaataataaaggggaaaaggtaatattcctatccaactgagacagaaaaatttgttgaaaaccgattcttacctgttgaaaaatattcagaaaatcgatcatccccaaaacaatgtactaactaaaacaaaaccaagaaaggcattctgaaaggcaagtatcaaagcatctgtcattgccccattttaggttttcaaatctggaactagtcattcaaataaatattgtttgaataataattatatgcccagaacccttcccaggtccacataccactattttttgtttttacaaatcacatctcatctctcctgtcctataaaactgcatttagtacatagcagacaatacattttaatgctcactgaatgaatgctaggattgatgtagaatacaaagaattatgttaatatcattgttattgctactactactaatagttactaacatttattgagcactaactatctgccaggcactgtgttagtcactttacatgcatcaccacagtacagggtaagttaatctaattaattcattgttaatctaattctatagtaagaaaactatagcataaagagatcaagtctcatagctaggtaagaggctcagtttcacagttagtaatcaaactttggcagtctgacctcagtgcttacaatgggccagagaccaacctattgcagcttacattctagaaagacgacaagaaataagtaaagaagtaaccaatataattttacataggagataaggctatggataaaagaaaacgggatgatttgatagaagtgactagagtgatatagaaaaatggttaaaaacatgaactctagtaccaggtttgagttcataccagaactttttccagctttgtcattatgggctgttatttagttacttatgttctttgtgtatttccttatctacagataataccgaatttatataacagtcatgaggtttaaatgaattgatatacataaaatgcctaaaacagttcctgacacatagtgtcatttaagtatttattattattgttatttttgcatttttattgttataattcttatcacgttgaggacatctacttgagatagggtggtatgggaaggcctctatgaggaaatgcatttgaaccaaaacctaaatgacacttaggcacatgaaaattttaaggcagagattccaggcagaaggaaacaaagtgcaaaagccccagggctagaatgttcagcaaagaaagccagtatggccaggatgagttcagtcaagttacagagctagtcaggaaccaggctaaattaggcatcactggatatggtaaggagttgggttttattctaagtgcgattagaagacatgggaacattttaagcatggtaatgacatgctttgatttacattttataaatatcactccggcttccatgaaagtttggattataacttccatagaatgtcaatcttatcattcccattagtcattgtttttaaaatcttagctttattcctagggaaaagtaattctctgactatatttccagaatgtttgtgttagtgcttttaaacatagagtccgattaaaggacttaagtaggtatatgaacatacatatatacacatacactcactgtgaacaaagattatatggaatactcacatagaccacacttcattattctaaattcaaatcagaatttgaattcactgaatgaatgctaggctgggtttttgaatcatgtttcttggaaggaaagtaattgtttacttacatgaaagttgaccatatgaattaggtcattcttgttatacccaactaaaacagttgagaggtcaaggggagaaaacatctagggcacataacactgttccaacaatgtaattccctgtgagcttggctgctgaagctgcctgctgtaacctgaaaccagttttatctaatagctactgaaacaacctgctgcaactctgagaatcattttacccatagccatcacttaccaatcaaaactttccagctcaccaacatattattagtgccaatgaacttcctcaaagagcaatatgtaactttccccttttttgtaaaacctctatccgtctgttctctggacataatgaagaccatccagcctatgagtatgccacaaatgcaattcttgatttccaaataaaacatttaaaattaagacttttgtctctatattgtatttgtctttaacccttattgtaaattatatggcaggggaggatattctttgggtcccacttctcttatttctaatatgtcccttggccttgccaggcgttagctccttgtcccccaaataaagaaagctttgcaaatctgactgcatggaacaatgtatgttttactagtgggtggtgttatttttcttaatcttaccctcacacccagcattttctcccccaacacacttcctctgcaagttcaccatggtttaaataggttgaaagccagcctaggccacattgtacaattccttcttaccagacatccttgatataagttctccggcttcaaagcatctcttaataaagttgtctgttgattagttgataccgctgtgtggtgaggggtaaatggcagtggaagaacatttccaggtccctggtatttttactactataatcacattaaatcatcatctttaatatctaacaccaaaaggccatccatgtattcaaaaagaatattacagccacactgacaagaatcttaaagccctacattgccacacatggaggtgaactaaaaacacaatgcaatttgtacgaagactcctcctaattcctctaactcataaatacttcagtcttaaaataaaaatacagctgcataaagtgaactgctttacctgtatggttagttccctcattcttgacttctgtggttcccacagaagaggtgggtggactagcaggaggactggcagtaaagcttgtgcaccctgtagatgtgttgatttcaaaatattcttggttgtgattcattcggtgaaaatccagagaagacacaatggatgttcgctgtttaggctaaaataaatgagcatgacgagagtattaatatgatcatgttcatcttcagcccaatctccccatcaatttaatctaagtgataatttttttcagttaaaaactatctgggttttatacttaaaatataattgtgctttacagagatacattaatttcttgatgaattaaataataaaaaattatttaatgagaaaatattatggcatagttgatgtgataggttaggcttttcatttgctttccccagaagattgtaaaaatatagtgcacaaaatttctcttggtaatcaattttgaaagttgcaattttaagtcacctttcattcaactaacatttattaagcatctggcatttgccagacccagaggatatagaatctaataataaaagggccttacaacatagaagaataattaaggcagttccatttttttattctttaaatagtccaaggaattggtggcattagatattgttcccaagtacaagatgctggaattttatcatcagaattaaataaagttatatggaacattttctaagatctaagaatatgcttggtatttttagtgaactttgattttcttttttaagaattttaattaatccccaaatagcaagaaaagtcaatttaaacataaaagttaaaatcatggagtaatagcagatataatctataccctttgtcagtaatgaattactccccgtagcaattttctggggctttttccccatagttttaattatattcactttcttttcttgcctagcagagcttctaacattgtccttcagaaaaactgcagttttttggctctcaaatgtgtgtgtttttcccaggattcaactctacctttcttactttttattttttagtttatattactgaaatactaaaaatctcttataataattataagagatcaaatgtaaactttttataataaggtaaagtttattgtactttactttctccaaagtacaattaacttttggtttactaatgtttttattacccttaaatatgtgttaatccctgtactccatagattattttcctgcaaaatattcaaattgctgtctcttccagcttatcattttcttccaagtagatatcatttaatctataatctaaaatagacaatcatatggaaaatatctgcacagtatagggtttttaaaaaaatatataaggtgtgtaaattatcacaatatgatttattctttcaccaatatttcaccaaatatttttatgaaagacattgagaggtataaatattgttatgcaagagagtgcaagtcatttattattatgacacatcaactcagtaatagaattcaaattagcacccacagaggactcagttgcttttgaaatacaaaagatcagggtttaatgtcaggcttggtttctcatgaaatgtctgtccttgggactgctgaatctcaatttcacattcaatgtcctttccaccacattctataatagcaattagaaaggcatgagctatagcgctggctccaatggagcccatcattctaggctttgttttattgtgttgtgtttttgtttcactttatgtgtaggcaatggaccacatttctatgtttcttctcataaattttataaaggtcaagccaaatgatatatatgattcccccatttctaattgtttcttaaatacatgtttctgaatcctgaccacccatggttctaactgctttaaaaacacaatgttttatgcaatcatgaaaacaaacaagctattttgtgcaatattaattcattctacaaatatttgctgaacatacactaaactgcagatatcatgcacgtaagcactgtgataggaataaaacaagacactgtccctgttttctgtatgaatataaacgaggtgggaggatggatggcacatgagtcttcgaaaaagagacaagcaatccaatgattatgcttcagtatcacatagcagtaagggtgatgaaaaattagaagcattatacttagtcatgccctaaggcaagggtcagcaaactatggcctgtggctcaaatctggctttcttcctgtttctaaaaatgaagttttattggaacaaaactgcacccattgctccctcatttagttatggtctatgactgccctcgtactataattgcagagttcagtagtcgcaacacaggtcatattttccacaacacttgaaatatttattatgtctggctttttagagaaaatatttggccactcctgttctatggaattgtttcacacctcaattttgtgctcaataaaaccgtaactataggtttccttttatttcctagcctgacttgcctttgggttgggcaatgtgactaattctcatcaaatacaatattagtagaagtgacatttttctatccctctcttactctcctaatgatgtagttgaaagatgaaggaaagtcatgaaactcactaattagttttatgagatgttaaagtgaaccttccttttttatatttttattttaagttcaggggtacatgtgcaggtttgttacataggtaaaggtgtgtcatgggggtttgtttaacagattattttatcgcccaggtattaagcctagtactcattagttatttttcctgatcctctccctcctcccaccctccaccatctgataggccccagtgtgtgttgttcccctctatgtgtccatgtgttctcatcatttagttcccagtgatgagtgagaacatgtggtatttgattttctgctcctgcattagttcactcaggataacagcctccagctccatccatgtccctgcaaaggacatgatctcattcttttttatggctgcatagtattccgtggtgtatatataccacattttctttatccagtctatcattggtgagcattgaggttgattccatgtctttcatattgtgaatagtgctgcaatgaacatacgcatgacgtgtctttgtaatagaatgatttatgttcttttgggtatatacgcagtaatgggattactggatcgaatggtatttctgactttaagtctttgaggaatcactgcattctcttccacaatggttgaactaatgtatactcccacctgtagtgtataagtgtggctttttctccacaaccttcccagcatgtgttattttttgactttttaataatagccattctgaattgatttgaaatggtatctcattgtggttttggtttgaattactctaatgatcaatgatgtagcactttttttcatataattgttagctgcatgtatgtcttcttttgagcagcagtgtctgttcacttttctttcttttttttttttttttttttttttttgagacggagtctctatcacccaggctggagtgcagtggcatgatcccagctcaatgcaacctctgcctcctgggttcaagtgattcttgtgcctcagggcctcgagtagctgggattacaggcaagcattaccatgtctggctaatttctgtctttttagtagagacggggttttgccgtgttggtcaggctggtcttgaactcctggcctcaagtgatctgcccacctcatcctcccaaagtgctgggattacaggcgtgaacgaccatacccagcccccaatgcccactttttaatgggggttgatttttttttcttgtaaatgtaagttaatttcttatagatgctggatattagcctttgtcaggtgaatagtttgcaaaaattttctccccttctgtgggttgtctgtttactctgttgacagtttcttttgctgtacagaggctctttagttttactagatttcatttgtcaattttttcttttattccaactgaaggaacacttatacactgttgatgggagtttaaattagttcaaccatgaagacactatggtgattcatcaaacagaaattttgaggatatttctgttcctaaaaacaaaaatataccatttgacccagcaatctaattactgggtatatacccaaaggaatataaatcattctgtcataaagacacatacacacatatgttcactgcagcactattcacaacggcaaagacatggaatcaatctaaatgcccatcagtgatagactggataaagaaaatgtgggatataatatatagcatggaatactatgcagccataaaaaagaattagatcatgtccttttcaggaacatggttggagaccgaggctattatccttagcaaactaacacaagaacagaaaaccaaatattgcatgttctcacttatatgtgggagctaaattataactaatggacacatagagaagaacaacacatactgggcctattggagagtggagggtaggaggaaggagagcatcaggaaaaataactaatgggtactaggcttaatgcctgggtgacaaaataatctgtacaacaaaccccatgatactattttacctatgtaacctgcacatgtactcctgaactcaaaatagaagttacataaaaaatttaaaaaaagaaatgagaacaaagaagctgctttgaggaaactcaacaaaattcaagataacgcagatgaggtattcagaatcctatcagataaatttaacaaagagattgaaattattgaaaagaatcaagcagaaattctggagctgaaaaatgcaactggtatactgaagaatgcattagaatctgttaaaagcagaattgatcaggcagaagaaagaattagtgagcttcaaaacaggctatttgtaaatatatagtcagagaagacaaaagaaaaaagaataaaaaagaatgaatcatggcttcaagatctagaaaatagcttccaaagggcaaatctaacagttattggccttatagaggagggagagaggtgggtggaataaaaagtttactcaaagtgagaacagagaacttcctagacctaaagaaagatctcaatattcaagtataagaaggccatagaataccaaggagatttaatccaaacaagactacctcaagctatttaataacttaactctcaaaattcaaggataaacaaaggattataaatgcagcaagagaaaagaagcaaataacgtacaatgaagctccaatatgcttggcagcagatttctcagtagaaactttacatgccaggaaagagtggcatgacatatttaaagtgctggaggaaaaaatgtttatcctagaatagtatatccagtgaaaatatccttcaaacatgaaggagaaataaagactttcccagacaaacaaaagttgagaaatttcttcaacattagatctttcctacaataaatgctaaagggagttcttcagtgtgaaagaaaatgacgttaatgagcaacaagaaatcatctgaaggtacataactcatgagtaaaaaaaacacagaatagtataacactgtaattgggatgtgtgaactcatattttgaggtgacaaatgaaaaaatagactgataataacaagtatgaaaacttttcaagacatagacagtacaataagacataaatagaaacaacaaaagttaaaaagtagggggacaaagttaatggctacaatatttattagtttttcctttgcttgtttgtttatgtaatcagtgttaagttgccatcagtttaaaataatggattataaaaaattatttgcaagccttaaggtaaattcaaattaaaaatcctacaatagatacataagaaataaaacaagaaattaaaacataccagcagagaaaatcttcactaaaaggaagagagggaggaaggagagaaggaggagatcacacaaaaaactagaaaacaaataacacaatggcaggataagtgcttatcattaatatcaataatattgaataattagactagaatctccagtcaaaagacagagagtagctgaatgggttaaaaaaaaaagacccaacaatctattgcctgcaagaaatacacttcacctataaagatacacatagactgaaaataaggggatggacaaagatattccatgcaaataaaaatcaaaaaagagcagtcgtagctatactgatatgacaaaatagatttcaagaaaaaactataaaaacagacaaaaaatcattacataatgataaagggtgaaaatcaagaagatgatatcataatttcaaatatatacgcacccagatatataaagcaaatattattaagggtaaagagagacataaaccccaatacaatagtagctgaagacttcaacaacccactttcatcattggacagatcattcagacagaaaatcaacaaagaaatgtcagacttaatctgtactataggtcaaatgggcttaataggtatctacagaacatttcaatgaacagttacagaatatacattcttctccttagtacatgaataattctcaaagatagaccatttgttaggtcacgaaacaagtcttaaaaaaactaaaaaataaattgaaattatatcaagtatcttctttatccactataaaataaaactaggaatcaataacaagaggaattttggaaactatacaaacacgtgaaaattaaacaatatgctactgaatgaccaaatgggtcaatgaagaaattaagaggggaatttaaaaatgtcttgaagcaaatggtaatgaaaagacaacatagcaaaacctatgggctacagcaaaagcagaactaacaggaaaatttatagctataagcacctacatcaaaaaagtagaaaaacttcaaataacctaacaatgcatcctaagaacaagaaaggcaagagaaaaccatacccaaagttagaagaaaagaaataataaagatcagagcagaaatagataaaattgaaacaaagaaaataccataaatgctaaataaaataaaaagttggttttttgaaaagataaaattgacaaacctttagccagattaagaaaagagagataagcctcaagtaaataaaatgagagaagaaaaagacaacgttacaactgatgccacagaaattcaaaggatcattagaggctcctaggagcaagcagtagtctcccagcaaagaaaagcccaggatctgatggcttcactgctgaattctaccaaacatttaaagaataactaatacatgccttactcaaactatgccaagaaatggaggaggaggaaatacttctgaactcattctacaaggctggtattaccctgataccaaaaccggacaaagacacatcaaaaacagaaaactacgggccaatattcctgatgcatgttgatgcaaaaattctcaacaaaatactagcaaaccaaattcaacaccacattaaaaaggccattcattatgatgaaggggaatttatcccagggatgcaaggatggttcaacttatgtaaatcaatcagataatacaacataccagcaaaattaaggacaaaaaactacataactgatttaattgatgctgaaaaagaatttgataaaattcaacatcccttcatgataaaaacccactgggtatagaagaaacagacctcgaatagtaaaagccatgtacaacagacccacagtatcatacaaaatgggagaaaactgaaagcctttcctctaagacctggaacttgacaaggacgcccactttcagcactcttattcaccgtcatactggaagtcctggctagtaatcagacaagagaaagaaataaagggcatccaagttgaaaaggaagaatttgaattagcctttcaaaatcttacatattttgaaaaacctaaagattctaccaaaaaactattagaactgataaattcagtaaagttgcagaatacaaaatcaacatacaaaaaccagtagcatttctatatgccaacagtgaataatcagaaaaaatagaacaaagaagtctcatttacaatagctacaaataaaataaaatatctaggaataaacttaaccaaagaagtaaaagagctctacagtgaaaactataaacacggatgaaagacattgaaaatcatataagaaaatgaaaagatattccactttctggattggtagaataaacactgttaaaatatccatactacctaaagcaatctacagattcaatgcaatcattaacaaaatactaatgatattcttcacagaaatggaaaaaacaatcctaaaatgtatatggaaccaaaaaagacccagaagagaataagccatcatgagcaaaaagaataaaactggaggaatcacattgcctgacttcaagttatactaccaagctatagtaaccaaaacagcatggttctggcatagaagcagacaaatagaccaatggaacagaatggacaacccaggaacaaatctatacactgacagtgaattcatttttgacaaaggtgtcaagaacatacacaaggttacataagggaaaagacagggtggtggtggaaaaacaggatatccataagcagaagaacgaaagtagacccctatctcttgccttatacaaaaatcaaatcaaaatggattaaataattaaatctaagacctcaaactacaaaactactaaaagaaagcatcagggaagctctccaggacattggactaggcaaaaatttcttaaggaacacttcacaagcataggcaaccaaagcaaaagcggacaagtgagattatatcaagctaaaaacttctgcacagcaaaggaaacaaccaataaagtgaagagaccacctaaagaatgggagaaaatatttacaagctatccatctgacaagagattaatagccagaatatgtaaggagatcaaaaaactgaaaaggaaaaaaaatctaagaatctgatttaaaatgggcaaaagatcagaatagacatttctcaaaagaagacatacaaatggcgaaccgatatgagaaaaggtgttcaatattactgatcatatgagaaatgcaaattacaactacaaggaaatatcacctcaccccagttaaaatggcttttatccaaaagacaggcaacgacaaatgctggcaaggatgtagagaaaatgaaacccttgtaaactgctggtgggaatgtaaattactacaaccaatgtagagaaaaatggagattttggaggttccttaaataactagaaatagaactaccatatgatcctgcagtcacactgctaggtatattcccaaaagtatatcgaaaacatagctcattctctctcatgtttattgcaggactattcacaatagccaagatttagaagccacctaagtgtctatcaacatatgaatggataaagaaaatgtggtacataaacacaatggcatactattcggctataaaaaagaatgagatcctgtcatttgcaacaacatggatggaactggaagtcattacgttaagtgaaataagccaggcacagaaagacaaacattgcatgttctcatttatttgtaggaactagaaaaattaaaacaattgaactcacagtggtagagagtggagtgatggttaccagatgctaaaaatggtaatttgggtggtggggggagtgggaatagttaatgggctcaaaaatgtggttggaatgaataagatctagtatttgatagcacaatattatgactagagtcagcaataatttattgtaccttttaaaataactaaaaccgtataactgaattatgggtaatacaaagaaaggaaaaatgcttgagttgatgaacaccccatttaccccaaaatgattattacactgcatgcctgtgtcaaaatatctcatatactctacaaatatatatacctactatgtaccccaaaaaactaaaaattaaaataaaaaagagatatctatgtggagaaatggaataacagcaatgggagaaaagaataaagagatggtcataatattaaaatggagataaaaaagaataggtctagaatattcatttaaacatgtttgatttaatataatttttactactcaaatagaattgcactcagccattcagtataaaaaagaaaaagtgttttcacaaattcactgaaattacatattgaatttgccaagctttgatatgtagaatgaattgcacttgtgttcgttgtggcttctccactttaaaacatatccctccactgtggtccagtcctcatatcaccctactttccagaggacttgcttctatacatatttacttagcaggagtcagcaaactacatcttatgtgccaaagccaggcttctgaatatttttgttcagcctgaaagctaagaatggttttcacattttttatcgttttttagaaaaggaaaaataatattagtaacacatgaaaattgtatgaaactcaaacttcactgtttgaaaacaaagttttatggagacatagccatgtccattcattgatgtattgtctatggctgttttcctgctacagtagcagagtgtagtagttgtaacgtagaccttatgaacgaagacttaactattttactctctgatcttttataaaaaaaaaaaattgtgaccctttctataaagtgaataggaaatttcagctgggcacagtggttcacgcctgtaatcccagcactttgggaggccgaggtgggcggatcacgaggtcaggagatcgagaccatcccggctaacacggtgaaaccccgtctctactaaaaatacaaaaaattagccgggtgtggttgcaggctcctgtagtcccagctactcgggaggctgaggcaggagaatggcgtgaacctgggagggggagcttgcagggagccgagatcgggccactgcactccagcctgggcaacagggcaagactccatctcaaacaaacaaacaaaccaacaaacaaaagttaacaggaaatttctctgaggaggtaaagttgaacagacacaggaacgactgtgattgaatcagggaaccagtgcaacataaaaaggtaggaccccttgtttcaagagcaggtacaaaaacttttttctttttcccatgttctctctctagatctgttatggtgttcttttatttgctacttaacgtattgctcccttggtcatggaaacactcacagggtgagggcagattcttacaggaatgcagtggctctgccctgcaactcagtaagtgcatctgaccttgacccttccccacactcatggtctcactactgcatcagcagtttctgggcaggccaggggcacctgggttggaggagcaggtggaaaagaattttactcagtaaagaaagtagaaatagggtggaaagtgggaaaacagttaagtcaagattccaagccccaacacatgttcaattttcccataaaccgccttacaaaaccctgggccaggagcaccagggttgggggagctgctagagtccccagtgtctactgttcccatctttatgtctgtgtgtacccaatgtttaggtcccacttattagtaagaatgtgtggtatttggttttctgtttctgtgttaattcactcaggataacggtctctagctacattcatgctgctgccaaggacatgatttcattcttctttatggctgcatagtattccacagtgtatatgtaccacattttctttatccaatccactactgatgggcacttaggctgattccatgtcttctctatagtgaatagcaccgcaataaacatatgagtgcaggtgttttttggtagaaatatttattttcctttgggtctatatcaacctgggatattttgtgtgatacatatgacgaaaatatttaattctaaatatttttttctcaaaatgatagcctactgtcccaataccattatttatccactgatttgaaatgtcacctttatcatatactaaatttccaaatagagattgggcttgcatttttggactcgactatattcccattgatctatttgtctattcctgtactaacatcacactctcttacttactgtatggcttctatttctagagctcctagtgcgtggatattggatctctttgacccttcctgttttatatactgggagtattctacagttcattgtcctaaagaaccttcattaatttgctaggaaatacttattgaccattatcagctgtgtggtcaggcgctgttgtagcctctggggatacatcaatgaacaaataagataaggcacataattttaggcattttgttttaacttttggtgtgattatgctatttttaattttaaaaacttttcttttttttcaagtattccatttttaaaatagcctgttattaactttataagttcaatcacctctcaaatctttctgaggatactgattagagtctttttctggcattaagtcagttttcttaaaggttccttactttgttcattaagcctggtttctctctttttggttgttaatttttcctcaaccatctggtgtcttggtcaagcactttttatacctagggcactgtccccacattaggagcttcagggggtccttcaccttccttagatacttattaccatctggtgggcaaacaacaaagctgattgctccacataggagatgctaaggttctggttgccctgtccactccctggctttgataaccatgccctgttgctcaggcttgagattcttcgcagaggtctaatgaggatgtcaaatccactcattgttccagtgacatcttcccctcttccaccagtgttggatggtgggctttttcctcttgttttgtctaaatctagcaatatttgattttatcttttagaatttcgcaaatgcctcaggtagtaactctccctgtttttcatcactgctatgaatttattgttaattttgtatttatttttaccattttgattgcaagtaaggaggaggaaaatgtaaacacttgcgatccactcagctttatcagttagaattctcatatttctctgtcttgatcactttgaagactgtatataagagatttgaggaagtctggacaactcgaagaaagtaagtatcattgccatttcatcacagatgtcatgcaaatggaaaattattatattttcttgatttttcaataaatggaaaacaattttaagtgaagtacaattttttggttgttatgaatatgatgttaatgtgatcaagacttgctctaaagatgtagaactccttatcttcaggtaggcaaatgcaattcttctgctttatagattatggccaaacatagacaaaaaatatatgatcaccacaagggagttaaagaagtcgtgagtgagtattgagtatttaagagacgtggacattcttctaggcacttgaaatttgttgtctcattgaagcctataatgttagtatcaaaagtagctattactctttccattttatagacttgagattcacagataatctcagttaagtgggagagctgaaattaaagttaagtgggagagatgaaattaaaattaagcgggagagatgaaattaaaacacaaatctagtgaatttcaaattgattgcattttccccgaaagacaccacactataggtaaagcaaagagaagcaaacatatttacaagtaaagccaagagcctaataactcttgagtttctcatctttatatcaacgcacaattttcctactcttcagtctattggtagcattgatttttttaaaaatctacattgtttcaaaagctgttgaaataaaacgcaagtgggtggaaaatgggaataaatagtatctaattctgctatgcattaaactcttacagtcactacattttttataagagaaaggcagaaaatttttaaaaatctttatatctcctgactttagctcttcatttcatttttatatagaggtatctgactatgaaataatatgcatactcatcttctatttaaaaagacaaattataaaacagactgtagggactctgtactgcttctcagacactgcaatcccacataggagcaaggtcagatttactgatacaggcaactgtccaaagcagctcttctcctgctagctgttgatgttctcttcctctctgccagctccataacaagggccctcacccggtgcaccaccctcgcccacacacacaccctgaccgaggccctgagagttccaggttcctgcacctgcctttcctgcccagggctttttgagaacagacagttgctctcaagcccagggctttctgagagcagacagttgctcttgagcccttctctgaggtcctctgaacacccctactccaccatcaatcagagcagttatactttttttttttgcttttacctattaggtttctgttaggttgaaacatatgaaactgctgatattcaaccgtattacctgcaaaaatagcaatttcatataactcagcctacataaacttttcttttaacagagttctctggctaaataatttgaaaaccatttctctaggccttaagtgagcctgacattttgctggccccagtaaaattgaactctttcccttcttagacatcactagtaagagtataaagacacatgcacatgtatgtttattgcagcactattcacaatagcaaagacttggaaccaacccaaatgtccatcaataatagactggataaagaaaatgtggcacagatacaccatggaatactatgcagccataaaaaggatgagttcatgtcctttgcagggacatggatgaagctggaaaccatcattctcagcaaactaacacaggaacagaaaaccaaacaccacatgttctcactcataaatgggagttgaacaattagaacacgtggacacagggagggaaacatcacacactggggcctgtccagggggtgaggggttaggggaaggatagcattaggagaaatacctaacgtaaatgatgtgttgatgggtgcaacaaaccaccatagcacatgtatacctatgtaacaaacctgcgcgttctgcacatgtattccagagagtataaatgggtatatgcccttttcagggcaacttgtcaaaatagattttttaaaagtgttaagtctatccctagtatttaacatacataagcatgagtgtggagtttgttagatggaaaatttgtaatatatgtttcttcgtatgagttagtttcttcatacaatgtattcaaatcttcattggaaagactgtatacacacatgagaggataataaaagttctagtttttattctagttttatttaataaaggtcaaaagtagttttggactcaatgtagatattaaagacctgaaaagcattttgacctccaaaccatggagtttgtcctcatagaagctttcccagcatgaaaatagtcacaactattttgcaaaaaatactttttgacttaggtattgcaaatacttatatattaatattttatagatgttcatgtcaacttcaaatgcatccagaatttaaaataagtaaaaccagctttattttccacacttaagttctttttttaaagcaacaatttcaagtgatttgtttcatcttaggaacagcaggaaataattatgcaatggattatagaagatatattctgaacagctaaaataggaagcacatatcactgtgtgggtgaaagaaagacatttttacaaataaaggtgcacactgctttttaaatagcttaattttttaattaaattttttattttcaataattgtagattcatatgccattgtgagaaatcatagagtgcactcatgtttctttttcctagattccctcagtgggcacatctcacaaaattatagtgcaacatcgtaaaaaggacaagaaacagagcaattccatcaccacgaggatccctcccattgcccttttttttgagagggagtctcgctctgccgcccaggctggagtgtagtggtgagatctcggctcacggcaagctccgcctcccaggttcacgccattttcctgcctcagcctcctaagtagctgggactacaggcgcccgccaccacgcccggctaattttttgtatttttagtagagacggggtttcactgtgttagccaggatggtctcaatctcctgacctcgtgatccacccaccttggcctcctaaagtgctggaattacaggcgtgaaccaccgcgccaggccccattgcccttttatagctacactcacttctctcctgcccccacctccaccttaactcctggtaactaccgatctgttatccagttctacaattttgtcacattaataatgctatattaataggatcacacagtatgtaaccttttaggactggcttttctcactcagcatacttttctgcagattcatccaagctgttgtgtgtatcaatagcttgctccattttattgctggatagtattcaatgacatggatgtttaaccattcacccaatgaaggacatctgggttgtttccagtttttagctgttatgaataatgctgctataaatatttgtgtacagatttttcagtgaacatgttttcatttatctgggataaattcccagaagtacaaatgctggttggtatggcagttcaatgtttaatgttttaagaaactgccaaactgttttccaaaattgctgtacaattttacatttccaccagcaatctatgagcttctctgtatccttgccagcatttagtgttgtcacaattttttattttagcccttctgataggtgtgtagtgatatctcattgtggttttactttgcgtctcccttgtggataatgatgttgaatatcttttcttgtgcttatttgctgccatctacatatcctctgcagtaaaacgtctcttcatgtcttctgcccattttctaattggattatttttatactattgagttttgagagtgctttataagttctagatattattctttgttagatatgtgatttataaatattttctccagtatgtaccttgtcttctcatcttcttaatagggtttttcacagagcaaaagtttttaactttaatgaagtacatttttttttaaccagaggtgctagtcacaccttattctttgatagagcataaacagaggtggggagggagacagtgcaaagggagaagggcaggctcttgagagcgaggttactggcatgcagtcaggccccctctgatttggggactatcacttcttaaacacgtgctctgtggccgttgccatgccaagctcatttatatttgggaggaaggagaggatcaggacaatttatttttttatggattatgtctttggtatcaagtataagaactctttgtctaactctagatcccagaaatttttttcctatttttttctaaaagttttatagttctatattttaagtcaattatccattttgaattaatttttacataagccatatgacttaggtcaagtttcaacttgtggcctgtgtatgtccaactgctccagcaccaggctatcttccctccactgaactgcttttgtacctttgtcaaatagcagtcaggtttatgtgtatgggtatatttctgggttctctcttctgtcctattgatctaagtgtctatcccttcactgataatactacattgtcttaagtactgtagctataaaataaatcttgaaactgggtagactgattcctcccacttttttcttctctttcgatttttttttagttatcctagttactttacgtatctatgcaaatattagaataatcttatatttacaaaaaagtgttgctgtgactttgataggaattatgttaaatctaaatatcaatttggaacaatttacatctttgctacactgagtcttctaatccataaacaggtatgtctttccacttctttgaacattttttttcatcagtgttttgtagttttcagtatacaagacctgtacatgttaaagaggagttcaccgaggctcataatcaaactatcaaaaattaaagacgaagaaaaaattctgaaagcagcaagaagtaagaaacatatcacatacaaagaagtccaatgtaactatcagtggatttatcaggaaaaaccctgcaggctaggaaaggggtaggatgatatcttcaaactgctaaatgaaaacaaattgccaaccaagaatacttaaatcagttaagctgtccttcagaaatgagagagaaatagtaactttcccaaacaaaagctaagggagttcattatcactgggcctgtttcacagaaattactaaagggagttctttaagctgtatcaaaaggccactaattaataacataaaacatgcaaaagcacaacactcaatggtataagcattacagaatcacattcagaatactctggacaaaaatgttggtatgcaaagcaattttatctctagtacaatggttaatagacatctattaaaacaactataaataaaataatcaggggatacaaattacaaaatgatgtaaattttgacatccaaaacataaaatgagggatttggataaaagtgttagatttatatctaattattattttttctttttgtatttgtgattataaatgaccttgtatttttaatttctgtgtatatatgttcataactagttcacagaaatacaatttttttatgtgtatcttgcatcccgtgaccttgttgagctcacttattagtcacaggagtgctgtttttgttttgttttgttttgttttttagcttgcttcggatttctacgaagacaatcatgtcatctgcaaataggaagtttcagttttcctttccaaatctgtatgccttttatttttttgtttttcttcttggcacaggttagagcttccagcactatgttgagtgacagtggtgagcacagtggacatccttgctttgttcctaatcttagaaagaaagtcttcatgtttttaccattaagtataatgttagctgtagattttttatagatgctcttcatcaagttgagaaaattcccctcaatttctattcttttaagaggtcttaaaaaacaaaacaacatgaatgggtgttgaattttgttgaatgctttctgtgtatcaattaatatcattatgtggattttcttctttattgatttcaaatattgaatgagttatgcatccctaaaataaacctcactttgtaattgtatataattttaaaaatacatttctgaatactatttgctaatattttgttaggaattttttgtctatattcatgaggaatattgctctggggtgtgggtgtatgtggaattgggaatactaggtcataaaatgaattagaaaacattcccccattttcttttttcaagacaagattgtttagagttagtgttaattcttctttaaatgttgttataattctccaacaaaacaatgtgagcttggagatttattttttgaaagcttttttgattatgaattccatttcattaatagttgtagggctattcacattatgtattacatattgggtaaattgtggtagtttgttttaataattgatccattttagctaagttgtcaaatttatgtatgtagaatagtttgtaatattcctttattatccttttgatgtcttcagggtctgtagtgacatccctattttattcctgatataggtaatttgtgtctttcttttttctctcagtttcactttaagaacagtaggaaataacaatataatgatttacagaagatatgttcctagcagccaaaatattaataaaagcttatattgctgtatacgtgaaagaaaatttttacaaataagagtgggcattgcttttggtttttaacttctcaaaggtcattctgctttctaattcttgtttttagagatagggtctcactctatcccccaggctagagtccagtggtaaaatcatatcttactgcagcctcaatctcctgggctcaagcgatcctcccaccttagccccctgagtagttagcaatacaggcacacaccaccgtgtccaactaattttttaaaactctttgtagatatatggtctggctatgttgccaggttggtctcaaattcctggcctcaagtgatgttcctgtcttgacctcccaaaatgctgggatttcaggcatgagccagcacacccagcctgctttctaattcttaagtcatctctttactattatagtaatagtgcccatgaaatacattctgtttcaggtatcctacctttttttcatctaaatcctacaaaaactccacagatgggcagacagggaaactgagtgtcaaagatactcagtaactattggacagctttagaatccagctctctcaacacttaaaagccatgaatacactttccattacatcattctgtctttttgctataattacccaaaatgtcttcctatacaataaaaataacagaacttttttagcttaatgatagtttaaaagaatattttccccagagtatctgtaaaagcatttaccacgagggttatcacaaagtaataaatatgttagtaggtagaataaagttaaggtttaaaccagaaagatgtgacaatataagtacttctgtgaataaatttaagatggtgtgaagttttaagaataagcacatagcacttcccctggagtaaaatataatcagggtcataaaaatttgtgtcataatatgatagcaataagttttaaagtgaagataagtattacaattaattttagctaacaagttcaactccttttctgctatttttctaaaacagttataaaaatgcccattaataaaagtttgtctttttttcctgactcattcctggcaaaggaatattcaaaaggttgatatgaaggggtataagtatataaagcaagtgttaaaaaatacataaactcagtaataagcttctaaataatcaagaattgttatgatttgtatgtaaatttcatttggatttccctcaaggaaacaaaatcattaagttctgaaatagtctctaattctaaaactcctttcttcatcttcatatcaatgaaaaaattggtatcctcaattaaaaagtacctttatgtttctaactaattcctatgggttaaacttattaacacatatttgggagacaaaataggatttgcagcaaagtagaattggattcagatcctaatgtcggtatttacagtttagtatttgcattcacaaaatgaggattatataagcctccccacagaattattgtctggattaattgagataatgtaaatgaaagactagaataaggcctaaattagtaaaggattgataagtattcatcttcttctcccactgtaatattttagtataagtaggatctaactgaaagaagacattgatgagttaaatcataaggcagccctcctaataaatggcagaatcaccaaattacatgaacagtccagcagaatctccctgacacaatttacagaggtgaaggttgaaggaaaagaggaaatcaataggttcggaagaaaatacagcacacagacttattttatcagtgtttaagagagctgccctggaaattgcagtaagagctctaagtagaaaccttccgggggcgtctctgatgggaaataagtggcagagaccctggtagaacctctctaaatagcccaccatctctgatttggaggagtgagggctcatggcaatgagggaccacaaagaagggggaaaaagaagagaagatacactccaattaatcacaataagcctttttagaaagcatggcattaggaggttaaagagcccctgtggtgacttgtttacaggagcagaaagttaagaggctgttaggagcttgaagaggaaacatcagacttcagcttctgagaaagaagttagtcattagacatattttgctttagaaacaaacccaagtgatatagtttgaatatatgtccccatcaaatctcacactgaactgtaatcctcagtgttggaggtggggcttggtgggaggtgactgggtcaatggggcaaatccttcatgtcttggtgctgtcctcgtggcaatgttttcacaagatctggttgtttaagtgtgtggcacctccccaccaaccccactctctctcttgctcctgcttttgccatgtgatgtgcctgcttgcacttcacaacttctgccatgagtaaatgctcccttaggcctccccagaagccaagtagacggtggagccatgcttgcacagcctgcagaaccgtgagccaattaaatctgttttctttataaattacccagcaaagcaggcatttctttagagcaatgcaagaatgtcctaacacaccaagcaaaacataaagatggatgttaatgtgccctggtgcaatggcatcaccaaacacagataagacagcacaaaataattcttcttgatgggactgctcattcatgactctgtcatcttctccacttaccagatttaagagaaataaccagcactatccaatattaactaaaagatagatgccattctttccctcaagcacctcatattttagtgagaaagctatgaaagaggaaggtgaaaagtcctatgaagaaatagaacttcctatgaagacatataaccagggatctaacctaatttggagtgtaaagagaagcttctttaaggaagtaatctttcagctgccacctgaaggagatgtagaaattagctaagtgaaagcagtgtgagcgggttaaaatgaagtgtccaagtcagaaggaacatgaaatgccgtaatcctgatgtttacagcaggaaaagatacagacagcacatgtaaggaactaaaaggtggttgatgtgttcgggatacaaaaaggaagaagaagagagagaatgggcacatctttccagaagtttgtgaaatcgaataaaatttgcatagctatgggagatactattctatgatggcattgacttgagtacattaaaatgctgatggaaatgaggtggtaaaaagagatatattaaagagataagaacaaaaaggaattgagagtaaaaatttcctacaaaggaggtaagggtggaatttagagaatgtgtgaaaagtttgatgtttagagaggcagaggaatgccttcagtttaataggatggagaaagaaatgaagaggttcagaaaggttttaaacattttttggcaaagtattgaggtaattccttgttgatgacttccagtttctctggaaagtgaggattaaattatctgagtagactaggaggaaaatcaggtatctgtgaagagtaaaattcaaaagtcattaggaaagttggcatgcaagctaactggagaaatttaggtctgctgagtagtgttaagggcccagaagagattgagaactatgaatttataacattaaaataagattatgaaaaaattcaacatcactgatcattagagaaatgcaaatcaaaaccacaatgagatatcacctcacaccagtcagaatgactaatattacaaactcaaaaaataacagatgttggcgaggttgtggagaaaaaggaacactcatacactgttggtgggagtgtaaattagttccattattgtggaagagagtgtggcaattcctcaaagacctaaaaacagaaatacctttcaacccagcaatcgcattactgggtatgtacccaaaagaatataaatctttctatcataaagacacatgcacttgcacgttcactgcagcactattcaccataacaaagacatgggatcaacataaatgcctgtcattggtagactggatttaaaaagtgtggtacatatacaccatggaatattatgcaacagaaaaaaaaaggaatgagatcatgtcctttgcaggaacatggatggagctggaggtcattatccttagcaaactaatgcaggaacagaaaaccaaacaccacatgttctcacttataagtgggagctaaatggtgagaacatgtgaacacatagaagagaataacacacactgggacctattggagggtggagggtgggaggagggagaggatcaggaaaaatagctaatgggtactaggcttaacctgggtgatgaaataatctgtataacccccccaccccgacacaagtttacctatataacaaacctgcacatgtacctctgaacttgagggttaaattttttaaaaagattatgaattgattaacttctcgacttaggcttttttctattttacctgaaaataaatgaaacaatttattagtctctcactatttactcttgcacatatacatatatatccatatataaatgagttaatgcttttgcatttatttcagtgtaatataataagtagggaaatacgatgtgtgattattatatagttattatggattatgtactttatcaatataaaaatcctatttattcctatgctttttatctcagtggagtccaaggattaggccatgaaggattgaaagattcagagcaatgttccaggcagaagcgtatgttttgaaagagcatgctgcttttgaggaagtaaaataaatctaggtttggaatatagactagaagagatcaagaagtaagaattaactccagaaataaacagaaacctggtcatacagtttgatggctttaagttgaccaagcaatggtggtcaaacctgtgcttagctaggcttaaaagctatgaagtaaatagacaggtttgaaaaaaatagactatcactttgagaaacaatctggattttatgtgtactattttatttaattttttcctcctgtacaggtagcagaaacacacacacacacacacacacacatacacacacacacccataaggaaaattttaacttgtctatctatctatctgtcatctatctgtctgtctgtctgtctgtctagttaaagcaaactaaatatggcctgagaaggactccatacttccatatttgaatccttgtggatgaaccataacctagcttaacaggcagacaagatgaaaacctaacttaggagtatgtgcctgtaacaatagctgagtcttggccaatcacagcagccatacctcaaccactcatagactgctaagtgttcaaacagggttcaattaaggcaaaagccaacctgtaaccagccgtttctgaacctcacttctaagttcttttctgtacctcactttcctttttatgtctataaattagttctgaccacgaggcacccctggagtctctgaatctgctgtgattctgggggctgcccggttcacaagtcattcattgctcaattaaattcctttcaatttaattcggctaaagtttttcttttaacaatatataaacacacacccacagttgtacatattacaaatttgcaaataatctgtgtatatttatattcagtttattttgtagttaacagttaacatttttatagttaccatataattaagttattcatatgattaaattagctttcaaataatttttaatatttttaatattctatcttccattcaaacaaaaatttttattctaattcttttctgttataaatagtagtacaatgaattattttacagaattgtttcctctttctgggcatttcattggtacagacaagaaagtactagacgaaaagtagtatgtttttcaagattcttgattcacattaccaagaaaatgtatagaaacatttccaccattgttctacaagactatcagtctgtgcctgcatcaccatgaatttaccatgcatttgctaagcacaggatatatttttgtttttaaaaagttttaactacttcttaggttatgttataactttattgtgcatttccttgatattcagcgccattaatcatttttccttttatttattattattctttttctttcttaaattgggtatttatattgtttgtccattttcctctgtggatgtgttagtcttctttgtggccttctaagagctctttgcatattaaaattttaacagtttcactgtttatatttatctctatagcattagttacttgttttctattttaataaagtttttttgatgcaaggcaacttaatttctatgaagtcaaggctatttatcttttcctttggtattactttcacaacttttgtgttaagtaaatgtttgtatctgtaagattatgttcgaaatattgacagtgtgtgtctctatcttttcatacattttgttagttaatagagaaatgactgctgagctaatcatttgtaactgttgtgacagaagaaagtgaagtgtaaagatgagaagataagaaaatgtgtctctcagagttgttattaatcaccgtcaatatttcattagagtgcattgcctaatgtctgtttatgtaatttaacttttttgaaatagtctttttcctcacatattttgactaacttaatgacccacttaatttattatttcatgtataattgcaattattatgtagatatccgtttgtgttgatatctctgtttttttaaatggaaattaatagaagatataaaatacttttggatctttctgatattcaaaaaatatttttgagaaaaattatcttaaatagtaatatgatttggtacttgactcaattcaatttagcatttattgcttgctgtctcatacaactgttctaagaattcatgtcaaattatatcagttattcctgtgtccatttagcatatatttattgtcaagttcttggctaaagcaagaatccaagaagagaaatttcacagactagtaagagattatttgcaatttctgctttttaaatagtaatgtaattaatatactttccagaaaatttttccatcttctttgatgcataagtagactcttaaaatacacatataaaattatgtgaaagtacacataattctaagaaagcatagcagaagggctagagacccttatatttaactatctacattatatctagagggtatctaaaacttatacaaaccaaacagacatttgatccttgctccccagttccagcaacatcaaaacaaacacaatgaaaatcactgatttttgcctagatctcaccatttcagtaaatggcatcgtgatttttcacagtgactcaagccataaatctggacatgcttgattcgtaacctgtatctcctaaattcaactctatggtaaatattattcattctactttgaaaacatgttctaaaaccactcatttccctatacttcggatttacccaccaatccaaataactgtacatgttctcttggacagctacaaaacgtcctaattgtttcccctatttttccctccataaggtattctctagccagagtgatcttttaaaaatgtagatcaaatcacatcacattcttgcttaacacccttcagtggcttctaattgcacttggagtaaaatctacacttcttaccatgacctcattggctctctgtcttctctggtttcatctcacagcactttgccctcacactgagctccagtcatgcatgccttctgtctgttcctctgctccaagttcatgtcttcatctgggtctttgtattgctatttcatttccctgcctggaacattcttcctctgactcttttcatggctaactgtttctcctcattcatgttccagctcgaataccacctcttcagagaggccttctctgattccaagtagtgactcctcctccaaatactgtttgactctgtgtagttaatttacagccctgatcacaatctgaagttatattctctatttattgttcacttgatcattgaatatttacctcctcttgaatagaggctccttgaggacagtgaactcttttgtcttgctcactgttattacctgtactatgatgaagcctggtaaatagagcacacttagcaaatatgagtaaaacggatgaatgaataagggcatctcagtgaagatggggtgagaaagggttatgctagctggtgcttggatcctacctaaaagaaagaacagaagttaaccaggtagagaaaaagagggaaatgcattctagactgtatcggaaagggtgcaagaacaagtctcctttggagagttgcaggaatttgggatgattgcatgttggcattgctggtgataaacaggagcccagtgcaagaacatttatggacttttatgccttatcgagtaagaagtttagaggttgtcatgaaggtaggaaatcctaaaggatgttataaaagtgaataacataatcatgttgacaatgtaataagatcactctcctcacatgggaaggagtctggcattgggtgagtagggtatccttgtagggtatcctcctactggcagtgtgaggaggtgtccacatgtggagggcagccagggtagagtcaaggcactgtaaaggtgagaagggtatccatcaggggccaaccaggcatgaggaatcagagcatacacaaagtaaggagcagggtggatgtgtgtgtgccatgccctgagcaggaggtgtccatgtggagctttactggcatgcggtatcagagcccaagtgggatgaggccagtgtccacatttggagatgaccctaaatgagaatcaggacctgatataataacaaaatacactatgaataaaggaagctaggtttctgactgtcagagaatagaactacaaatataaaaatgaattatgtgttgtttagatcgaaatcacattacttctgtaaactcatggctttcaatatatgttgagatggatggacacagaaatatagatgttcctgtgcatgtgtatatttgtgtatacatacccagacccacgtgcatacgtatatgtacgtactatgcttatatacaaatattctctagccctgcccactgagagagtctgagaacagtgacatcccagtagcaattaatatacgtagtgcctaaatcttggcattaaactaccattttatactaagaggaagtaaagcttcttagagaaatagctgattccacatctaggactggaaaatcatatatgagataagcctagaaatcccgatgttccagaaagtaaggaatgctcaaagagtgatggagataagtcaaaaggacacaggaggactccctttggcaaaactctaaataattcaaatatcaaaaccaataataataataatggagtataactaactcaataaaataggaaacatgggtctctgcaagtataaacaaatacacaagtaaattgaacgttttgtgaggaatgggatattcacatagttttaaagtacctccccacaaatgtatacacatttcagaagagaaacaaacaaacaaacaaacaaacaaacgaagagaaagagtaaccttacaatggagaagtctgaaagaaaccaccttaatcaagtgaccaaggtgaacatcatttgaaaaatcattatcacaaatcaaaatcatgcaccagctgataggatgcaataagaaaaacagagtcatctctgggtttttctgacaaagatacataccctgaatctaattataaggaaatatcagacaatccaaattgaggaacattacacaaaatagctgacctgttatattcaaatttgtgattgcttttaaagtcaagaaaagactgaagaattattccagatcaaatgagattgaacaggaatgaaaactagaagaatgtatgattctaaactagatacttttaccataaaacatattattaggacaattggtgaagtttgaatggagtcttaaggttaaatggtagtaatatatcacaattcattatctgattttgatgtttgtgttctggttatagataaatatccttgtttgtaagaaataacatggggccgggcgcggtggctcacgcctgtaatcccagcactctgggaggccaaggcgggtggatcacgaggtcaggagattgagaccatcctggctaacacggtgaaaccctgtctctactaaaaaatacaaaaaattagccgggcgtggtggcaggcgcctgtggtcccagctactcgggcagctgaggcaggagaatgacgtgaacccgggaggcgaagcttgcagtgagccaagatcgtgtcactgcactccagcctgggcgacagagcaagactccgtctcaaaaaaaataaaaaataaaaataaaaaataacacaccagtgctaatgaggcattagaacagcaacttactcacaaatagttccaggaaaaaaaaaaaaagatctttagaaaaaaaagatctttgcattgtgtttccaacttctctgcaattttgtgattgtttcaaaatataaaataataatcattttaaaatccatgaagatcactctgtgataaatatagaagataaattagaagtagaagagatgacatcaaggaagccatgatgggagctatttcagtaatcaagtcaaaagaattaagacaggtacagtgggagtagaagagaaaagcttagaaagataggaaacagaagtgacatgctttggtggctaatttgatacagaaagagaagtagaggaggagtctaggtggtacagttaattgatataaggaaggaagagcagatttttggagaaagatgaagattttgatgtctggcaagtaagtgtagtgagtcttatcttccaaacactgtacgttacttgaccaaatgaaatacaagttattggcttattgttaggatgaacttctattctctggcttcatgtttccacaagaagggaataccattagagtaacatcctccacctattctccgactccttattaatttatcccctaaggaattagagttactgagctgtaaaacgacattggggaaggaactaagcatgcttattattgcctcttccatgtttctcctcttcagagacataataaatatgttctctgctcttctgtagtaaaatcaccttgtaggttggctagctgtgccagtgactgggttaggatgtgtgtctaatccaagagtgaagttacagcaagcatattcagtaacatatctagaatcacattgtccaatcagttctcatgatgataataaaaagtatggcatttggtttcaatttgtctaactcttggattccatacctcagttggttctgaatctgggagagaaagcaagcagtgtggttaatttgtttcctaaattcaaaacaattataaaactctgtttattcctcccagtgtctaatatagtgcttaatactcacttattgaattgagttcaattaatgtaaaataaaatgatgctaaaataatactgtcttaaaggcgaaaatataggtccttctaattatttgtttttccattttaggcatttagcaccattgatttaaaacttgttcttcaacatgacataatctaaagatacttatttttcctttcctcacagataaaacagaaatcataatggtcttatccatctcacgtggtttctcaaaggattaaagtagacagtgtgtagataccactctgtaacatcataaataaatggcatatttattgctgagtttgggtgttccctttctcaacagtgtgaatttgtgcaagatgagtggaaaatcaaaccagaatggaattgttagggtcagctataaagaggcctatgaaatgccctagatcatgtttttcaaattaagttttgtgcatcactagttgtgaaatatattaatgggtttacatgggtggtagcgaaagaaggctctgaaaaatcattcagtgaagaaattatttaaccctgtatttccccaatatatttgacaatggaaactttttatataagaacatcacttacagaatgagtaatccatagatattaggacattctgactaagaggaaggtggcagaatatctggttgggacttcctaattattagaatgccctaagtaaatcagcacagcacttaagtaaaaagattctaaatcccttgcttatcctattcttctccctggactatgtatctgcctgctacgatatggatatggcttagtttgtccccaccaaaattcagattgaaatttgattcccaatgtggccgtgttggcaggtggggcctagtagagggtatttgggtcaagaggacagatctctcatgaatggcttggttctgttctagcaatactgacagttccaagtctgccaagactggattaattctcatgggtatggagtaattcccataagaggtatttgttataaagccagacaccactggagttttgcctcttcacatgttttcactttccctttgaccttctgccatgttgtgatgtatcaccagcagctgggcagatgtcaacacgatgcttcttgtacttcccagcctgcagaagtgtgagttaaataagcctcttttcttagttcattttatgttccatataatggaactcccaacctcaggtgttccattatagcgacacaaagtgaactaagacttcacctatctaatgcctattcaaacataaaggtcactttgagcatttcctctctggaatagtcttcactgccctttccccaactattcttaattaattcaggtggtacttattgacagccagttgtgaaccaggtactgttctcagtgccgaaattgagcactttataaaacaaggaaggaaggagggaggaaaagagagggatggaaggaaggaaggtagaaagaaataaaggaaagaagttcttattctcatggcatatccattccaggtgggaagaaagacactgaacaaatcaacgcataatgttagttcgggagtgaaaattgttataaaggaaaatagcataacagagacagagaataaagtggtagctactttatattcaatggtcaaaaagggcatctctcataaggtagtatttgaataatgacctgaaggaaggatgataattagcagtgttaagtctctgggagaagggctttccagacaattcaatgataagtacaaagaacctaaggcaggagctgtttggctaatctaaggtactgttgggaagatgacatggctagtgtaaattaaacaacgtggagaacggtaggagatgggttaagaggttttagagagtcagattatattggatgtcatgcttctttactttcagtgagatgggaagacattggaaggttgagcaggtgaataacgtgatctgatttatatatgtggccaagttacaaaaggacaagagcacaataatcaatgccagtaacaagatatgaagctttttcaaaggtctaggccagagatgttagtggctcatacaatagtgacagatgacagatggtaagattcaagatatatttttaaagaaaagttagaggactgatttttgaactttttggtctcaagatcccttgatgcccttaaaaattaataacactgaagattttttgttcatgagagtcatatctgttaatatttatataaaaactaaaaataaaaattctttaagcataatacacaagtgcgcattccattagccatcagaggtatgatgatgtcatcacttaccatatagcttctggaaatctccatttagaactcatgtacaaataaaagcagaacaaggcaaaatgtctttgtattattatggaaatatttttgacctcacagacctttgaaaaggttttgaagcctgctaagaggtcctgaaccacacattgagaactgctggcctagaggatttttttgatggaatggatctgaggtgtgagagaaagaaagaaatcaaggatggggtcaagtttttaagcctgagctgctattaactgaaatgcaaactgcagtgctatataagttaagtttaagacatcccattgagatttagggtagcctgctggacatgagcctggagttcagggaagtgggcaggcctggagatacaaatttaggaataatcagcacataaacagcattgaaagctctggaactggatgagaacacatggggagtgaaagtagactgagaataggtctgaggatgatccttggggcattggatcaatgaactccatcagtgaaattccaaaagttctctatttagagcacagtctcctttggttggttaaaagttattttaggatagaatccatattttagtcattttcatactcaaatcaccgcttaagatgcccagcatatggtaggcactcaactgtgtttattgaataaataaataaattaattaatgatgtcctttgtggtactttcacagctaaattccagaattttagaacaggcaagattaggaagttggaatgatcaggttcagattcatacagtaggtatactattcattgtatagtcaaacagatttccttgaacttagaggaagatgtaattgactgcaccctgtgctgtcaataataagtgacctaaagggaaggatagactatatttcaaattctagtctgccatttaagatatttaaagcaataatgccaactctactttctgatcattttattttgcaaggaaattttttcccagaatattttttctttctatgcattcttttatttaattacacaataaatttaaccagctttacagaccaatacatatatatctacaaaggatgtatttcatttttgatgaacatactatggcttatttaacaagttatccttactaataggcattaaggtttccaataaatatttcaataatgaacatccttgaacatatttttatttatttattaccattttaataaccacatttattttcattattcttatagcacatctattcttagccactcatgtgatttgaaaatacttttatattaaatgtctatttaatcaatatttcctcatctttataatgattcatttgcatctcttccaaaacttcaagttaatgtctaaactcaattttcttttgtttctcttcttctatttttattttaggtgccaggggtacatgtgcatctatgctttctcattcaggctgtctagacatgctctaggggaaaaagctgagccaaacaatgacacccactgagaattttatgcatgtgggagaaaaacccctgaataacacaaaaggaaaacacaatattaatacagtcttgctattactggcaatgtgggcacaaagtataaaaaattacatttcatgtttaggaaaaaagatgaaaaaatttttttacttgtagaaagtgccaaataacaaaaattctccatattcctgtaggataaactcacctggaatttcatcaaatgaatagaaatgaggatgaataatattccactggcatataattggcatgaccactatatggattgaaggtgattttaatcatcaatggaagatacaatgtacagtggttgttttctggattccggcttttccctcccctgtattaggtcagcctgaccctgtactgtgccatttatcctcactgactcctcccatatcccaaattccaggagtttatacttcctgtggctcacttaagcagaggcatctaaagaatgagatgcttgaaggtgagtatcaccccatatgtagccaacatcttcttaagtaggttccaatgatttagggaactttaaaaggttcccaaatacattttctaaaatccacagttgccatgatcagagctacttggggatgacacagagagttagaacattacttctcagaggtcttatttcaattgtaggcaaacatgatctaatcaccattataataacaagttgggccactacagggctttacaatgtacacagcaccatggcaccttttatctggtttgagtctgactacacccctgagaagcaggcaaggcaaataccattctcactttgctgaaaaactgagggtgagaagggtaatacagagtgcatgtgacagaagaaaggttggaactaaattccttttaaagaggcacctacaagcaaaattttgcacataattccaggaattgtgtagaccacccatagcctatccaagaacaccaggttaaaaatatttgccctcagacagactgatttaattggtcaggggtggaactcaggtatttttttaaaaagcttcccaggaaattcatatttgtccaaaactacttcaaaaattcatatttgtcaacgttgactgttgggtcctgttgccttctttctcattttttttcctttccaaatcgctctttgttttacttaatattattttctattacgtctatctttctgtttttagccttctcttctcactcagcttttgttgcaagtctggaaattactgaatacagtcttctttggctctttccttcagactacatactactgccatctatgtttctgttcttcctcctttttcaaaactattattctctcctgaagcttcacccttctagaatatcagtattccacctcgattattttctacctaatgagctaattagcattaatggaaaaactactgaagttaggaaatcagagatcttccagtaagtcagtggcctcaggcccaatcagtaaaataaggaaaaatatacctacctgatagaatttttgtgagaaacaaatgaaacacatactcaatcatgggaataaaatactcaatactcaataataaaaatatttttaaagactatctccttgaagttctttttattccttatctattttttgctgcaacccaatacaatattctgtactctttccaagttatatgcctctgttttttacatacccactctcatttctaattttaaaatttagcatatgtattctataaccccacagtgcccagaaaaatgttattctggatttggcaagaattttttgtaaccccagttctaaactgttaataatggcagggagaggtgctatggcttattattaaactgctttattgttagctcattaatcatacacaggtccagaagaatattcaaaatgtttctttcaggttgagtaggtacctgatctaaacatggtccattatgagtaggtgttcagaaatgactcatctttcctccaatcatctcctttagtgtcttgagagctctgagcctttgacctttctccttattttctttacctctacagcctctttgcttctttttgctatggtccctccttagctgcaaaagaatgcagcctggtgttatttcattctattgaattccatttaggatgaggttttgggttagtggtgaggtttggatggtactaggaacatctaaagccaattggaatgtcttttccggctgctattaacaaataccaaaaagttatggggtctctcccagttctggaggttgagaagtccaagatcaggtttccaccttggttgggttctggtgaaggtcctctttcagattgcagattgccgagttcttgctgtgtcctcatgtgttgcaagggtgaacaagttcccatgggcctcttttataagtgaactaatcccattcatgagagctctgccatctgacctaatcctctcctaaaggccccactttttaatactattacattggggatttgaattcaacatagaaatttggggaaaacacaaatattcagatgatagtacagaatttcaaattttccagattgacttcttaggatattcttatgctcattatgctaaaaatctctgttcaatattgagcccatttagatgacttgtctgtggtattgtgccaaaatagcctctttttctgcccgtggtcacttctcaagagcccccttctattttagacttgatttctatcatgaaacagggaaaggagtgtaaaaacccatctagctaaaaccaccacccagagcacagaccaggaatccagtgctctgtcaactgctaatgttagtttgtttgaactttggaattaattagatgtatacacacctcctaacaaaatatttaacaattgagtccctatcattcatgtctcttcagtcaacttttaggctcttctttctcattctctgcaaccagaaactgtttccccacctctgctcatcctttaacatgctgtcatactgccttatttccttttaccatcaaactactaaaaagattagtctacaatcagggtatcttttcccactcttcaattcctttcatcttaagcttctacattcttcacctgaaggaaattgcattcttgaaggtctctgccctcataattgccaaataaagtgacattttggtctctcttctcctctatcttcctggaagttttgacaatgttgactaatcactttaaaattttttttctttatatccacagtaagagttgtctttcttcttttatttttctcaatgattctctctctcttttttgctaaagacttctttctaaagtacatgtgaggaaatcacttaagttcctggttctcaacttcctcacctataaaatgaaaatatccattccaaaaagaatcatgaacattaaattatattaggtactccaaaaatataattatcctcctttagtgtaaacatttatcagaattctgtctttggtactatctctcttcatcattgaattttacgaatgagaataaaatctttaccttaagccctcaactctctccagaaccccataccaatatttccaatttgtatatcatgcttcatgttcagtaaatctacaaaaccaaacttatcatgtcatcttctccctcatcaaaataaacatctgttcaattctttcctatccttattagtagcattccaaagtcccaatcaacaaggctcaaatcattagtcatctttggctcccttagacctaatccatctatctactgctaattctttatccaaagtgtctcttgcaccaaagactacataaaatgtataaaacattatagccaagtgttacttatattagcatccaaagtaaaacaatgtaatctgccatatcaacagaaccaagagtacacgcaataaactgatagcctacattgtagttaatgttgaaacactgtaacattgtctgctttccccaaagatagggaacaaggcaataattcttggttttaccacttcattgcatcattttactatagtcacagcaataagaaaaagaaataaaaggcacaaatattagaaaaaaaagtcaaactatcattattataagatgacataaaagaatcctatggaagttattttttaaaaaagcaaacaagtactctagcatttaaataaaattaaaatggtaatataaaactcaactgcatttctacatgccaacaacaaacaattaaaatatgaaagcaataaataatactaaattattaactcagtaaataacaatttttttccttgtagcaaaaattaaatcttgacccccacctcacaccatacacaaagcaatctgagatggattatcgacctaaatataaaaaccagaacgagaaaacttctagaaaaaagtgggagcatatatttacaacctgggacaagtcacaaaaacactaaccatagaagaataaaatgatacatctgacataaaaattaaaatattctgctcatcaaaaggcacttgagaaaatgtttaggcaaatcacagagtaggagaaaatatttagagtgcatacacctgagaaaggacccatatcttgtggggttacagaagaatttataaagaattactacaaataaacaatcacaaagctgaacacccctaaaaaaaagaggtgagcagatacttcacaaaagaagatctaagaattggcaataaccacagaaaaaggtagtcatgatcattagtcaccagaaaaaatgcaaattaaaaccataatgagaaatcatttcacacccagaagaatggctaaaataaaaaagtttaaaaggcgagaatgtggagaaatgaaaattctcacacattgctactggtgactataaaatggaacaacttttttggaaagctgttgggaagctttttataaagttagctattcatctaccctgtgatccaacaatgccattcttatttatctatatgaaaacatatgtttataaaaaacacttacatgtgtatattcatagcatattcactcataatggtaaacaatgggaaacaacgcaaggatcaatcaacaggagaattaatgaacaaattgtaatataccatagtatattaatccaatggtaaaccacttaccatgaaagaaacaacatggattaatttccaaaccattatgttgagtgaaagaaacccaaacagtgatacgcacacagaaaacatactcaccataggattccatttatataaagtccaagaatagccaatcctaatacatgatgataaaaatctgaacattcttgcctccaaggcaggaaggagggcaactaattagaaaggggcaagaggaaactttctggggtgatggcaatgttctatattttgttttgagtggtgttatacctatgtaaataattaaagttcatcaagctatatacttaagatctgtgtatttgattcttcaattgtgaaaaacaagatgtttcacgaggaactattttaaaaacaaagccaacacaagtaacatataactattcagtaaaaagaagataactagaatgtcaatagacctacctaatatatatttcaaagatttttttttcaagtatttaagtacaagtaagtagaaaaattcaggcttgtgggttaatatactggagagaaacaaagagaaaagagtaataaccatttcagtcactctgaatttgaaatagattgcttcacaatctagaggattttaagacgtgaaataactgaaagaaacaaaggtgaaaaagatcaaacacaggatgcagaactaacagctgtgacttagttaatgcatatgctgaataaaaacaaactcaacaaagcactgggaagccggcagcttccaagtaattaactaagcagaaacacatgcaatgtgttatcagccctatctcatattgaaagcaaggactccttcgttacaatggatgctctccatttacaggtagagttacaagaaaataaactacataaaggtatacaagaggcaaaggaaaaggaaccaatttgctacatctaagtagtatctattttcagtgaatgagataaaagttctgccgttacctcacctactcaatatcagtcttcccacaataaaagactgaacacatcagctaatggtcaaagaattgtaaattcatgaataagggtcacatttacatttttattttcaaagttcaacacaagttttaaaagtgaaattatcatttcaatcatattattaatttttaataaataaatttttagaacggtctttaatacccataaatcaatctaactccacactttctgcattttcagagagaaaaccagaattaacaaatatgttagagtattaaacctgtgattaaaatataggcttttatataagttcatcaataattatcttttctttggaacagtagctctcaaccattttccatccctgacacacctgtgatttgtcagaacacagcaggagtctcctgttctatccatccatccatcctctatgcacatcctctagtcttcaaatcctttcctgaaacctcatgtcctacctgaatactctctcataagtatttccatgtgaatatactactccctttctacaatgaatgaggagccccctgaaggtcataactcatatggagaaataagtcatgcaccaatgtctccagggtggaagaaagagtagcctaattgaagttatattctttctgcaattatatatagagaaagaaaatatatagatatatagctgttattgttctattacataaatacaggctgcattggttctaatttaaacaccatcatcctgagttacttaactttctcacttatttgtttttctccttaaagcattgttataacatttaagaaagatggagtcagttactaagataaacatttaagtaacgacagcaccaagaaattgggtcaagatggaatttctggctttaattctacctctagatttcttcaaagataaccaggtgaacctaaactcaattagaatatgcagagaaggatttatgaaataatgcctcagttattcagatcatggatctatagaaaagaatctgtttttcattcattgaatgaccaagtgcatttacattagagaatctacattggtataaaaacaaatatatttaataatgaattttattaacatatataggacaatgtcttacttaaatagctttaaaatgctggaaatgcactagaaacacattaaccccagaaacaccttcatatgagagaaccagtgtcaacgaaaatgacagatagcaactaaatctgggtttagtgaggtttatcttgaagcaaatagaccccatcaaatttccttgaaaaagaggacattttgtaatgagatgaaggtgtcactatgttacccagactggtctagaactcctgggctcaaggtgattctctgcctcagcctcccaagtagctaggattacaaccgtgtgccactgtgcctggcagaagacgacatttttgaaaacatttttcttctccacatattggggcactatgtcaaatgttacctgtgcctaaatgcccctgaacctgcatattccatactcctaaagatgtgtcaaattatacaacctcatgaggatatttttaacctctgagcaggactggaagaggcaaatatactaaagtaaaaaaaaagaaactccaaatcagttggacaatgtagcccctttggagtgccagtgatgttatctataaacactgaaacacaaattgcacttgaattgatgaaggatataggaaacaatttatattaaagtgttctacaaactgcagtggctatccaaaatttaagtgccattttatcaatgaggatgaagattataataaaaatgatctaaaataacttatgttaaacaaggaaaaatattaaacaaatcttgcttatttagacctaaatagtcttaaaagacacattttccctacaatttggctcaaaggatttattcatactctatatctaagtagatgatgaatggcattgattgaatccaaagtcctcctgtcttggattttatgaggcccattcagaacgagccaggttgagaacaccaccaatttcgtgttctgggtccatctgttggcaaaaatataatgcaaacagctttataagtgctattttcaatgaaatatcacagaacagcttgtcccaatgatatttctaaagcttgcctgcaaaccgcctactggaaaatccaactgaaagagaagggagaaaagagagaaatccatagaggaaagagacaggaatggaaaaaagaacaaaggataaagagagactagctagaggactgggaacactggaggaaaacaaggagcaatattaaacgcagacaatattcattgaaaccataagaatagagaagatagagaaatataaaaatcacttgggttggaagacagagaaataatcacaaaccatgcagcattgtccagaagaatgaagacaaaaggatcaggaaacaccagaaaatatgtaacagctcaataattggagcataattattaaaatgttgtgagagaaaaatgatgtaaaatagctatttttctaagtctcactgcttcatgtaacaggcacaattcatttttccaaaaactaatgcagatttcagtgtttatcaccaacttgaaaggaagcaaacatcctcttctgagtcccctcttttaatttagaaatccattgacataccacataaaacagtccaggcattgcaatataagtgatgtacatgcattgattcaaatcaaaacacattagagggaaaatgatgccattctgggcacttacctggggtcgaatgacttttacaatatttttgagggcagtatcaggggatggaggtgaacaatcaggtgttgggcctgttgagctgtttctatggttactagttcctggagtagtaactgctacctcagaggcattatctgtgaataaaaatagaactgccatgaacctaatcactcagtttaccttttaagacttgaaattaattttctgaacataaattgagatttcaacttttaaaactggtatcaattacaagatcataatgaggaatatgctcagtagtatattttaaagataatgctttttgaatgctttgtttccttctaaaatggtaactatcaccccctggaatgttgttctgagacaagtgtattattattcaattcataatgatagattatccagcatagctcttaagactgctactactatatgaataactaaaaccttaccttaactaaaaagaatataattttatgatatgattgggctaaagctttcccaataatctcttaaatgagtattaatatttattaaagtgggagttttatatctccctgatgcataaaatccaaattcaagcctcctcaaatgacttttcctagaaatcccacaaactatagaaaagcaccctagtgaatgaagcttgatgaaaaactgaaatttgtgcaaaatggttttatgatgtagataaacacaaaattatcactcctagataagtatagcaacctatgtggtcaaagctaaatgaataaaatttcagaatctaaattaatcttctcttatgttcagtatttaggaggggggaataaagaaaagatgacttgaaaatcaacaacatgtgtaacatttttttcttaaattcatattaaagcaaaataacatcaaggatgccattttagaatgtttaaaatacttgggaaaggatgaaaattattctataaataacttctggtagcacatagaaaagttattttaacaacaatttggcaaacttcaatagctttttatgaaaactgctgcaagctcaaatctgccaaaaaaataaaaaataaaaagtttacttctctgttgtttttaattagttcccaataattttctttcctagacagttagctgaactgattgcaaaagagactgagactgaattttttatagaccaggaagtttctctgttcctgatcgctgtctacaatccccagtgaaatacaggaattcatcaaggcatcttttcctcataaaacacaaagggatgaattatcataaaactctacctaccatataaaaatataactcagtctcactgaggaatccagacaaaggcccataaaacaaaaaattcaagtatgacacatagaattacttggatgactcataaaataagtcttaaaagtgtccagagcacactcttctaagatttaacagaaaaggtgggatttgaattggcatcacaaaagagatggggtggtcttctgagtagattagaaaaccatgagtcaatactgaaacacacaaaacattagtcagcaagatgctctgattctctccaacctatcccttccttctttcattcatctaaaaactacacatgtaagaacacttatttggggcaactatgagtcaaatattatgttatgttctaaagattaactaggaagaatctctggccaaggactggaggcaggtagggatgaataggttaagcactgaggattttcagggcagtaaaactattatatttaacagtataatggtgagtatacatcatcattatatatttgtccaactcatggaatgtataaatcgagaatgaacctgtataaactataaactttgggtgataatgatgtgtccatgtagtttcatcaattataacaaaggtatcattttggagcagaatgttgatagtagaggaggctttgtgtatgagaatatatgaactttgtaatttctgctcaattttgctgtgagtctaagaagttctaaaaataaaatctatgaattttttttcaaaagaatccctgccctcgagaagtatactgttgggttttttccttttcttttttgagacagggtctcactaccatcacccaggctggagtgcagtagcatgaacacagctcactacagcctcaacttcccaggctcaagtgatcctcccaccttagcatcctgagtatctgggactacaggtgcacattaccacatctggctaattttttgtatttttagtagaaatggggtttcgccatattgctcaggctagtcttgaactcctgagctgtagtgatccacccacctcaacctcctagagtgctaggattatagccatgagccactgcacccagcccaaaagtatactcttaaatgtgtcatcagacatgtaaacaaattacaatgcaatataacttgagaactgataacagataaaggaagcatgataaaaaaaaaacagggtggggtgggggagtaatcagactatggcttggacagaagatagctgtgaaaggcttcagttttcaggcaagaaagctggaacaaaacattagatattagggcatgaaggtaggaagagcacagttgaagctgttatttcatatacaaaaaaactggagataagtttgaatgagtgaaaggaagttttattagaatataaacatacttaattctgtaggcaatgagaaatattgaagactgagcagggagtgacataataatagataacttttattgagcatttattatgtgcagacaagccatgttaaattattttacttattgaatctcatttaatacccaaattaacttacaaaatacattccactatcaccatccctattttacagagaaactcatctcaaagttatattctcagttactggcagaaaaggattcaaatttcagactgatgccatgttacccttctgagagttagcatgtcatagcaggtatgcaaaagatatgcataggtatgattgggttcatagaaacatagcctgaagaagatcggcatagttgaggtaggagcacactctacttcaaaatatagttgaaccaacttccagaaacttaaaaagtagacatagacactatgaaaaataaataataaaaacaacaaaaaagtcaaccataaaaacatctttagggtatgcctttgagtactatatagtataatatttaatatttggaagctggaagatatgttaagactagagacccaagctagaggtcatgacgttagcattttggagttgataagtgattagattctggacatgtgttgaaatgtccagaactgttgaaatagaccaagaatttttttgatggctcctgaatagacaaagcaaccttgaacaaaaagaaaaaactgagcacattacactacctgacttcaaaatatactacaaagctataataatcaaaacaacttgatgctggcatagaaacagacacatcaaccaatggaaaagaacagaaatcccagaaataaatacacatatttttggttaatttatttcaaaggtgccaacaacacacaatggggaaagggcagcctcttcaataatggcattgggacactggatattcacatgcagaagaataaaattagaccttcatctcacactatatacaaaaactaactcaaaatggattaaagctgggtgcaatggtacatgtctgtacttccagctacttgagaaactgaggcaggaagtttgcttgaacccaggagtttaaggccagtctgggaaacatagggagaccactctctaaaaaaacattttcttaattaattaaagacttaagtgtaaaattgaagtggtaaaactattagaagaaaacacagagaaaaacctccacaacattgatttgggcaatgattttttggctatgacctcaaaagcacaggcaagagcaaaaatagacaaatgggattatgtcaaactaaaaagctctgcacagcaaaggaaccaatgaagagagtgaagaaacaatttatgaaataggagaaaatatttgtaaacagtacctctgataaggagttaacatccaaaatatatggaactcaaacaactcatagtgagaaaacaataacctgatttaaaaatgggcaaaggatctgaatggacatttctcaaaagaggacatacaaatggccgacaggtatatgaaaaaaatccctaacaacactaatcatcagagaaatgcaaatcagaactacaatgaaatatcatctcaccccagggaaaatggcttttataaaaaagacaggcaataacagatgctagcaagggtgtggagaaaggggaaccactgtacactgttaatgggaaggtaaattagtacagccattagagagaatagtatggagttcctcaaaaacaaaatatagaattaccacataatccagccatcccactgctgggtatatatccaaaggaaatgaatcattatgtagaagagatatctccactcccatgttattgtagcattattcagtagccaagacatggaattaacttgtgtccattaagagatgaatggataaatggaaagaaaatgtaatatatacatacagtggaatactatgctgccttaaaaaagaagggaattccgttatcagtatagatgaacctggaggaccttgtgttaagtgaaataagccaggcacagaaagacaaatgacacgtgatctcacttatatatgaaatctaaacaaagtcgaactcacagaagcagagaatagaatggtggttaccagggactggggagatgttggtcaaaggacacaaaatatcaattagaaggaataagttcaagaggtttatcatacaatatggtgactatagttaataacaatgtattgtattctttaaaagagtagatcttaagagttctcaccacaaaaaaaatgctaagtatgtgaggtaatacatatgctaatcagttcaatttagctattccacaatgtatacatgttttaaaacagcttgttgtacacaataagtatatataatttttgtctatttaaaaataattaaattttttaaaattattgatgtgctggatatagggagagaaagagagaaatcaagaatgactctaaggcttttggcctgaggaactaaaaggatagagctgccatcagcagaaaagggacagactataggaggagcataaattctctaccatataacttccaatattgccttcccattctctctctccctttggactctattgaagtaatgctagacagactttattcttttaaccatttattctctcttttcattctgtctctctgttgcatttttaatagtttcttctatttattttctagtttattggttctttcttcagctgtgtcaaggctgctatcaaaccattttcttaattttagtagacttttctgttctaaaatttctatttggttcttaatcaagtatatgatgtcagtagtttgtattttttagttcctaaaaacattttcaagcttacttttatattaaaatggcaaatacaattggctttggttttttaatctgataattccagcatctaaagtctttacggatccatttctggatttgtggttctgactcatgcaatcctgttccgctgttagtttcatcatcaattctgtgttgcttattattcaacctgttgttacaagatacacatttaaatataactaactcttagtcttttaataaatgttaatttttaaaagcatcgaaacttatatcctaataccagatgctgaagtctgtgaacaacttgcctgtgtaacactagatcatttatttaatctttctggatttcaagtttcttaactgtaaaaatgcaaatgattaactaccatcttctatcatttacgtgtgcagataaaagaaaagaaaaataacttgtatgtttttaggcacataataggggttttcagtatatgagtttccttttccattatcaaaagaaacaccatcagaattaaaataaaatatggaagatcaaagaaacccagagggaaaacaagaaaacaaatagttatcctttttagacaacacatctagagtacttgcgtgatatttgagagcagtatcttttagctattaacacaaattggtagggacagaatttagttccagaaatagcagatgatcctttgagacattgtactgttcaaagttatccagagaaataggaccaacaggatctatccatctatctatctatctatctatctatctatctatctatctatctatctatctatctagacaaagatttactgtaaggcattagctcatataattaatggagcctaagaagtccaaagatctgcagttggtaagctggaggtgcaggacagcctatgtgtagttccattgtaaatccaaaggcctgagaaccaaggaagttgatgctgtaaattctaatccaaaggttggcagactcgaagtcaagagccaacatttcagtccaagtctggaggcctggaaaaaaacagtgttccagctcaagaggtcaggcaggagaaattcccctttactcggcctttttgttcaattcaggtccgcaatttattgaataaggccaataacagtagggtggatgatttgctttactcagtctgccattcaaatattaatctcatccaaaaacaccttcacagatacatcccaaataatgtttagccaaatgtgtgggcatctcacggactagttaagttgaacttataaaattaaacacaacaggaatgattcattgcaagggctggtcttaactgcttttgcactaaagccagaagaaaatgctgggaactccctgcaaactgtaagccaacagcttcttgaatgttttttttctgagtattttaatacatagtataagacagtggataattaagtactaaattatttagaaaagactaagtatcttcatcttctgaatccatgagctataccattacactgataatttgattttgtactatcttgcattgttcattaactcttccagactaggttatatttttgcataaagtcatatttctctctatatagctcttagcttaatgcaatccttttaaagtaataaatgaagtaaagtagataaagcaaaacctgtgtcaatggaaaccaacacaaatgtatttaataatatgaagaaagctggtctggcttttataataattccatgatcctttcaaagaaaatccaaatgagaagcatattctagaagatatatgagtcttaagaagctggtttattcccaaaatatccttgataatataatttacaaaaaataccaattatccagtggacttggtaaaatagcagcctatgaccaagacagttttacatgctcaacctacatttcacatatgcagttacaaaatattgctgataaaaaggaaatgaggcacataaaactgcttagggaaaactgcaaaatatacttgcaatttcagattgaaataagaggactatcttcttgtcagattcccttactacatattaattattcattatgaatgtcagtttagtctataataacaacattagaaaaaatacttatagtttattttatcttttagaagaaaaatattctatgactataaaataattcatgtgcaacattacagtctagtattttaacatcaatacccagcatgtaacaaacagtttaagtataccagggaccatgatagatgcttttcagctgaagaataggactgagattacttctggctgggaattcaagaaagctgtcatggaagaggcaggagttatgaaggcctctgacagactagtaaaattcaggcatgaagaaatggctgggaagggcgttccatgagttggaagcaggttgagcaaaatgtagagagatgggaaagaggcacatttgtggaataaagaagagttcagtttgaataaaatataatattcatggaggaaatgctaagaaatggaggagtcatacacaaagactttgggctttgaaatcagaaaaccctaagctgaaattctggtatatttaacttcagtttcatcttctgtaaaacagtgcctttcacatagtgttacaaagacaaatgaggcatgtacagatacgtgtgtgtgtgtgtgtatgtgtatgtctgtgtgtgaatacattgcctgacacatagtaagtgctcaataaaattatctattactattattatcagatatatgaatataatcataatagcaaataaaactagataggtggcttgatgccttattatggaaaatcctaagtgcatcacttgcatcactaagtaatcatcaaatataagtatttaataaatcctaatctaacaattcatgaagcacaatttttacgttttggtattaagtcaagagttgacaaattttttctgtaaagggccagatggtaaatattgtaagctctgtaaggctacatgatctttgttgtaactactctactctctttgggtagcgagaaggcagccacaggaaatatataagcaaatgggtgtgtccgtattccaagaaaattttacttacaaaaacaagcagtagacaagattaagtttgttggtgataacttgtagatccctgtcttaagtacttcctatggaaatgttttcccttttatggacagacctagaagaatgttatattatacattttcatttccatattcatattatagatgaacattctcactgtgtaattaaaaactaaggttttcaatataaagctagaaatttgtcatttgtacaaaaaatggcattatatctaacaccagggcagtcctttgtacacagcaactgttcaatatatgctcattaaatagataaataaataagaccaatgaaatctttacattttaaagtaactttgttgtagtgattgtacatgactaccacttctgggagaaacagtacagaaatcataagtaaaaaagcccaagtatcctgtttcagtattttcagtgagaaagtactcactatgtaccacttgaggaagataatatttaacagtaatttaagagaattagttaataatccaaataattaacacattttactttctctagtgaaggtttgttaaaaagtaacaattctcttaaatataccgggtttgaacttccattactatcaccaacaatagtgttaaatattcaagtcttaattagccagcaactttaccagatgaaatgtgtggtagacagcctctaggatggtcccaattgagccccacctcatggtattcacacttttgtgaaattttgtcccctagggtgtgagttgaactcgttgaattgcttctaacaaagaagagatgaggccgggcacagtggctcacgcctgtaatcctagcactttgggaggccaaggtgggcggatcacaaggtcaggagatcgagaccatcctggctaacatggtgaaaccccgtctctactaaaaatacaaaaaattagccaggcgtggtggtgggtgcctgtagtcccagctactccggaggctgagccaggagaatggtgtgaacccgggaagcagagcttggagtgagccgagattgcaccactgcactccagcctgggtgacagagcgagagtccgtctcaaataaaaagaataaaaaagaaaaaaaaagaagagatgagttgtacttctgggaataggttataaaaaaagactgtggcttccgtcttgtgtgtgtcctccttctcagatctcttgcactgaggaaagcaagtaaccacattgtgaacaaccttatgcaaaggcctacgtggcatggtaaggagctgaggccctcatttcaacagcccaccagaaactgaaccttgttaacagccacgagttagcttggaagcaaatccttcagccccagtcaagccttgaaaagactgcagttctagccaacagcttgcttacagcctcccgggaaatcttgagtcagaggcatcccgctaagtccctcctagtttcctgaccctgtgagataattaatgtttgttattttcggccacaaatagcaatagataactaatatagtaaatgtttggttaacgtttataacatggccaacatgtttgtgctacaatggtgcttagactttcagccttgttttgaaggagctgactacttaatggaaaacatagaagggcaaatataattacaaaattgtgttacttatgctacaaattcagcaatatgggaacacagaagaatgagccactaaccaaatgagggggccagagcagaaagttaggttataggcagaaagagaaagtgaagaaaaaaaatgtaatagccttgaggaatgagtgccatcaagaactcaaagagggagaagcattccaggcaaagaaaacagaatatgcaacagggcagaagcatgaacgagcattatgcctttgggaagctataaatagttcagcttggctgaagcacaggatatgtgtggaaaagtgaatggagatgatgttggcaagataaagtattcagatgaaagatggaaaggtgtataaaaagaaaacaaaattgcctttgtaaaagattaaatttttctatttaggaaaaaaagtcagccacattgcatttctaaaattactttccttgaggctatgatcaaatgctactttcatctataaaaagaacagaccacaaggctatagtcactttaaaattctctgcatgcaagaggccacatctgtgtgctaaagagtagaatgattgactagcagcttcaagccaataagaactttggtcttatctacaccagagaagttctagcaaagagtcaaaaactcgaagagttagaggacatctaaaagtccaagatctcaattcaaacataaaaagcagtgcaatgaacagatggttgggagagtgtgctctctcccacctttcctttacttttgtttcctcctctttctcaacccatggcagggagatggtcttttagcataataattcaccagaggtatgctgtaattggtgagcaatattagtaggagaaatgtttccttgtcttataaattctctactctgaagaatctcaaggatttatgagaaatgcaggagtcttgtagaattttaccttcctcctcccaggatgatgccaagaatgacaattccctggccttggctagcaagactgaactagaatcctggagaactgcacagttaagaaaatgaaagagaaagggaggccatagaagatgggttccctcccaatgcttacttttatggactaaatgttaagcaatgaagaaagtaaaaaagaaagaaaatattttgcatcacatcagtaatccgtggattctctgttttactaatgcacttgtgcttcaattcttattttggctcttcaggctctcctggttttgagtcccattttaggttgtatgctttcccttttgtcttaacaacctattcttttctccggttgtactcttagtggtccctgtattcatcttctatatctttctattcattccaaaattatgtaaacacccaacctgaccaagacacaccctagcactagcccaccaggccagaacccctactaagtagccactgactctctatgaaaggaagttagaaaatgaacctgctgagagtaaagggggaaaaaggtggataggaggcaggactaacttgcagctgccactcagatggacagagcagcatgtggagacccacatcatgaacttttgctccaagaactaccataggaacataccaggaaagcagagaaaaccacagaccctttgaaggagtagattgccactgcaggctctgtgagtcagcttgctttctcagcagggaggtttgtagcctggggcaagttcttagtcctgctcataggctgcctggaaataaacggtgctgttggcagggcacagtgggaatgagactggccttttgggctgtgggctgtgtgggagttgggtgaggtctgtggctgctggctttccaccactttcctggtgacctgtgcgactcagcagaggcagccataatccccctgggatataactccattggcctgggaactgcaaccccacccccaacagtagccacagcaaaccccacccaaggagagtctgagctcagacacacctaaccctgtccccacttgatggttattgtctgctggccctggtagctgaagactaaggacataatctcttgggaactctatggccccacccacggcctgatccttcctatactactgcagctgatgtgctattgaaagcaccacctcctggcttgaggacaaccaaaacaaaaccagcgcacttaacaaaaatacaaccaaggaccctcagagagtccacttcactctcctgatacctccaccagagcaggtgctggtatggtatccacagctgagagacctgaagatgggtcaaatcacagaactctttgcagacactcccagtaccagcctggagcccagtagctccactgggaggctagattcagaagaaaaataacagtcacttcagctctcaggaagccccatccctaggggaaagggaagagcaccatatcaagagagcaccccattagacaaagaatcttaacagaagcccttgagtcctagatcttctctctgaaatagtctacccaaataagaaggaaccagaaaaaaacaattctggtaatatgacaaaacaaggttctttaacacctccaaaagaacatactggcttaccagcaatgggtcaagatcaacaggaaacctctgaattgccagaaaaagaattcagaaggtcgactactgagccaatcaaggaggcaccagaggaaggttaagtgcaacttaaagaaatcaaaaaagatgatacaggatatgaatggaaaaatctccagtgaaatagatagcataaaaaaaatcacaacttctggaaatgaaggacacacttagagaattacaaaatgcactgggaagtctcacaatagaatcaaacaagtagaagaaaaaaacttcagagcttgaaatcaaggctttcaaattaacccaatctgataaagacaaagaaaattttttttttaaaatgaacaaggcctccaagaaaatttgggattatattaaatgatcaaacctaaaactaattgatgttcccgagggagaatagaaatctaaaagtttggaaaacatatttgagggaataatagagaaaaactttcccagccttgctagagatctagacatccaaatacaaaaagctcaaaaaacacctgggaaattcatcacaaaaagatcatcgcctaggcacctgatagtcatcaggttatctaaagtcaagatgaagagctgtgaggcaaaagcatcagataacctataaaggaaaacttatcagattaacagcagatttctcagcagaaatcctacaagctagaagggattggggttctctttagcctccttaaataaaacaattatcagccaagaattttgtgtccagtgaaactaagctgcataaatgaaaaaaagatggtgtttttcagaaaaataaacgctgaatttgccactaccaagccatcactaaaagaatggctaaaaggagctctaaatttttttttaacctctaaatcttgaaacaaatcctcgaaatacaccaaaatagaatctccttaaagcacaaatctcacaggacctataaaacaacaacactatgaaaaaaaaaccaaggtattcaggcaacaaatagcatgataaacagaacagaacttcatgtcttaatattaacattgaatgtaaatggcctaaatgatccacttaaaagacacagaatggtagaatggatgagaattcactagccaagtatctgctgtcttcaagagagtcacccaacacataaggactcacataaacgtaaggtaaaggggtgaaaaaagatacttcatgcaaatagacaccaaaagcaagcaggagtagctgttcttatattagacaaaacaaactttaaagcagcagcagttaaaaaagacaaagaaggacatacataatgataaaatgactagtccaataggaaaacatcacaaacctaaatatacatgcacctaacactggaagtcccaaatttataaaacaatttctactagacctaagaaatgagatggacagcaacacaataatagtcggggacttcaatattccacagacagcagtcaggtcttcaagacagaaagtcaacaaagaactataccctagaacaaatggactaaacggatatttacagaacagatatttacagaatattctacccaacaactgcagaatatacattctactcatcagcacaggggacattctccaagatagaccatatgataggccataaaacaagtctcaacaaatttaagaaactcaaaatcatagcaagtactctctcagagcacagtggaataaaattggaactcaactccaaaagaaaccctgaaaaccatgcaaatacatagaaactgaataacctactcctgaatgattactgcataaacaatgaaatcaatatgaaaattaaaaaatttacactgaacaataatagtgacacaacctatcaaaacctctgggatacagcaaaggtggtgctaagagaaaagttcatagcatcaaatgtctacttcaaaacatctgagagcacaaatagacaatctaaagtcatatctcaagaagatagagagacaagaaccaaacccaaatctagaagaaaaaaagaaataaccaagatcggagcagaactaaatgaaattgaaaaaaaaaaaatacaaaagataaacagaaagctggttctttgaaaagataaataaaattgatagaccattagcgagactaactaagaaaagaagagagaagatccaaataagtgcaattagaaatgaaacaggagatattacaaccaatcccacagaaatacaaaagaccatttaaggttactatgaacacttttatgtgcataaactagaaaacctagaggagatggataaattcctggaaatatataaccctcctagattaaaccaggaagaaatagaaactctgaacagaccaacaacaagcagcaagattgaaatggtaattaaaaagttaccgagaaaaaaaggccaggaccagatagatacacagctaaattctctcagacattcaaagaagaattggtaccaatcctgttgatatctattccaaaagatatagaaaaagagaatcccccctaaattattctatgaagccagtatcaccataataccaaaaccaggaaaggacataacataaaaagaaaactacagaccaatatccctgattaacatagatacaaaaatcctaaacaaaatattacttaactgaatcctacagcatatcaaaaagataatccaccatgatcaactgggtttcatacaaggaatgcagggatggtttaacattcacaaatcaataaatgtgatacaccacataaacagaattaaaaacaaaaattacatgatcatctgaatagatgcagaaaaagcatttgatgaaatccagcatccctttatgattaaaaccctaagtaaaattagcataaaggtcattcgttaatgtaataaaagcatctatgacaaacccacagccgacattatactgaatggggaaaatttgaaagcattccccctgagaactggaacaagacaaggatgcccactttcaccacttctattaaacatagtactggaagtcctagccagagaaatcagataaaagaaagaaataaaggccatccaaatcaataaagaggaagttaaactgtcactgtttgctgatgacatgatcacatacctaggaaaccctaaaggcttatacaaaaagttcctagaactggtaaatgaattcagcaaagtttcaggatacaaaattaacatacacaaatcagtagccttgctatacaccaacagttttcaagctgagaatcaaatcaagaactcaaccccttttacaatagctacaaaaaaaaaaattaggaatatactcaaccaaagaggtgaaagcctgctacaaggaaaactacaaaacattgctgaaagaaatcatagattgacataaacaaatagaaacacatcccaatctcatgaatgagcagaatcaatattgtgaaaaatgaccatactgccaaaagcaatctacaaattaaatgcaattcccatcaaattaccaccatcattcttcacagaactagaaaaaacaatcctaaaattcatacggaccccaaaaagagcccacataaccaaaacaagactaagcaaaaagaacaaatccagaggcattacattactgaacttcaaactatactataaggccacagttgccaaaacagcatggtactggtataataacatatggaccaatggaactgaatagagaatccagaacccagaacccataaataaagccaaatgtttactgtcaaccagtctttgacaaagcaaacaaaaatataaagtgcataaaggacaccctatttaacaaatggtgctgggataattggcaagccacgtaaaagaatgaaactggatcctcatctctccccttaaacaaaaatcaactcaagatggattaaagacttaattctaagacctgaaaccataacaattctaggagataacattggaaaaacctttctagacattggcttaagcaaagacttcatgaccaagaacccaaaaacaaatgcaacaaaaacagagataaatagatgggacttaattaaactaaaaagcttctgcacagcaaaagaaataatcagcagagtaaacagacaacccacagagtgggagaaaatcttcacaatctacacatccaacaaaagctacaaggaactcaaacatatcagcaagaaaaaaacagtctcatcaaaaattgagttaaggacatgaatagacagttaccaaaagaagatatacaaatggccaacaaacatataaaaaaatgctcaacatcactaatgatcagggaaatgcaaatcaaaaccaaaatgagataccaccttactcctgcaagaatggccataataacaaaaaaaaaaaatggatgttaacatggatgtggtgaaaagggaacacttttacattgttgatgggaatgtaaactaataaaaccaccactgaaaacagtgtggagattcctcaaagaagtaaaagtagatctaccatttgatccaacaatcccactcctgggtacctacccagaggaaaataagtcattatacaaaaaaagatacttgcacacacatgtttatagcagcacaattcacaattgcaaaaatatagaaccagcccaaatgcccatcaatcaacgagtggataaagaaaatgtggtggatatatacatgtatatatatatatatatacacatacacacaccatggaatactacttagccataaaaaggaacaaaataatggcatttgcagcaacctggatagaactggtgaccattattctaagggaagtaactcaggaatggaaaaccaaacatatgttctcactcataagtgggagctatgctatgaggatgcaaaggcataagaatgatacaatggactttggagactcaggggaaagagtggaagggcagtgagggataaaagtctacacattgggtacagtgtacactgttcaggtgatgagtacaccaaaatctcagaaatcaccactaaagaacttattcatgtaaccaaatacgaactgtttcctaaaaacctattaaaattaaaaaaaaagaagaagaaaatgaacttgctaaatccctgaataaaatatcacagtagttggaggtgaaatgacattcattcttccacatgacagtgtaaattccagtagtattccttcacactcatttaaaaatgagtctaatctcatcagatgatgctatagtccatacttcctcatagctataatttatgaacttctttttactctcttttatttatcagagaattagcatgtatctcccaatcttgctttccacctcaagcctatcatcattttgggaactgtcagtttcctcgtacattttcaatcaatctcttgagcctgagtgttttgatttctacttacgtaatctttgctttaattctattcagattaccatgtctaaggctaacccatgtatttcattatgaacagcaactacttcatatagatatttaatctctagtaactcattctgtggatacaatgtccaatcacttcctctctcttccacactacatctattgtttaatcccatctctatccttttatccatctagtttcatccaacctatcagtccctttccatcttcacatttacttatttagtttagacacaatggcccatcacttaacaactctcttgccagtaactacattcactcttgttattttaccacatacactgagcaaaaccctattcctatttgcagttgacactttaatgtaccacccagattcaacttcagatataaaacatttattctcctagctgtatgatgtgttgctggcagacagtcttcagctgtcagctttcttttggaattgcctcaactgaagagaatggactgacccaaggccatgcccccttccaggtgcaagctgctttcaatgtcaggtcaacacaagtgtataatagtcctgtcctatcgccaacttggaatgactttgaagagtcatcccagtttcagaattccctagggagcctttggatggctatattgagacttcatcacagcctgatctctccagctgccatttctggcttccctttaacaggtgttgcctccgaaatcactcaataaatctcctgtatgctaacctacatctcaaagtcagctttctggtgaatccatcttggattgaactcagttgttctcagtggccccttctgcatctttttaaccaattaggtactaatgactgagacagaaaaatcatacaactgctagaaattaatgttatcaaatgatttgatattctctgatatggtttgtatacttgtctcctccaaatctcatgttgaaatgtgttccccactgttggagatgggcatactgggaggtgtttgcattatgggaatggatccctcatgaatggcctggtgccctccctgtggaggtcatgagttaccatgagatctggctgttaaaaagagtctaggatctacctcttctctcttgctcactctctcatcatgtgatatgccttctccccctttaccttccaccatgagtaaaggttcctgaggcctcattgtaagctgagcagatgttcatgccatgcttgaacatcctgcagaactgcaagccaaacaaacctcctttctttataaattactcagtctcaggtattcctttacagcaatacaaaatggaataacacatgctttcacaaataattcacacggtgaaaaaaataccctaatagaaaactggactaaaaactaccaacaggcacttcacaaaagaaaagtacaaataaatgtataagccttttgcctcagcttctgctcaagcctttgtataggaatgcatggatggaatacagtcttctggttttgttttgattaatatgtgaagacaagatattcacaagcttaaacattcaaatgcggcagccaagatggccgaataggaacagatccggtctacagctcccagcatgagtgacgcagaagacgggtgatttctgcatttccatctgaggtaccgggttcatctcactagggagtgccagacagtgggtgcaggacagtgggtgcagcacaccgtgcgcgagccgaagcagggcgaggcattgcctcacttgggaagtgcaagggggcagggagttccctttcctagtcaaagaaaggggtgacagatggcacctggaaaatcaggtcactcccaccctaatactgcgcttttccgacaggcttaaaaaacggtgcaccaggagattatatcctgtgcatggctcggagggtcctacgcccacggagtctcactgattgctagcacagcagtctgagatcaaactgcaaggtggcagcgaggcttggggaggggcgcccgccattgcccaggcttgcttaggtaaacaaagcagctgggaagctcgaactgggtggagcccaccacagctcaaggaggcctgcctgcctctgtaggctccacctctgggggcagggcacagacgacaaaaagacagcagtaacctctgcagacttaaatgtccctgtctgacagctttgaagagagcagtggttctcccagcacgcagctgcagatctgagaagggacagactgcctccccaagtgggtccctgacccctgacccccaagcagcctaattgggaggcaccccccagtaggggcagactgatacctcacatggccgggtactcctctgagacaaaacttccagaggaacgatcagacagcagcattcgcggttgatgaaaatccactgttctgcagtcactgctgctgatacccaggcaaacagggtctggagtggacctctagcaaactccaacagacctgcagctgagggtcctgtctgttagagggaaaactaacaaacagaaaggacatccacaccaaaaacccatctgtacatcaccatcatcaaaaaccaaaagtagataaaactacaaagatggggaaaaaacagagcagaaaaactggaaaccctaaaaagcagagcacctctcctcctccaaaggaatgcagttcctcaccagcaacagaacaaagctggacggagaatgactttgacgagttgagagaagaaggcttcagacgatcaaactactccaagctacaggaggaaattcaaagcaaaggcaaagaagttaaaaactttgaaaaaaatttagatgaatgtataactagaataaccaatacagagaagtgcttaaaggagttgatggagctgaaagccaaggctcgagaactacgtgaagaatgcagaagcctcaggagccgatgcgatcaactggaacaaagggtatcagtgatggaagatgaaatgaatgaaatgaagccagaagggaagtttagagaaaaaagaataaaaataaatgaacaaagcctccaagaaatatgggactatgtgaaaagaccaaatctacgtctgattggtgtacctgaaagtgacggggagaatggaaccaagttggaaaacactatgcaggatattatgtaggagaacttccccaatctagcaaggcaggccaacattcagattcaggaaatacagagaacaccacaaagatactcctcgagaagagcaactccaagacacataattgtcagattcaccaaagttgaaatgaaggaaaaagtgttaagggcagccagagagaaaggtcgggttacccacaaagggaagcccatcagactaacagctgaactctctgcagaaactctacaagccagaagagagtgggggccaatattcaacattcttaaagaaaagaattttcaacccagaatttcatatccagccaaactaagcttcataagtgaaggagaaataacataccttacagacaagcaaatgctgagagattttgtcaccaccaggcctgccctaaaagagctcctgaaggaagcactaaacatggaaaggaacaaccagtaccagccactgcaaaatcacgccaaattgtaaagaccatcgaggctaggaagaaactgcatcaactaacgagcaaaataaccagctaacatcataatgacaggatcaaattcaaacataacagtattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggaaggggttgcaatcctagtctctgataaaacagactttaaaccaacaaagatcaaaagagacaaagcaggccattatataatggtaaagggatcaattcaacaagaagagctaactatcctaaatatatatgcacccaatacaggagcacccagattcataaagcaagtcctaagtgacctacaaagagacttagactcccacacaataataatgggagactataacaccccactgtcaacattagacagatcaacgagacagaaagttaacaagaatacccaggaattgaacccagctctgcaccaagcagacctaatagacatctacagaactctccaccccaaatcaatatacatttttttcagcatcagaccacacctattccaaaattgaccacatagttggaagtaaagctctcctcagcaaatgtaaaaaaacagaaattataacaaactgtctctcagaccacagtgcaatcaaactagaactcaggattaagaaactcactcaaaaccactcaactacatggaaactgaacaaactgctcctgaatgactactgggtacataacgaaatgaagacagaaataaagaaggtctttgaaaccaacgaaaacaaagacacaacataccagaatctctgggacacattcaaagcagtgtgtagagggaaatttatagcactaaatgctcacgagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaataaatccaggagctggttttttgaaaggatcaacaaaattgatagaccgctagcaagactaataaagaagaaaagagagaagaatcaaatagatgcaataaaaaatgataaaggggatatcaccaccgatcccacagaaatacaaactaacatcagagaatactacaaacacctctatgcaaataaactagaaaatctagaagaaatggataaattccttgacacatacaccctcccaagactaaaccaggaagaagttgaatctatgaatagaccaataacaggagctgaaattgtggcaataatcaatagcttaccaaccaaaaagagtccaggaccagatggattcacagtcgaattctaccagaggtacaaggaggaactggtaccattccttctgaaactattccaatcaatagaaaaagagggaatccttcctaactcattttatgaggccagaatcatcctgataccaaagcctggcagagacacaaccaaaaaagagaattttagaccaatatccttgatgaacactgatgcaaaaatcctcaattaaatattggcaaacctaatccagcagcacatcaaaaatcttatccaccatgatcaagtgggcttcatccctgggatgcaaggctggttcaatatacacaaatcaataaatgtaatccagcatataaacagaaccaaagacaaaaaccaggtgattatctcaatagatgcagaaaaggcctttgacaaaattcaacaatgcttcattctaaaaactctcaataaattaggtattgatgggttgtatcgcaaaataataagagctaactatgacaaacccacagccaataccatactgaatgggcaaaaactggaagcattcccttgaaaactggcacaagacagggatgccctttctcaccactcctattcaacatagtgttggaagttctggccagggcaattaggcaggagaaggaaataaagggtattcgattaggaaaagaggaagtcaaattgtccctgttcgcagatgacatgattgtatatctagaaaaccccactgtctcagcccaaaatctccttaagctgataagcaacttcagcaaagtctcaggaaacaaaatcaatgtacaaaaatcacaagcattcttatacaccaataacagacaaacagagagccaaatcatgagtgaactcccattcacaattgcttcaaagagaataaaatacctaggaatccaacttataagggacatgaaggacctcttcaaggagaactacaaaccactgctcaatgaaataaaagaggatacaaagaaatggaagaacattccatgctcatgggtaggaagaatcaatatcgtgaaaatggcatactgcccaaggtaatttatagattcaatgccatccccatcaagctaccaatgactttcttcacataattggaaaaaactactttaaagttcatatggaagcaaaaaagagcccacatcgccaagtcaatcctaagccaaaagaacaaagctggaggcatcacggtacctgacttcaaactacactacaaggctacagtaaccaaaacagcatggtactggtaccaaaacagagatatagatcaatggaacagaacagagccctcagaaataatgctgcatatctacaactatctgatctttgacaaacctgagaaaaacaagcaatggggaaaggattccctatttaataaatggtgctgggaaaactggctagccatatgtagaaagctgaaactggatctcttccttacaccttatacaaaaattaattcaagatggattaaagacttaaacattaaacctaaaaccataaaaaccctagaagaaaatctaggcattaccattcaggacataggcatgggcaaggacttcatgtctaaaacagcaaaagcaatggcaacgaaagccaaaattgacaaatgggatctaattaaactaaagagcttctgcacagcaaaagaaactaccatcagagtgaacaggcaacctaaaaaatggaagaaaattttcgcaacctactcgtctgacaaagggctaatatccagaatctacaatgaactcaaacaaatttacaagaacaaaacaaacaaccccatcaaaaagtgggcaaaggatatgaacagacacttctcaaaagaacacatttatgcagccaaaaaacacatgaaaaaatgctcatcatcactggccatcaaagaaatgcaaatcaaaaccacaatgagataccatctcacaccagttagaatggcaatcattaaaaagtcaggaaacaacaggtgctggagaggatgtggagaaataggaacacttttacactgttggtgggactgcaaactagttcaaccattgtggaagtcagtgtggcgattcctcagggatctagaactagaaataccatttgacccagccatcccattactgggtatatacccacaggactataaatcatgctgctataaagacacatgcacacgtatgtttattgcagcactattcacaatagcaaagacttggaaccaacccaaatgtccaacaatgacagactggattaagaaaatgtggcacatatacaccatggaatactatgcagacataaaaaaggatgagttcatgtcctttgtagggacatggatgaaattggaaatcatcattctcagtaaactatcgcaaggacaaaaaaccaaacaccacatgttctcactcataggtgggaactgaacaatgagaacacatggacacaggaaggggaacatcacactctggggactgttgtggggtggggggaggggggagggatagcattgggagatatacctaatgccaaatgacgagttggtgggtgcagcacaccagcatggcacatgtatacatatgtaactaatctgcacattgtgcacacgtaccctaaaacttaaagtataataataataaaatttaaaaaaaaattcaaatgtttcctcttttacctcattatgatttctttcaaggcagacacaatgtgtctaatttgtctttatatcaccattacacattacagtagaattcactttattaggagtcaggactcaatttttgaacagtcagagtattacggacaaaacaatatttcatgtatttttaaacaaagtatttcacatcatttacttaatatctatatttgttaaatactgatgagaacaaaatttcaagtatctagaatttagcaaagaagttaaatgtccaactaaaataagtttaaatttaaatgattaaattgtttgttgtatttcagattctatccattttactttaatagaaaaatatcattcataaaaaagtttggctggccacagtgactgacaccaaaaatcaaagcattttgggagactgaggtaggaggattgcttgaggccaggagttccagacaagcctgggcaacataggagacccccgtatcttcaaaaataaacaaattagtgggatttggtggtacaggcctacagtcccaacttctcaggagactgaggcaggagaatcacttgagctcaggagttttaggcggccgtgagttatgattatcccactgcactccagcctaggtaacagagactctgtctctaataataataataataataataataaagttttcatgaaaaaaagaaatattaataaaatttcctaaattggagacatgcactcattatccacatatatcaacattggtcttattttcattatggtatactgtatgagctatggaaattattaagtatcaagcattaaattacctgccaattcttgttcattatacaatcactggtctcagaagaacataatcattacaaagacaacttcaaaagtaggagtgactatctttaatgctttaatgacattgtagagcatcacatcatgatttgttatggagtttagttttcctcttaattactatcacacttcaatctaaatgaatttagatttcatgtaacattttgactttttggaaggtcatggtttcttcattagtaggcaaaactcctacttaggaaagctatcaattcctcaattctcctattatttttatacatgtggttatagtttaatagattacttcttttatatgcccactgcagcatgtgaattttatgctaacaagagtgtgcacttaggcacacatgcaatatagctatgatatgtctatcatataaattaaatatgtgccaagtatttcatggagctaatacattttactcaaaatgtcagtaaattctagaaaaactggatggaaattgccaattataaaatgagagttttgattgaagtccacattagccaggaacccatactttggttacctgatattttggcataaatgtgaccacatattcatcttactatattattaccatatgaacatatatttcctttgaaatgctatcatgttcttcaagttatatgaatactaatgataagagatcttacatgttataaaaggaatacattgtatggaattacaatttatttagacatactttgggaaaagtttgattgcatttcatatgcgttcataaatcaaattgaactgtttcaggattttcaggaagcaaaatgacaaccaaaagtataatttaatcctaaagcatctttcctctttttttcttaatactcacagctaaacttaactgaaagtaaagttttcattctaagctttccaggttcattaaattgttcctatatcctcacaaaatcatgatttttgtttaaaatttaaggacatttttgttgttgttaacaaaatattgcttaaatacttgttatacatcatatatatttatgagtccaaaagtacctagttattataactttggaagcccagagtcctgtttaaaaaaaaaattagatgtcacaaaaggcctctgagctcttgatgaatgtgttataagttttgtgtacatcttaagggacctctttcacaagcaaccagaagtccttttgtaattacttatgctcaacatctatttctaatttgcagagctatgatgaggaacatccccagttcacacaccacttggcaactctgaactcactgatcaatgtgtcagtagacaggtttgtaatgagtagacataaaacaacatatcacatatgcgtgcacacacacacacacacacacatacacacgctctttaaagtgctttgaagtgtttactctttggtctgctactcatggaccaaatattattaaaaaatatgttgctgctactcttccaaatatacttaaaactctgacatgtaatgcaggttttcctataatctgtgaaatccctgctgcctttcaaaaaaatcattctaataaaaacagagataaatttacccagaagagtaaactagcatgaaatgccctgtttttgctgttgtcacaattcattgttaagttatttagtggtcccttattaaatgcccttagaattcgtagtgcaaaacgtttttacatagaatgggagtcctatatgacatattttaatttttacatggaatgacattcctatataacaaattttaatcctgttaatttaactaattacataaacctaaccaccacagtaaattatagtctgacctaaaagaaaatatggcatgagctgagacaaaatgtatccagttctcagaacatatctatgtctcctctaatttgtaggtcttttttcctttgtatgacactccacttaaatatcctgccggacctagctcaaatgctattttttctgcagcgtcttctctggctcggtcagtcagtaactgatgtttcttccatcatttcttcatataagatcaggctcattacattataattatttaggtatccctctgtctccctacagagcgtgagctccttgaaggcaagaacctttttacattttctttacactctcagacctaagtatagtactggatgttaaattaataaatacatgcaagatactatatcaactaaattagatatttcaaaatagttttgttgttgtaacaaaaattggatgttttgtagatgtttataattctgttttcattttaactaatacatagagttccactttattaaaacatatcctttgattaccttatagctagacacagaaggaggaaaataggagggtaaaggattttaaaagcatttggggatttttaaaaaaggcttccagagactaataaatcactgaacagtagtaacaatgctgtcatcaccaatctctatacaccgagtttcatgcagcatttaagaaagcctatgagttaaactgcgcttaaaataagatatatatttgcttttaaccatgtcaaattgtgcatgaaaagaaagtccttgaaggcactataccaaatgttataaagctcacctctggctggagagattatggattaattttttaaaatatttttcctatttccctaatattcttctaagagcatgtcttactttgatttacttatatttgtttcaaatattggctattattttttaaagcattacagatacttttaaaatctcttttatatcctgtcacaaacctatttccatgttgccttcatgagttaatcaccatcctgaagttggtatgtattatccgtctgtgcctttatacttttactatttatgtatatagtcattagacatattaattatgtcacagacatattgtgttttaaatttacattaatatcatatgacaattctgactcctttttttcatttaacactttcaatatagatccacatggatgtttataatcctactgttttattttaactaatacatagtgttccattttattaaaatttatcttttgattattttatgaatagacattttgttttttcgtaatttttcattcttacaaacaatattgcagtgaatatccgtgagagacttaaagttttcttttcaagagccatacctagtagtacaattaattgatagatagaagagtatgtgcatttcaaacttttaaaaatattgatgaattgtcatccaatgtggagtaccaatttatagtcctatgagaattcctgtttttctatatcctttacaatacttgatattgtcagaactcttgttttctgtctttctagtagatggaaatacaactggcacctcattggggccttaatttaaatgtccctgttacctgtgttaactatgtttattggttattcaaaattcattttcagggaattgtctttgccaattgtttccattctttgtttgctttttgttgttgtcttttccttactttgtagtgcttataccttctcagtatgtgcattataaacatctttcccagtttgtggcattttaaaagtattttgtgacatgtcatgctaagcatgagctttaatgtaatcaatcctaccaatcttcttaatgatgtgtactttttgtcttgtgtaagaaatccttccctaaactaagatgtccatgtggattactttttttaatttgttaaattgaggaattatattgaaagatttttggtggctgaaatatccttagaagagtgagttaagttctacttagtatgatctacgttttaatgcattattgaattcaatgtggtaatattttgcttagacttagtacatctgttttcacgcagagattaatccatatatactgttcttgtactctccttgtccattttcgtatgtaagtcatgaaagtacaaagttgggtagtttacttctttgtacactctcttcaacagtttgtatagcattggtattatctgttcattaaggtttgataaaactatcttatcaaaccattttgcaattctattctgttaaaatttactgagttatgactagtaattagtacttttcccagaaaattgtacattttatgtcttaaaatataaagaagaaattaataaaatcaagtatatcagtggttacattaaatataagtagaattatccccaataaaaaccaaacatggggctaaaaagttagacacatttttttaaaaaagttctatcctgctcattagaaatacacctaaaataaaataaagctggaaataaatagaaaagaagtgaaaagcaaaggcaaacaaaataacagaaatgaaaatattaaaatatataaggtcatattttagaattaaaattgttaatagaaataaagggaatactatataatgacaaacatgaagaaatttataaagcaattgtggtatcattctaggagtaaaatcctggaaactattttatctgaaacagaaaccagactcaaatgccttccattgccatttgttcaacattgtcttgaaggttctactaaatatatcaaagtgggaaattaaataattactataaatattggggaaaagagtgaaaatatttatttttgttgattacatgattatatatccaaaagcctctataaaactcaaaagccggctgggtggggtggctcatgcctgtaatccaagcacactggtaggccgaggtgggcagataattttaggtcaggagtttgagatcagcctggccaacatggtgaaatgccatctgtactaaaaatacaaaaaaaaaaaattagctaggcatggtggcacacacctgtaatcccagctacttgggaggctgaggcaggagaatcacttgaacccaggaaacagaggtttgcagtgagccgagatcacaccactgcactccagcctgggtgacagagtcagactctgtttcaaaaaaaaaagaaaaaaaaaaaacctcaaaagcttaagttttaaagtaaaatatattaaaattaaaataattttgtaaggtagctgaatacaactaatatattaaaaattcaatacttattgtgcattctaacaataaacacctataaatggaaatgggaaaaaaaattctttcaacagagtgataaaaactatcaaatagaaactactaagaaattcatagaaattgtatcatttaaaaaactatatattttattaaatgtcatgtaaaatctgaataaatctaggacaatataaaatattaaaagggcaattccccaaaagtaatataaacataaaattaaattccatttttttataattccatttttttggatgtagttcttttgaaattggatgaaattatcttaaaactcatatggtaaaataaatgaccaaaataacaaagaaagtatgaaaaataatagttaaaaaaagaatgcctgtccaaatagcagaaaagattatacagctactgtaattacattaatcagtcatataaaaaatgaagagcaataaaaatatgtccaaatatatagaattttataaataacaaagagtgtatgtgagtaggaaaaggaaagcttgtttaattaataatcataacacaaatgaaagaaagtaaatttaaacccctattgtaacacagtattaaaaaatccagatggattacagaattgattttaaacaataaaacaataataatcttaaaataaattataggagttcattagtatagcctgggataagggagaattcttaatcaagacaagaaacctagaagaaagaaagaaaaagattgatatatttcattacataaaaattgaaggccaggtgcggcagttcacgcctgtaatcccagcactttgagaggctgaggcaagcggattacttgaggtcaggagttcaaggccaccctggccaacatggtgaaatcccatctctactaaaaatagaaaaattagctacacatggtggcacacgcttgtaatcccagctacttgggaggctaaggcgggagaattgcttgaacctgggaggtgcaggttgcagtgagcagagattgccactgcactccagcctggacaacagagagagactctgtctcaaaaataaaataataaaataaaaattgaaaagatatcacaattaatcatcagaaaaatgacaaattgagaaagaatagttgtactacatataacagattaagggttaataactgtgatctataaagtgataaaatagtataaaattgggcaatttatatgaatagcaattcagagaaaagcaaatctaaattatcaacaactatttgaaaaggagcttgaactaatagtagctgaggaagtactaattcaaataaaaatgtgatatctattttgcactatcttcactggaagaattaaaatgtagaagaataaagattatattagctatctatttctgtgtaacaaattaccccaaaacttaaaaccgcaaatgtttattatcttgcagttttcatggctgagggtctaggtatggctctgctgactcagggtctcgaaggctgcaattaacgtgtcaattgggcctatggtctcatctgaggcttgactgggagaaattgacttcaaagaccactcacatggttgttggcagcattcagctcccacaggactgttgggttgagggcctcagtttcccactggctgttaatccaaggcctccctcagttccttgtcccatgggcctctccacggaacacaaagtgctccatcaaaatgagtgaaccagacagcaggagagagctaataaaacagaagccagaggtctttgtaacctgatctcagaagtgacatgcattattctttccatattctattcattagaagcaaattactcagtccagtctatacataaagggaagagattaaacaaaggcataaataccaggaaagcggatcactggcagttatcttagaggcttcatatggcagttgtggagaaaaagactgcaggctaacattgttggtggcaatggaaactgatacagctgttttggaaagcaatggcattaagatcagtccctccgcatctcattcagaggtcactttggtttgctaggttatttcccgattttacaactgcaagcccacatcctggaaatcccttcagtcctaggcaaaccagcttggtttgtcagcctactctagagccagactgtctgggtttaaatcatggctccatacttaactagcaatgccaccttgagtaagttacttaatttctctatgtctcagcttccttatttgtaaaataagcatgataatatcatgtttgtgggaaactgagacagtacctgtaaagtgcttaaagcaatgtctggcacattaaaaattctcaatgatatccattgttactatcatagatattaaaatatatgtatcctttcactaaggtatacaaacatttatcatccaaactgggaaacttttgagagtgaaaaggagtgctagtaataattatgccaggtcataaacaggaatattccagggagacttggatgtatgattaacttacatttgacccacagggaaatttctctcatagaaataaaggcacctcagtataagggaagtacacagtgatgtttgttgcagttttgtacttagtggaaaataaaaaagtaattcaaaattaagtgaatgctcaccagtagacaaagaataaatcacaatacataatgtttttaaatattatgcaacacttaaaacaatgaaatacagtgacaccaactgacttgaagaagttctttgaaatatctttgagtaaggaaagtaatatgcacaaaagtacaaatagttccatttgtaaaacaaaaggtttacactcagaggcaaatattgcagcttaagcttcagggtccagctctttcataggcccctcccaagatgttgagaggggtctagaaatgtttcctcatggttacatgtttttgtaaattatgcaaaagtaaaatattttaattgcaataggttaatacctctgtttctttcacctttaatttccctatcatatttctctgtattttgggtagtatttgaatggctgcagacatttttggaatccagctaaaggaaagatgaatcttgggcacatttagtttgggtttagtaatatatatttatgaattctgaagtcactcccatgtacatacagttcagatgtaagaatggcttctaggaatacccctaccacctcctgtgccaactcatcgggtatgcaacagaaagttttaaagccatattttgatatgggtgtgacctatgatgttcggtaccagaaatatttgtgtagtgagtgagaaagatttgaaatgtacagaactagccagtggaaaattcttccaaatcttcaagcttggaagtgaaagaaggattttatcaaagttgacaacaatccccaaaatcagcgtgacagtaccaataaccgattgtgaagctgaaataaactttctaacaaacaatgataaaacattaattttgatcaatcatgctagaggaaagaccgaattacccttttattttctctatcagagcattcttcaacagaaatagcgtgagccacatatgtaactttaaattttctaatacccatattaaaactttttaaataggtaaaatttaatgtttatttgacccaatttacttaaaatattagtatttcaaaacaaaaattactaataaaatattttacattctttttgtgtactatgtcttcataatcagatgtgcaatttatacttttagcacatgtcaattcagacagtaaactttaattgaaaatacacaatctatatttagactttgtagaattacagttgaaaaagtggattcatataaccaagtttttctaaacataaagttttcaaataactgaattgaacaccaaaaatcattttcctttaatatttggacctatgttgataaaactggttcattacttttaaaagaattaagttgactttgaaatataaccatttcaactttaaaattatgtctgcccaagtttaagtaaattctctgactcagcaatattaatagaaaagtcaaaggggtattgcataaattttaaaacagctctaaatttatcaacattaataaagctttcttcaaatttgttttgtttttgcaatacatttccataatgctattgaccatcaatggatggatggatacagaaaatgtggcatgtatatacaatggaatactgttgagccttaataaaagaagaaaattctgccatttgtgacagtatggatgaacctgggggacattatgctaagttaaacaaaccaggcacagtaagacaaatactgcatgacctcacttgtatgtggaatctagaaaagtcaaactcatataagcagggagtagaataatggttaccagacgttggagaggtgggtggaaggagaaaggcagaatgttagtcgaaaggagaatgttagtctaagttgcagttagaggagaggattaagctttagggatctattgcacagtatggtgactatagttaatacattgtatatttcaaaattgctaaaaaatagattttaaattttaaatgttctcactacaaataaatagtaggtatgtgaggtgatggatatgttaattagtttgatttatccattccattatgtatacatatatcaaaacattacactgtatcccataaatatatacacctattatttgtcaattaaagatcaatttaaaaatgaaaaatttaaaaaaatacatagatgactaggacatagagtataccctataagagagagacataaataacatgcatgtattttaaatattcaaaaattttttcatattgattcatattaatgtgtaaaataattatattgatttgttttatgaaaagctctgtttcaacacaactctttgtgtccttctcactaataagctcttcctttccttggagcttcaaacttagcttcttcatgtgtagtgtgatatcaagaaaatgtaggcacattgccatttctttacttactaagaaaagatatttttaatatacttcaaactgtgcaataaatcaataaaggaatttttttgttttaaaagtcaaaaaatctggatttttgatctaatataacaggaataccacatgttgtgatagatactaatgttttcacatttagtagaaattatttctttgatgtaaattttaaaaatctatttcatgagtttgattatttaggctatgagttgaaaatattttttaatttagcaaatctgaaggttgagagaaagcatactcaaagtgttaattaggcagtgtctcatgtcacatgacttacctatagctaatgaaaaatatctgcaattaaacatgttcttaataagttacatatgacattatttaggaaggtttttgtattcaatgaacagttgtttggtggtttaattgaagagcttttggttgtttttggcaaaatatcttcattagttttttcctcaaattttctagcaaaattttcattactgaaattacttcttttaccagatctcacttaaaatgttcttccctttgtttggaacctaatccattttatagctggcaaaaattacaagctcaaatccttccaaaaattgtttttatattttgtgttggatatttaattttgattcaggcaaataattttcactgatttttttttttactgttaagagcaaatgtctttttttaaaaaaaaattcaatagcttttgaggtataagtggttttatgttacacgcatgaattatatagtggtgaattctgagatttttgtgcacccatcacccatgtagtctacattgtacctaatgtgtagtttgtttttttatccctagctaccctctcaccctcctgcttctgagtccattatatcactctatgatgcctttgctgacacatggcttacctcccatttataactgagaacatatggtttttggtttcacactcctgtgttacctcacttagaataatggcctctagcttcatgcaaattgatgcaaaatacattattttgttccttttaatggctgagtagtattccatggcatatatatactacattttatatactacattttctttatccactcattagttgatgtgcacttagcttgcttccacatctttgcaattgtgaattgtgctgctataaacatatgtgtgccagtatctttttcatataatgacttcttttcctttgggtagacctagtagtaggattgctgtatccattggtagatctacatttagctctttaaggaacctccatactgttttccacaaaggttgtactaatttacattctcaccagcagtgaataggtgttcccctttccccacatccacaccaacatttgttgtttgactttttagtaatggccattcttgcaggagtaaggtggtttgaatttgcatttccctgattagtgatgctgaacatttttttcatatgtttattagctatttgtatatctccttttgagaaatgtctattcatattccttgtcaagtttttgaaggaattatttgcgggttttttgttttttgttttttctgatttgagttccttgtagattctggatactagtcctttgtcggatgcacagtttgcaaatattttctcccattctgtgggttgactgtttactctgataattatttattttgctatgctaaagtgttttagtttaattaggtcccatttacttttgtttttgttgcatttgcttttggggtcttagtcatgaattctctgccttggctgatgtctacataagatttttcaacatcgtcttccagaatttttacagtttcatgtcatatatttaagtctttgatccatcttgagttgatttttatatgtggtgagagatagggaaccagtttcattcttctacatgtggcttgccagttttcccagcaccatttattaaatagggtgtccattcccaaatttatgtatttgtctgctttgtcaaaatcacttggctgtatgtatttggctttatttctgggttctctattctgttccatttgtctatgtgcctacttttataccagtatcatgctgttttggtaattatagcattgcagtataatttgaagtctggtaatgtgatgcctccagatttgttctttttgcttagggtcactttggctatttgggctccttttgtggttccatatgaattttagaatggttttttataattctgtgaaaaataatgttggtattttgatgggaattgcattgaatctatgaattgctttgggcagtatggtcatttttccatgagcatggggtgagttttcatttgtttgtgtcatctatgattactttcagcagtgttttgtagttttccttgtagagatctttcaccttcttggttaagtatgttcctaggtatttttatttttttgcagctgttgtaaaagggattgagttattgatttgattctcagtgtgatcattgttggtgtatagcagtgctatggatttgtgtacactgattttgtaacctgagaatttactgaatttgtttatcaaatccaggagtcttttggagagtttttagaatattctaaatataaaatatcatctgcaaacagcaatagtttgacttctatttgaatgccttttatttctttatcttgcttaattgctctggctaggacttccaggaatatgctgaaaaggtatggtggaagtaggcaagcttgttttgttcctgttctcggtggggggaatgctttcaactttttcccattccatatgatgttggctgtgggtaggtcatatatagcttttattattttgagataggtcccttctatgcctcatttgttgagagtttttatcacaaaagtatgctggattttgtcaaatgctttttctgcatctattgagatgatcatatcatttttgtttttaattctgttaatgtaatgtatcacacttattgacttgcatatgttaaaccatccctgcatccctgggaggaaacccacttgatcatgatgaattatctttttgatgtgctggatttggttagctagtattttgttcaggatttttgcatctacgttcatcagggtaattagtctatagttttcttttttttgttgtgtccttcctggtttgggcatcaggctgatactggcttcatagaatgatttaggaaggattccctctttcttaaccttttggaagtttcagtaggattggtaccaattctctttttaatgaatgtctggtagaattcagctgtgaatccatctggtcctgggcttttttgttgttggcaattttaaaattatggattcaatccactgcttgtttttggtgtctttatggtttctatttcttcttgatttaatctatgagtggtgtatgtttccaggaattgacccatttcctctaggttttctagttcatgtgtgtataggtgttcacagtagcatccaatgatcttttgtatttttgtggtattggttgtaatgtatccagtttcatttctaattgagcttatttgaatcttctctcttcctcacctggttaatctagctaatgatctatctattttgtttatttttcaaagaatcagctttttatttcattaatctcttatatttatttgtttgaatttcatttacttttgctttgatctttgttatcttttttcttctgctagctttgggtttagtttgttcttgtttctctagtcccttgagatacaacataaggttgttaaaatttgtgcccttccagtttttgatgtgggcattgagcactataaactttcctttagcactgctgttgctgtatcccagagaatttgataacttatttcattattatcattcaattcaaataatttttaaagttccatcttaatttcattgttagctcagatatcattgaggagcaggttatttaatttccatgcgtttttatagttttgagggttcctttttgagttgatttctggttttattttgctgtggtttgagaagacacttatgatttcgatttttaaaaatttattgaggcttcttttctggcctgtcatatggtctatcttgaagaatgttacgtgctgatgagaagaatgtatattctattgttctagggtaaaatgttctgtaaatatctgctaagtacatttgttgtattatgccatttaagtccaccgtttctttgttgattttacgtctcaaagatctgtctagtggtgtcagtggtaaattaaaatcttccactattgttatgttgctatctcattttttaggtctagtagtaatgtttcataaatctgggagctccagtgttaggtgtatatatatttaggatggtaatatctttttgctgggttgacccttttatcattatatagtgaccgtctttgtgtgtgtgtgtgtgtttttttttttttttttttaccattggtgctttgaagtcagttttgtttgatataagactagctactcctgcttgcttttgtttccgtttgtgtggaatatctttttccacccttttgccctcagtttatatgaatccttccacaaggattcatataatgaatctcctgaagacagccaatatttggattgtgatattttaaaatccattctgccattctgtaccttttaagtggagcatttaggccatttacattcaacgttaatattgagatgtgagattctgttctcttcatcatagtaatttttacttagtttttttcattatgtcattgttttataggccttgtgagttttaagctttccaaaggttcgattttgatacatattgggcttttcttcaacgtttagaacaccttttagcacttcttgtagtgctggtttggtaatgacaaattccctcaagatctgtctgaaaatcactttatttcttcttcatttgtgaaacttagttttgtgggatataaaattcttggctgacagttgttctgtttaagaaggttgaagataggaccccacacctctctggcttgtcaggtttctgctgttagtctgataggttttcctttgtacgttacctgatgtttttgtcttactgctcttggaattctttgcttcatgtttactttagataacctgatgactatatgccttggtaaatatctttttgcaataaatttaccaagagttatttgagcttcttgaatttgatatctagatctctagctagaccagggaagttttcctcaattattccctcaaataagttttcctcaattattccctcaaataagttttccagacttaatattttctcttctctctcagaaatgccaattattcttaggtttggtcattttccataatcccatatttcttgaagactgtattcatttcttttgattcttttttctttattttgtctgactgggttaattcaaaggccctgtctttgagctctggaattctttcttctatttgttctagtctattgttaaaactttccactgcattttgtaacgccctaagtgtatctttcatttccagaagttcggattgctttttctggatgatatctatctctctagaaaatgtttcagtcatatcctgaactgctttaatttctctatgagggttttcatcattctctaatatctccctgagtagcttaataatcaaccttctgaattacttatgtggcatttcaaagatttcatcttggtttggatccattgctggagagctagtgtgatctttcagagatgttatagaatcctgttttgtcatattaccagagttacctttctgattccttctcatttgggtagactattccttctaattattcttaaatttatgtttgatttgactgtgtttttttttaatattccttttttcccctaaaagatgtgactttaatgcttatagttaattattgcctaacttagttcttggtactttcaggggtgaagactctgtaagatttccttggttatagtctttgcatgatggctttctcatatgctggttatattaagaacgttctcagtgtgtgagcaagttcactgtttactatggggttggaatggcagaggtctcttgatgcttatctcattcttccatggcatgtgcttatttatttatttatttatttatttatttatttatttatttttccccagtattttatttgctggtttgatggttcaggcttcaggccaataggggaggtgtcccttgacaggaaccagctgtggctaaagcaagtaggtaaatgcaatacccaatggtgggtagaggtcccagccttgacagaggtggctggaggagctcacagtgatttgcactaaggtcttatcaaggggaagagttgcagttacctcagctcccctgtcaggtcagcaggaaagttatccacctctcagacacactcctgtcctagtgctctggctatgcagatcggataggcacctcttttcatctgtaggaatgttgatactccatgtagaaagcaagtgactctgtgtcttatgcaaccctgaccctgtagggtgctcctcctgtggggatgcagtaaccctgacatgtttcagaaaggctgtctattgttgtacccatgctgagttcccatgggagaagccccaactgtgcctgccatggtggacaaggggggaatgacatctccttctccaaggcctatcaaatgcaccagggctgattgttgggttagagctgaagaatttccctgctgaacccagcactggaactgtgcttctgctgaaggaaacttcatatcagcagaaagatctggtgctcaaggcctgccatccaggtccttctgaaccacagggtattcccttgatttggtacactcccccttctcctaggaggtgggaatcctggaagctagactattatgaatgttgttgaagagtgaatttcttatcaaatttactatgtatttgtgaaatatacctcttactatttcccacttaattatctttaaagttttgttagacaacaaacagctgtttcagtttcctctgcattggcaaattacaattaccatcatcatgacatagacatgcttttctatgtttgtatattaaaggatatatactgagctttgagcattgcttaaaatgaaggtgagctgaagagtgggaacaattgggtcaggcaaaatgtgagacttgattagcattgcctatataaagttaggcattgtttacaggttttaattcagtgctacaagcatgtatgtctttagtaatttataagacattcaatatgggggggggacatttttcaaatataatgtgatttatattttttattgttgattcatatttcattatattatgatttcagattgtgacttatttctctgatgtgttgaaattgccacaatgacctaataagtggtcaatttttctcagggttttatgtgtgcttgaaaagaatatatatattctgtattgatgggcacaaagtcctagatatgtctattaaatcaagcttattaattctattattcaatagttctaatattatatttcttcatttgtcaatattctgaatgaaacatgacatattaaaatcttgcaaatattgtagatttctgtttctcaaaatcctatcagttttggcttttaatgtttcaaggctgtgttgtgtattgttgtatgtaaaaaaaattacggctatgatatcttcttggtattgtgctttctgtggtttgattcttttaatattataaagtattcctctttatcctttttaatgtttttagccttcaattaaattttgactaatgatagtcctgcaatgcctttctttatgttggttttgcttgatctttcctattttaacccaattctttcaaactttctgtgtcactttgatttaggttttactcttataaaaaagcatatagcaagaattttaaaaattgcatgcaatataatctctttgtctttcattagttatcttctccttcgcatttttggtttgccatgtttcttctttgcttcactcttttttccaagaactagggacattttaattaataaattgttgctttattcttttagtcttcattattggtttcgaagatatattttcctaatttttagtggtttctcttaaaatttttaccagaaatgttttttaacaaaaataaaaattattaagtacctttgtttctctagttctttagcaaacctctatcttgcttgtttttattgtctggaaatttaatatgcccagctgctcattctcagcagaggggcagactttctggccctagctccagtgaagctcttttagactccattaccattaagaatgcaatctccccactgctctgcccactgctggaccaagtcacgagctgggctgctattcaagtcccactttctattttgtgcttctgatccagttgagcatcaagatattttctttgcttttcagcacaagtaacgtttataattttctgtttttctattttttctttcattattgtttggaacactgggcaggagaaaataggggaaggattgctttaacaaaaacttgacagatcttgccatgatgacagagccattatacttctataataagaaaaatgtttaaattaattaaaaaatgaatacagtacaaacgcaatcccagaactttgggaggcgaggtgggcaaatcataacatcaggagtttgagaccagtctgaccaacatggtgaaaccccaactctactaaaaatacaaaaattagctaggcatggtggcacgcacctataatcccagctactcaggaggctgaggcaggagaatcacttgaacccgggaggcggaggtggcagtgagcggagatgacgccattgcactccagcctgggtgatagagcaagactccatctcagaaaaaaaaaaaaaaaaaagtacccacaaatgtatatacaccaaatgttcacattgatataaaaactatgcacagcaaagaaagaaaatacatcagaatattaaattagttgctgcaataagtatgatacggggaaagtacttttattctttttactttctatatattgaacaaaatttagtaaaactttattctattttataatgagaatacatatttttgagctactagaagagaaaagaagcattatattagtagctatgctaaaaattttaaagtaatacaatccaacagcaattaaaaggtaggcattttaagtcagctcataccttcagaaaggtatgccaccgtatctcaagatttacacaaatcacttttacacacgtggttatagtaaccaaagtatgcttcagttgaaatgataatccagcatcctcatagatgcctgtgactaaaggtcagttagtttcaaaaggaatggagtgcttagctgattcaatgctctcgacttgtttacggcatagcttttagcattccattattctctttttattgcctttatgcacaggtgaaaaacacagaaaacactagatgattatttggtaataaattgaatggttctatggaaatgaaaagcatagaaaacctatgtgattaaatggcaactgcagtttttctctggattctgcatataaatagaataggttctcccacagagaatgagcctggctaaatctgatagttaaatatacagctctggatgtaataatagtctttgaaccttcttgaatcccagtatctagagtgctttaagctattattttgccaagtactgtagataaagcctctctgttaccctatgtttaatatgtctttgttgtctttgtgtcttacacacctagttgacctggaaaatagtatgtcctcaacaaacgtttgtggaacaaatgaattggtggatagatggattaatgaatgaatgattttatgaaaagagatggttctgaacagtaaaaggaaacactgaattatttgaataatgcactgagaactacagtgatttctcaatgccagatttgcttctgaattcttatctccttcaacaaactattcccctattctgttttagtttccacaactgcaatatgacatctgatgataaatgtgatgaaatcacagatctggatatattttgtacattatttattgactgagattaaataacaaaattatttttaattctctatttttctaaattattcaaacctcatctgttaatacccaaaaataacacctaagaataacctagttttctcttttccctttttgtataaattgcctctgaaaggccaattgaagaactattatgagcttcttgaatttgtgtgttctaatataaacataaaatgtaatctattagataaaatctagaatacaatataatcaaggtaaaattgttactttttaaacatacagtgtgactgtattgtatgtcagttagttgtgttaatgttacttagagtctaggactatgtaaagacagaactagtagtcttcatataatactaaatgaaaagaaaatgaattagtaagtctgcagtagatatatctgacaagtctagaaaatgcaggtaaggtgaatagttaaatatgagactacaagcattacgtaagattgtaagatttctacaagattatattttcagtataaaactatttcccaattaatgttgtatgcagcagctgctaaatagagcaaagttactgagtgattccatgaagtaagagcttaaggctgggcgtagtggctcacgcctgtaaacccagcactttgggaggccgaggcaggcggatcatgagatcaggagatggagaccatagtgaaaccccatctctattaaaaatacaaaaaattagctgggcgcagtggtgggtgcctgtagtcccagctactggggaggctgaagcaggagaatggcgtgaacctgggaggcggagcttgcagtgagctgacataacgccactgcactccagcctgggcgacagagcaaggctccatctcagaaaaaaaaaaaagcttaattgttagtatgtgctgaaattacacaattgtgagttccaagagctataatgatattgcctcttttttaatttttattttagtttcaaggctacattttcagatttgttatataggtaaactcgtgtcacaagggtttgttgtacagattttttaatcactcaagtactaaacctagtatccaatacttatttattctgatcctcaccctcttcccaccctccacccacaagtaggccccagggtctgttgttcccttcctggtgtccatcatttagcacccaattttaagtgagaacttctcacttaaatgatgatgagcacttctcatcatttagcacccaattttaagtgagaacatgcagtatttggttttctgttcctgtgttagtttgctaaggattacagcctctagctccaaggctcaaaaaataaactcaaaatcatgcaattacatggaaattaaacaacctgctcctgaacgacttttgggtaactaataaaattaaggcagaaatcaagatgttctttgaaactaatgagagcaaagatacaacataccagaatctctggaacacagctaaggcagtgttaagagggaaatttatagcattaaatgcccacatcaaaaatttagaaagatctcaaattaacaacctaacatcacaactaaaagaactagagaaccaagggcacccccaaagctagcagaagacaagaaataactgaaatcagagctgaaatgaaggatatcaagacatgaaaaaccgttcaaaagagcaacaaatccaggagctgatttgttaaaaaaattaataagataggccactagttaaactaataaagaagaaaagagagaaggtctaaataaacacaatcagacatgacaaagaggatgttaccactgaccccacagaaatgcaaataaccatgagaggcaactatgaacatctctatgcacataaacgagaaaacctagaagagatggatgaatttctggacacatacactcttccaagactaacccaggaaggaactgattccctaaacagcccaataacaagctccaaaattgaattaggaataaatagcctaacaaccaaaaaaagcctatgactagactgattcacagccaatttctacccaatatacaaagaagagctggtaccatttctactgaaactatttcaaaaaattgataagggactccttgcgacctcatcctatgaggccagcatcatcctgatactaaaacctgccagaagcacaataaaaacaagaaacttcaggccaatatacttgattaacattgatgcaaaaatcctcaacaaaatacttgcaaacttaatccagtaacagaccaaaaagctaatccaccacaatcaattaagcttcatccctgggatgcaaggtaggttcaacatacacaaatcaataaatgtgattcatcacataaacagaactaaagacaaaaaacacatgattatctcaatagatgcagaaaaggctttcaataaaattcaacataaaacctctcaataaactaggtattgaaggcacagacctcaaaataataagagccatatatgacaaacccacagccaacatcatactgaatgagcaaaagctggaagcattccccttgaaaactggcacaagataggatgccttctctcaccactcctatttcacgtagtattggaagtcctggccagatcaatcaagcgagagacagaaataaagggcatccaaacagaaatagaggaagtcacactatccctgtttgcagacaatattgcctctttcaggagcattgaaaataactcttgtcagggtttcaactgcacactagccaggataatctaaatttaaatattacaatgtataagcaaaaatagtagttaaaaatctgtatctttagcagatgcaaggttattgcagaagtttaaggagggtgatgcaatcagatttgtggttttaagattactttgactgcaatgtgaataataaattcacatttctacaaagaagatacaatctacagaatctctgggacacacctagggaagtgttacaagggaaacaggactttaggaaactattataatagtccaaggaagtgttacaagggaaacaggactttaggagactattataatagtccaggacagttattggtggtgacggagattaagagaggcagatggatttgagagatatttagggatagaaatgtacataattaccctcatcctactgtttattccagctaaaagtcacaagacctggcgcttatttgaatatgaggaattgatagggaggttgcaataatgaccttcaggctggatgaataattaaatcatttactgagatgagaaattcagcatgaagaaaaggtttggggggaaagatgtgggagtttagttctagatatgctaaggttgaggtgcccttggagatatataagtaaataagtagatgatattaagtagatatacaagtaaagatattagatggattaatagatgggcctggagttaagagaagtggtctagcctggagataagtatgtcggagtcttcagcatgttgattgtaacagaagccgtactatagatgagataatttatagagagaaaaaagtaaaaagaataaagaggactgtttacgagccttgaggaactctcaacttttagagtcatgcagaaaaatgtcagccatcacaatagagaaggagcaccataataagatgaaaatctaccttagacgacaaagggaagaaagggtctccagatggaggtgtcgccaacctgtgcttctgagaggttaagaaaaagtgaggatcgagaaatgccctttttgattttgtgacatcaaggtcattagtaactttagaaagcacatttccacagagtaatggggaatagacacctgactaaagtgggctgagaagtgaaaacaaagaaggaaaatgaacatattgagagcacgggaataaagagagaacactagctgagtcgtcaggtgggatcaaggaagttttcatttattgtttagttgtttttgctgttagttgttcttgtggtttgctactgcttttcaaacgataaagacccgagcagatttaattgttgatgtgcacaatgcagtaaaaaaggacaattcactttgggaggccgaggtgggcgggttacgaggtcaggagattgagaccatcctggctaacacggagaaaccccatctctactaaaaatacaaaaaattagccgggcgtggtggcgggcgcctgtagtcccagctactcgggaggctgaggcaggaggatggggtgaacctgggaggcggagcttgtagtgagccgagatcgtgcccctgcactccagcctaggtgacagagggacactctgtctcaaaaaaaaaaaaaaaaaaaaaaaggacaattaaaattatagaggagagaaagactgaatgcaggggtcaaattcctgaggaggaaaagacctggcgcatagaagatggagccaaccttgggcaggaggaggaaaaccccctgtatcttaacaggagcagggagcaagaggaaggttacagggcagttgcatttaatcacctaatgaaggaagttaacaaagttccatctggtaaattctattttctttatgaattaaaatatgagaccatctgctgagagtgagagacaagggaggaaaagtatctcaggattgaggaaagcaatacagaacaagagtggaatgtgaagcagtgtggtaagtccactctactttcatgagcatgaacttatgaattaatgaatgtttaccttgttattatacatacactgacattataggagaaattctgttgcataggatagcatacacgacatcataaagagcctatattcccacatcatcaaatcatcaacctagcaggagttcattgtatttttagaaatcttactagtctacaattcatgttattcacacacagtggaaacaaaattgatttcaggggagaaaaagtgtgtgtgtgtgtgtgtgtgtgtgtgtgtgtgtgtgtagtttataatattgttttccaactacaacacatttccactaagttgaacaaattgagatgattatattttttaattggtaaactgtccatatggatgaaggaggcaggtaattcccttcaggtactgctttccttgatttctctctttgcccatccatgaactagcactggtttacaaatttatcatgtagatatctgctttaataaatggctaagacagcactgagcacagagcaaatgccaagtaaataattactgtttgataaaagtgcttcttatcagcaaggccagtatttgtgtgtaaaataatgcttccatggggctcaaaaatagtttgctctcttaaatgagttaaatatacccacagaaatcatgttgacactacccacttgctcagcagagataaacatttgttctagtccagtctgaattcatttaatttcaaaattttggcaatagaattaaggaagtttcaccattcaaaaaatatttaggtataaacaagttacagaatcaccctcacactcctacctatttcagatgttgcagaaggtatagtagagtgtggattattcaccagatggcattttcatttcaggttgaccacagtccagtaagcacattagcaaattgaacagaggtaactaagacccacactatcttggcatgcagctgctgaatgtgtcctttttttatcagagatcatctattctctttcaacatgattggaagcagtctttgctggtggttttgtaaattgctcattaatcaaaatggatttatcgggcatccatagtatacaaagcctgtactaagtgattcaaaataacggttgcctagttaccttaaaatggaaaaattcccctaggaaggttaaaatcaaaggaaaaggagacaagaaaacattatatttgatgacacctggctatttcataagggattttactgccattacagccattttcttttaaacataatatccatccattcattcgttcattcaattattcattcatttatgcaagtgagtcaccactataattaaacaaggtctttagcttgatgctataaaggaaacaaacaggattcaatagtggtcgcataaacatgagtcttagcaaattcaccaagcaagtgctagactactgttggtctttatttaataagtccagtactagaacaatcttattctttacttcatgtgaaatctgtagtcatgaggcattagtaaaatgctccttggaaagagtatccttcattttctggttgaattgtaaaatcttgctgaatacagatctactaataagttgcttttatttaaattaaactagtacatctgataattttttttttcctgtggtcaggattagatttattttgtactagcccttctagtttttaatacaagagaccacagaaaggaaagttaactttgattttctgagcaaatgcatacttataccatgaatacacaatgttgccagtcacaaccaaccctcagctgctcagcccctgagaaatgaaagccaggcaggttgtgtgctgtactgtggcccaagcatcctcaattgcctctccctattatgtattgaatttgtgtgctcagttttaatccctatatttgttacctaggggtgcttcaacaaactacagccatccctcagtgtccaaggggaattggttcccagactccctgttgaggaggattgggtatttgaggatacccaaatctacggatgcttaagtctcttctataaaatggtgtagtgtttacatataacctattcacatcctcctggatactttagatcatctttagattacttgtaatacctactgctacataaatagttgttatacagtattttctttagacaatgatgacaagaaaacaagtctgtacatgttcagcacagacccacccatccatttttgcttctgacatatttttaatttgtagttggttgaatccatggatgtggaactcacagatacagagggccaactatactagtaactgggtggcttaaacaatagaaatgtattgtgtcacagctttcaaggatagaagtccaaactcaaggtggcagggatggttccttctgtgggctgtgagggaaggatctgtcccaggcctccttggtttgcgaatggctgccttttcctgttatatcttcacattgtcttccctctatgggtgcctgtctctgggtctaaatttcccttaaataaggatactggtcatattggattagggtccacttaatggctttattttaacttgattatctttacaatgattctatatccaaattccccaaataagatcatattctaaagtactataggttaggattccaacctttcttttcgggggcataatatgggggggacacaattcaatctataacagtccctcttaagacttgatcacccctcagtctttctctttctctctctctctctctccacccccacctccaccaccctgtctctccaggaaatcttcatgcagttcttgtatagagtagtaatgcccattttgtctgtaagcctaagccatgttacctaacacagttaacctaaagcattgaatgcattccctgaagtacaattctcaaatttccttgaccccttattgtccaagtgtcagcattctcaagatgagaaggatgagctttactcctacatgcttctcagctttgtttccccttgcctttctctgctgcaattgtctttgttctggccactgtcatttcttgctgagtgtatgcactgatttgctaatgaatcttcccgctttcaacttcatctttctccaatctatactctatactccacattgcttctagagggatcattctaaaacagaaacctgatcatgccatgttcacttctgctgtcagatgaaatccaaacttctgcctgttactccttgttctttatgcattctaccctagtatcattctatgctctaaccatgccaagtgggcatagtctctgaatgtactctgttctttcaccctctctgcatctctgcacacactgccccttgcctggagtgccataccttattcatctatctaactcctccttctttgaggctagcaaatcatgtagcacttcctcccacaagccttccttcattcacattcctccccttctactctcccagagcaccctatgcttatcttgttcattgcccttattatccttaattttaacacattctaagctcctaaaggtcaacacttataccttttgctctgttccttatgcaatatttagcacaatgcctagaacatcagaggtactcaataagtgcttattgaatggatcagaactatagggtatttacccaccaagatcaatttgagggtctctaaaagactcgtgtgcatcaagaaatgtctccacgtttgcaaattctacctttactcactaaagaatttagtaacaaagggaatacatcagtaactccaagagaggtcagtaacttccctgagttctccagatcagttagttggccctaagggggaaatgcatagctaggtatgagtcacaagggactagtcatagcagttgagagacttggaagtaataggattgatgcaaaacctaaactatgggttaatggaatcaacagaggaaaaaatgcaaactatttccttacctaaccagaaaagaagtaacagttatgttgatgctctcctctacctgctatggcgcttattgggggcaattctgtggggctgagtggataaggtctcatataaaattacatagaaactgttttgatctatattcatcccaattctaatcattttttaaaaaccacaaaatttccctttaaattctggactcctttaccttagaattcatgatcacagcccaaagactatcaattattatgaattaagcctgggtcaactgagcaaactggcttcttctatactaaacccaagtgatcaaacacaattggggaaaattatgtagccatgcaaactaagtctttacccaattttaacaacaacaacaacaaactcaggcattgtaggagtttatattttctgaaagtggctgcaagaatatcttcttataatgtgactttagttaacactccttcatcaaggggaggcaagaattaaattccctccacttaaatgtaggcaggcttttgactacaatggaagtgatgttgccttctgatgtctcattttcttagaatgtttgcttagaatcccaacacagaccacgagaaagtccaagtaggccatggcagcgatatgagtatggatcttgagaataaaacctccagaccccagttaagcttcccccgttgacaccacatggaacagagacaagctatccctgccaagccctccccaaattgcagatttaaaagcaaaacaaatgactgttgttttcactcactaagctttggagtggtttgttatgcagtgacaataaccagaagagattttgatagttggatatggggtgctgccaaaacaaaaacttaaaatacgtggcattagcaccgagattgggcagcagacagaagctggaagagccccaaagccagtgcctgtcaagccaaaagggccaaggaaggatggatttgtggaagccttaaaagctataagaaaggtgttgatgaaagcttaaaggaaagaaaacgtaactgtaagctgaaagaaagtttcttctctctctgcagtgttttacctagacctgtggcaaaaatctaagactcactccctctctctgtgcatgtacaaagaagaggtttggtaagcagggtgatgacagccttcaacaagccaggaagagagctctcaccagaacctgaccatgccagtaccctgcagatttccagcctccagaacaaggacgtaatacaaatgatgcagcttcctcttagttctttggggatgcttgctctcagaatccaggcagtagtcaggaggaaacccaagcagtgcctggagagcaaaaaaggcctccagtccattgccttagccaagttactggtacatagccaacactaactttcagccatatgagctggccatcttaaaagtgttcctctattccccagttgaacagcccgagatcataagatgtgacacagataatcagtccctgacaagccctgtcaaacttgcagatttgtgagcaaaataaatgactgatgtcagtttgttttggggtggcctgttaataacaatagataactgatacaggcatcatctcctttatgtcttcctcaagctccaggtaaggttaagtactcccccatttttgctcccaaagaactctttgtgaaacactatcttagcaattattgtgctctgttgaatttaactcttcacttgtctacctcttcgagctcaagggtaatatcatgctttttgaaaaattacctcctcaaatatattatatttgtcacattctctctttcttctcctctggaactttgattagacgagaaaactttgcagtatatctttcaagtctctcagcttctctttcatattttccacatttttgtctctgtgcaacattctgaaaaatttcttgtggcttaatttccagttcactatatctcccttcagctgaatctcatctgctgttccactcattcattgagttttaaattgcatgtgtgtatgtgtaagtaattggaatttttttcatttctaaaagttttttttttcctctccaatatgctaggtcattttcttttagtttctattcccaaaaaatatcttcaggctcactttttctttataatggcacagtcattgtatagtctacatctactaattccagtatttgaaagcacttaaggtgtggatcggctcttccttgtttttgttggttcctgttgggttttctttccctataggcttaattattagaaactgttaattttaataataggaaaattattcatagaaattatttggggccctggaggagagtatatttctctccagagggattacatttgcttccacttgatacctgagggtattagtttaaatgcatgaactgacattttttggaccaccaaggtgatatgaattttgtgtggcaatctgtgagggctagttagtagtaataattcttcaggaatttcccaccccctgacctgccttgttctgctcacaaaaaatcatctttccttggagtccccttggggtggggaatacaggattacctctgattcctctaaggctgtagcccttggaatcctagttctatggaggaaggatttcctattacagtccctgagctggacaggctgtgtagatatttgttttcagtatccaaagccacagaagtcttgagcactgaagttcattagcaggttcagtaagctcccccaggacaaatgtgactttagtgcagcatttatttcctaccctcgccaatgttttggcttgattatttcttactaaccaactaataaaaagaaattcctaatttagatgtgattcgatttctgtaattttcatatcagctttttgatacttttaagaagtttttttcttttctatatcgtatccagcatttttatttgttttcagcaagagttgacctgagcctgatcagccttgttatctgtgtccatgtcattttcatccttgtatcctcagcattcaaaattgtgccccagcatgcataagaactcaattagtttttgactacttaatcaatacatagctgtgtcttcaattttgcattccttcctctatcacacctgatattcccctaccctctgtgccccaattaaagctctttcacattttgcatatctatttcctgcattttcctattttaatgaagcttccccccctgaatatgctatttccctcattatctctcttacggaaaaggaaaagttctcattcttgtcaacttccatagcctggggtcagcattgttttcattctccatgaccgctgtgggtcactttctattatttggccttcatccaaactctgatgctcatctgaagtttacactattctattataacattctttttgtaattttattgttatcatatgtggacctccagtcatatctctacatttcttgagggtttcagtatttgattcctaatatctaccccacctcatcccctagtaaaatgcagcactacagcatagtgtttaagagcacaagttagacaactcaaggtcaagtaccaaatctacccctcattaacatgtaaccttgggaggccagctaatgtttcaatgcctcagtttccttatctctaaaatgagaataatgatattaatacctcacagcattgtaagaatcatatggaataatgcatataaagcacttagaacagtatctgccacataataaatgctcaataaatttactattttcattactgcactattaccttaaaagtcttccttctgtatgtttatgattcattaacaccctagcctcagtactgctcaaaaatccatttttttcacttgtacaaaattccctagactattacgtataatggcttttctgaattttatttacttatttatttagagacagggtatcactgtgtcacccaggctgcagtgcagtggtgtgaccacggtttactgtagccttgacctcccaaactcaggcaatcctcccacctcagcctcctgaatagctgggactacaggcatgggccatcacgtccagctaattttttaattgtttgtagcaatggggtttcaccaggttgcccaggctagttttgaactcctgagctcaagtgatccacccaccttgtctaggattacaggcatgaggtagtgtctgtaataggctagtgctaagaatataggcatgagccatcgctcctggactgaattttaatttaacccttcttaagatctagctcttactttcggccaataaccttttatcttacccagaaattgaatccatttgaaaataaatatttcagaatttctctatattcataaccatgctgtcttctcgctactctgtggggaagcaaggtctgtgtttccctaaactagctgagtcttaacttctacccattctgttctttttattctttatcttcaataccttgctctaccagaaaattcctctaaacttgatcaagtcttatttatcctaacataaaccagctatttccctcttgcacctgctttcttcttatgttactatcatacctcttcttctaatctccttgaaagagtcatccgtactctctactccatttcccagtgtcttatttcccatttcccaatgtctcactattaacttccagacatctacttgtaccacatcacttctaaaatttactattcaaaagtaagttgcgactgcattaccaaaccaaaaaaaaaagcctctcttcagaatttttcttacaactccttcacagcattaaatatattgaccatccacttgaaaatttcctccttcattagctttcatataatcactctgtattctttcttaaagtaatagaaagaaactataatggtagtcaaaaatccatgttcaagcataggccccactattgctcttaaaactctaatttctttatcagcaaaatagggataatatttgtcttgctttgttcactagtttgtaatgcaaaaaataaaacaaaataatgaatctgataatgccataaaagacatgaaatatataaagcagctaagtaagatttgataacttggtaacagataggctacagaaaatgatacaaaaattgctaccaattggctgtgaactcctgaaggaaccaaagctgtgtatcttacctagaaggttttttcagtattaaaaggtttcaaagcatcttcatcaaagcattaccatgtccattatggcttttaccaggaagttaggagacttcaaataaaaaaccttctgacctacctggactcacttcaaaatgaaaaaataattattggaactacattgggggaactttcattttgataacatagtaggaaaccaaaatgttaatgatgcatcttcatatgaataagcaagtaaattgaatcaggccaattgtgagtaagagatattaccagttcttggggaaggtgcccttgcaatttctaaggagcaaggtttctttgtaacagctgtgtccatgagatcacacagaaagttctcattttctgaaggaaatgtatccagagaagcagatggtacaatttccatagtgtaatttctcttctttggataggactcctgaaaagaagaaaaaataaaaacagctttgtgatgaagaaacagccttgtttaatttataaaaactagaaaagataatcaggttcattagttctttccaaagtgattgacagctgatgattcatctgtttgaataaattatagaatcatgtaaacccaatatcagtgatatttttaagagtcctcataatttaaaaggactgaatttattactgaattagtaaaggtattgcccttttttgtaatatatatctattatctagttgtggcataaactgctggttaactaatcaacagtcatccccaagactctactcctttgccggcctcctggagacacccatataactcggagacacccatataactcaactttggcccattagatgtaagatgaagtttgctaaaaggctggtgggaaaaaatttttccccaaggaagaagcatataaggaggctctttcagagccaaggccatccccaggctcctctctttggatgcagttttgatatctggagctagggcaagcattttgtgaccaaaaggcaagaatcttcagatcaaaaaggtaacaagccaagaatggcaacagaaggataaaaagagcctgggacattgatcatatcattgagctgctcaaatagacccagggccagtttctccagtcttcttacataaataataacattcttacagtttgagccattgctaattgggttttctgtcatttagagttaaatgtcttgccatccagcacactagtatctttccttgtaaataccattaactaatatactaaggtactcttttcaggttaggataaaatataggtccagttctatatgattgattctttgatatattctaaaaattagaatttatttcattttataagattttgatttcctgtacataaggcattaattggtcaacaaatacttattgggcatctactatatatatgtagaatatatatagcatatttatatattatatatatatgtatatatatataatgtgctaaatgctggactgtttttaaactaatgagacataatccttgctctgaagaagttcacagtctgctggagaagactgtgaaattctgcatgatgaaattcacaattaatcatattttatttttgctacagatcctcctcagctttacaaaaaaacccaaagtaagttgaaaatattgtaagtagaaactgcatttaatacacttaacctaccaaacagcatagcttagcctagcctaccttaaatgtgctcagaacacttacattagcgtatagttgggcaaaatcatctggtaacacagtacattgtagaatattagttacttacccttgtggttttgtggctgactgggagttgtggcttgctaccactgctcagcatcatgagagagttatctatcatagggtatattgctagcccaggaaaatattcaaaatctgatgtacggtttctactgaacatacactgctttcacaccattgcaaagtcaaaaactcgtaagttgaaccatcatgagttgcagaccatctgtatgtgctacttttataaagtatgcctcacaatcaagaaaaagacaaataagaaaatagactaatatttttgaaaaatctccctaagtatattctagggctgataaagatttagtacgaattcctagtttttctacagtacagcagaattcaaggtcagggtaattgctttcagacaataccagaccctcacacatcagagagtcaattatggtcatgatactccattgaaagcaggaaattgggagtaatttatttttaacaacaaagggtgacaaagtagaaggcatccagaggaaagtaatcaggatggcatataattctgaaaccatgtcagagaagaaatgatgaaaggaactgcagtgttctatccagagaagccttatagccacataatagttttctcaatgatttgaaaggctatccctcatcaactatcccacaaaggggggatggagaaaagttgatgtggtagatttattctaaggcccataaagacaagacaaagactaatgtttataagtcaagaagggcaaatttggctcaatacaaaaaataattttctatgaattaatgatattgtttaccttttaaaataaaaaggcactataaaatgagttaacaaatagcattataaagcaacagaaggaagtcctcattactgaaaatcttccagcagaattatctgctgataaaattgtggatgaaacacattgtacaatgagtccaacaggttactataagctccatgaaggctggaatttgtcttgtccactactctgtccctagaatctaatacaggtcctgccaatagttgatgagttgatgctcaataaatatgtattgatcaactgaacagtctctagtgtcctttaaacaaagctaactacaagttatggaaatgattttttttcaaatgtaaattattttgcctttcagttcagttaatattgttcaccagtttgcatataaaaagtgaaaaactgagattacaacgataagattgtaaagattctatggaaaaaaagagtctccagttaaactcctagttccatcctgaaattaaattaatcaaaacaacccatggatttagttaagttggaattttacagtgtgtatgaacacttctgaggatttttaaagcctcgaaaaccactttgaaatttaatcacaaagcatgggttaatttgctttcttccttaaaaatgaagtatataggtttattagagaataatttgaaaacataaagaaagaggaaaataatcacatgaaaatcaagcatgctgagataactgagggtaatattttggtgaccatcctcccagactgtttcactctgtgaatgtgtgtggacatgtgagtatgtgcaaaggaaagaaaaaatattttaaacaataatgaagtactccctcttctgcttcctaatggagggccataatttcttcttagaatgtaagtctttgtagaacctggcttccttagggaaggtgaggcccccgcgggaaggagttggtaaaaacgaagatagtgaaacaatgcttttgtaaccaaatatttcaatgtcaagaaagagagatagttgaacaaaatatctgacaagtgaccgtcaaaagaggatatgcaagataatttttttaaaaaaatggatccatgtgtccactactcagtttaagaggtagaatattaccattgtatcattgaaacctgtcccccaacccaccccatgttcatctttccaattttaccctttttcctcctctaccagggctaaatgctttctgagctttgtgtttttaattgcttggactgtgttaaattttaactatacatgtaagtatcaataaaaaataaatttttagtactgtatgctttcaaactttatatatatagtatcaaatgctctagttcttctgtgatttttctcaatcaagattatgtttctgaatttcatctattttcagtgtggtacaggagctcattgtttaagattaccacaattcatttacacattctcctgacaatggacttttaaatgtttcctaggtgttttgttatttaggataatgttattataaattttcccatatgaagtctcttggagcaagtaaccagggttatgctgcctattctagtagtgatggggaagagtcaagaacagacagcagacgagaaaaataaatgaaatcaagagatgataatgagaatggaaattgtatgccctgtagattctatagaatcttaaggatagcatttgcagttttctacccaaagtggcaggagggttcaaaggatattctgtaaatcttattaaaatattatatataagtatagtattatataaaatatttcctaatctgttatttacctctaatgatatattttatacccttttcaatgacaattatatgtctacatgatgaacttgggtcccaatatatacctggtcataatttatttggccaatcctatcatattgaaattttaatgttttgctttgaaggaaacatttttgttcatatattttgtttacatattcaactattttgaaatagaattcctgtgataatacatatatgacttatgtttacatataattgaatctgtatctggactttctaattggttccatatatatgtctattctagtacaggcatacctcaaggtgtatcgtgttttacagatattgcatttttaaaaaaataaagatttatggcaaccgggcattgagcaagtctatcagcaccatttttccaacatgttcttattttgtgtcacattttggtaattctcctaatatgtcaaatttttcattattattatatctgttatggccatctgtgatcagtgagctttgatgttactgttgtaattgttttggaatgccacaagccacaatcatataaaacagtgaacttaatgcataagtgtagtatgtgttctgactgctccaccgaccagccattcccctgtctcatcttctccttgggcctccctatttcctgagacacaacaatattgaaattaggccaattagtaacccttcaatggcctctaagagttcaaattcaagaagagtcacatgtctctcactttaaataaaaagctaacaatgattaaggttagtgaagaagacatgtcaaaaagctaggcctcttgtgccaaacagctaccaagctgtgaatgcaaaggaaaagttcttgaaggaaattaaaagtgctactccagtgaacacacaaatgataagaaagggaaacagtcttattgctgatatggagaaagtttcagtggtctggatagaagatcacaccagccacaacattcacacaagccaaatcctaatccagagcaagactctaattctctttaattcaatgaaggctgccagaggtgaagaagctgcagaagtttgaagctggctgtggttagttcataaggcttaaggaaagaaactatctccataacataaaagtgcaaggtgaagcatcaaatgctaatggagaagctgcaacaagttatccagaagatcccgctaagacaattgatgaaggtgactacactaaacaatagatttgcaatgtagatgaaacagcctcataccagaagatgtcatttaggactttcacagctagagaagagaagtcaatgcttggcttcaaactttaaaaggacagtccaactcttttgttaggggctagtgcagttgatgactttaagttgaagccaatgctcatttaccactccaaaaatcctagattccttaaaaatgatgctaaatcaacttttcctatgctctataaatgaaacaacaaatctggatgacagcatgtctgttggcagcatgtctgtttacagcataatttactgaatattttaagcccactattgagacctactattcacaagaaaagattcctttcaaaatattactattcattgacaaagccacagatcacccaagagctctgatagagctgtacgaagagattaacgttgttttcatgactgttaacacagcatgtattctccagcccatagatcaaggattaatttagagtctcaagtcttattatttaagaaatacattatataaggctatagctgtcatagaaagtgattcctctgatgaaactgagcaaagtaaattgaaaacctagacaagattttccattctagatgccattcagaacatttgtgattcatcagatgaagtcaacatcaatgagtctagatgaagttgactccaaccctcagggaggactttgataggtttgactttggtggaggaagtaactgcagatgtgacggataaatagcaagagaactggaagtggagcctgaatataggactgaattgctgtaatcccatgataaaacttgaatggatgaggagttgcttcttacaggcgaacaaagtggtttaagatgaaatacactcctggtgaagatgctgtgaacattgtagaaatgataacaaaggatttagaatattacataaacttcattgataaagcagtggcagggtttgagaggattgactccaattttgaaagaagttctagtgtgagtaaaatgctatcaaacagctttgcatgctacaaagaaatctttcatgaaaggaagactcaaataattcagcaaaactacattgttcccttattttaagaaactgcccactgattttgtatcctgagagtttgctgaaattgcttatcagcttaagaagcttttgggctgagatgatggggctttctagatacaggatcatgtgatctgcaaacaaatattgtttgacttcttctcttcctatttgaataccccttatttctttctcttgcctgattgccctggccaggacttccaatactatgttgaataggagtggtggagacagcatccttgtcatgtgctggttttcaaggggaatgcttccagcttttgcccattcagtatgatgttggctgtgggtttgtcatatatggctgttattatttgaggtatgttccttcaaaacctagtttattcagaatttttaccatgaagggatgttgaattttatcaatggccttttctgcaggcaaatcatgaatgaactgccacatcatgaatgaactgccattcacaactgctactaagagagcaaaatggctaggaatacagctaataagtgaggcaaaggacctctttaaggagaactacaaaccactgttcaaggaaatcagagatgacacaaacaaatggaaaaacattccatgctcacagataggaagaatcaatatcgtgaaaatggccatactgtccaaagtaatttatagacaatgctattcccattaaactaccattgacattcttcacagaattagaaaaaaactaatttaaaattcatatggaaccaaaaggagcccgaatagccaagacaatcccaagcaaaatgaaaaaagttggaggcatcacgctacctgacttcaaactatactcaaggctatagtaatgaaaaaagcatggaactggtgacaaaaacagacacatagaccaatggaacagaatagagaactcagaaataatatcacacatctacaacaatctgatcttcgacaaacctgacaaaaacaagcaatggagagaggattctctattttaaaaatggtgctgggagaactgactagccatatgcaggaaattgaaactggaccccttccctacaccttatacaaaaattaactaaagatggattcatgatttcaatataaaatgtaaaactataaaaaccctagaagaaaatctaggcaataccattcaggacataggcatgggcaaagacttcatgctgaaaatgccagaagtgattgcaacaaaaacaaaaattgacaaatgggatctaattaaattaaaaagcttctacacagcaaaagaaactatcaacagagtgaacagacaacctacagagtgggataaaatttttgcaatctatccatctgacaaaagtctaatatccagaatctataaggaagttaaatatataagaaaaaagcaattccattaagaagcgggcaaaggacataaacagacgcttctcaaaaaaagacattcattgtccaacgaacatgaaaaaaagctcaacaacactgatcattagagaatttcaaatcaaaaccacaatgagatcacctcatgcagtcagaatgatgattattaaaaagtcaagaaacaacagatgctggcttgttgcagaaaaaaaaaggaatgctttcatactgttggtgggagtgtaaattagttcaaccattgtggaagatggtgtggtgattcctcaaagatctagaaggagaaaaagcatttgacccagcaatcccattattgggtatatacccaaagtattataaatcattctattataaagatacatgcacatataagttcattacagcactgttcacaatagcaaagacatggggtcaacccaaatggccaccaatgatagactggataaagaaaatgtggtacatatacaccatggaatactatgcagccataaaagggaatgagatcatgtcctttgcagggacatggatggagctggaagccattttcctcagcaaactaatgcaggaacagacaaccaaataccacatgttctcacttataagtgggagctgaacaatgagaacacatggacacatggggggaaaaacacacactggggcctgtcagggaggcagggagaggagaccgtcagaaagaatagctaatagatgctaggcttaatacctaggtgataggctgatctgtgcagcaaaccaccatggcacacgtttacctaacaaacttgcacatcctgcacatgtaccctggaacttaaaagttgaaagaaaaaaaaaaaactgtcacagtcacctaagctccagcaaccattactctgatcagtcagtggccattcaaatcaaggcaagaccctccaccagcaaaaaattatgactcactgaaggctcatatgatcgttggcatgttttagtaataaagtatttttaattaggtatgtactcttttttagacataatgctattgcacacttcataaactacagtatagtgtaaacattactttaatatgcattgggaaaccaaaaaaatcatgtgactggctttgctgtaatagtcactgtattgtggtggttgaaaccaaactcacaacatttgtgaagtatgtctgtaccagaattacactgtcttgattagtggagcgtttaaattgattttactatctggtaggataaatctttcatcatgttaatctttcccaaggcattaattattaacttcatgtttatttttcaaaaagaaaaaatttgaaacattttgttaagttttcctcaaatcattccttctcatttgttccctatcagtaatcaatacttccatatatccaggcactaaaagaacctgggatatggttcacttttcattctttctctgtcattcccaataaatcctcaagtcctatactttgccattgaattatacctcaaacacatttatttctctccaccccagctaccgcatgctagtccagaccaccattatatttcacctgaactgctggaacaacttccaaagtatcttctttgtctccagtcctgcctctcttctaatcaattcattttcaaaactagcttgaagcttctaagagtaagtaaggtcaaagcaaactcatttattttcatcataactttatttgatgagagaatcataaaatgctagtcatagaacacgttgattctttttaaacatttaacacggtctctcataatatctcagaatttccttgctgaatgatttcattaaatacattaatgatctaaatagtaaattcatttaattaacaagataggaaagaagaaacaaagttccttgagtaataagtttaaacgtaatcccattagttgataagataaatgggattaatttctaaagacatacttatctagcacctagcaaaattccatgttcatagtaggactctatgaatatatgatgaaaaaataaatgcataaattaccatatcagttagaatttcatggcttgcaacctctgctagaattaaagcaccataggggcaagaaccatgataatcttcatatagtacgtatttaataaacatttgtcaaagtctgaaacaatgtcatccaaaaacaatcacagattcaaactatcacaaatccaaaactaccacaaattccccactgtgggaagaattacaacttatatttatgcagtgttttatcatctgcaaagtgaatactattttatttgcccagatgattctcatttagccctcacaacaatccagccaatgctactatcaccgccatccagaaactaggactgaaattattaagtgacttgtccaatattaagcatcttgttaatggaaatgttagggatccaaccttggtcttctggcaccagatctagtgttcatgtgattgtgtcaaagataaaaatgactatgaccagatatttattgccagaactaagggaaagaggacactctgcacatcgttaggtagtatctagctctgccaattttcaagcctttgtatgtccccttccctgcactgggaaacgttgacctcaatacacagattaactgccaacatatccttgatggttaatcctggtaataggcaagagggattaaaaggactgcaatgcaacaatttctgactccttcaagactcaattttctccagtctagcaatattgggctcaaaatagattagtagtttttgcttttttcttgacatttggcctctatcatttaaaaaaaaaaaaacttttaaatatgcaacttttgtgggtgtatagcaggtatatgtatttatgtggtacatttgatattttgataaaggcaagcaatatgtaataattacatcatggaaaatggggtatccatcccttcaagcatttatccttgtgttacgtaagtccaattatacccttttagttatcttaaaatatacaattaaattgttattgactatagcgcccctgttgtgatatcaaatactccattttatttattctttctaactatgttttgaaccaataaccatccacaactcccaccctcagacccccactattcttcccagcctctggaaaccatcatcctactttatgtctccatgagtacaattattttgacatttagattccacaaataagtgagaacatgtgatatttgtctttccatgcctggtttatttcacttaacgtaatgacctccagttctatccatgttgttgcaaataaaaggatctctcttttacggttgaataggtactctgctgtgtataagtaccacagtttctgtatccattcttctcttgatggacacttagattgcttccaaatttttctattgtaaacagtgctgcaacaaatatgggagtagagccatctcttccatatagtgttttcctttgggggtggggggtgtatataaccagcaatgggattgctgaattacatgatagctccctttttagttttttgaggaacctccaaactgttctcctcacattcccaccaacagtgtaccatggttcccttttctccacatcctcaccagcatttgttattgcctgtcttttggataaaagtcatttaactggggtgaaatgatatctcattgtagttttgatttgcatgtctctgacgatcagtgatgctgagcaccttttcatatgcctgtttgccatttgtatgtcttcttttaagaaatgtctattcaaatctgttgcccattttctaagtgggttattcgattttttcctatagagttgtttggactgcttttatattctagttatcacctgtcagattattagtttgcattttctcccattttgtgggttgcttcttcactgtgttgtttcccttgctgtgcagaagcttttgaacttgatgtgctcccatttgtccatttttgttgtgtttgcctgtgcttgaggggtattactcaaaaactttttgcccagaccaaatgccctggagagtttccccaaacttttcttatggcagtttcatagtttgacatcttggatttaagtctttaatctattttcatttgatatttgtatatggggagagataaggttctagtttcattattccgcatataggtatcaagttttgccagcacagaatactatgcacccataaaaaggaacaagatcatgtcctttgccgggacatagatgaagctggaagccattatcctcagcaaactaacacaggaagagaaaaccaaacacctcatgttgtcactcataagtgggagctaaaaaatgagaacacatggacccagggaggggaacaacacacccaggaccctgtcagggaggcagggggagggaaagcaacaggataaatagctaatgcatgtggggcttaacacctaggtgatgggtggataggtgcagcaaaccaccatggcacatatttacctatgtaacaaacctgcatgttctccatgtgtatcctggaatttaaaataaaattaatttaaaaaaaaaagactgtttttttcccaatgtatgttcttggcacctttgtaaaaaatgagttcactgtagatgtgtggatttgtttctgtgttctctattctattccattggtcaatatgcctgttcttatgcagtactatgctgttttggttaccatagctctgtagtataatttgaatccaggtaacgtgattcctccagtgtggttcttttcttctcaggatagctttgtttcttctgggtcttttgtagttccatataaattttagaattgcattttctatttctgtgaaaaatatcattggtatttgagtagggattgcattaaatctgtacattgctttgggtagtatggatatttcaacaatactgattttaccaatctatatatatgaaatatcttttcattttcttgtatgatctttaatttcattcatcagtattttatagttttcattgtagagatctttcacttctttaggtaattcctagttatttaattttagttgtggctattgtaagtgcaataactcttttgatttctttttcaggttgttcactgttggcatatagaaatgctactgatttttgtatgttgattttgtatcctgacactactaaatttatcaattctcattctttttggtggagtctttaggtttttccaaatataagatcatgctaggtgtggtggctcacacctgtaatcccaacactttgggaggccaagatgggcggatcatctgaggtaaggagttcgagactagcctgaccaatgtggtgaaaccctgtctctagtaaaaatacaaaaaaaaaaaaaaaattagctgggtgtggtggtgggcgcctgtaatctcagctactcaagaggctgaggcaggagaatcgcttgaatatatatagccaacaagaatactttgacttctacctttccaatttggatgccctttatatctttctcttgttggattgctctatctaggacttccagtactatgctgactaacggtggcaaaagtgataatccttgttgtgttccagatcttggaggaaaggctttcagtttttccccagtcagtatgatactagctgtgggtctgtcatatatagctcttattatgttaagatatgttccttctatactcagttttttgaaggttttctgtgatgaaaggatgttgaatttcatcaaatgctttttcagcatcaattgaaatgatcatatggtttttatcctttattctgttgatatgatgtattatattggttgatttgcatatgttgaaccatccttgcctcctagggataaatcccacttggtcatgataaaacatctttttaatatattgttgaattcagtttgctaacattttgttgaggatttttgcattaatattagtcagagatactgaccagtatttttttttatgggtctttgtctggttttggtatcagggtaatgctggtcttgtagaatgagtttggaagtattctctcctcctctactttttggaatagtttcagtaggattagtattagttctttaaatgtttggtagaattcagcagtgaagccatcaggtcctaggcttttatttgctgggagactttttattacaccttcaatctcattacttgttattagtctgttcaggttttgaatttctttatggctcaattttgataggttgtctgtgtctagtaatttatccatttcttctgggttttccaatttatcggcctatagttactcatagaacccattaatgatcctctgaatttctgctttataggttgtaatgtctcctttttcatctctgaatttatttggatcttctctctttttttcttagtctagataaaggtctgtcaatctgagtctggctaaaggtttgccaatgtttatcttttcaaaaaaacaactttttgttttactgatatcttgtatggatttcttcatctcaatttcatttatctctgctttgatttttaatatttcttttctactaattttaaatttggtttgctctagcttttctaattctttaagatgcaccaattggttgtttatttgaagtgtttcttccttttgatgtagacacttataggataaactttcctcttagtactgctttcactatatcctatacattttggtatgttgtgtttccattatggtttgttttgagaaatttttcaatttccttcttaatttcttcattgacccctggtcatttcagggcatattgtttaattttcatgtgtctgtatagtttccaaaattcctcttgttattgattatatttattccattttggccagagaaaatgcttaatattatctaaatttggttgaatgttttcaaatttgttttgtgagctaacatatggcctatccttgagaatgatccatgtgctaaggaacagaatgtgtattcttcagtcactgagtgagatgttttgtaagtatctattaagtgaatttgatgtatagtatagattaagttcaatgtttctttgtagattttctgtttgaagatctgtccaatcctgaaagtgggatgttgaagacctagctattattgtattaaggcctatctgtctctttagctctaataatgtttccattatatatgtgggtgccccatggttgggtgcacacatatttataagtgttatatcctcttgctgaattgacccttttatcattatataacgaccttctttgtctgacttgtcttatagtttttgtcttgaaatctactttgtctgatataaatatagctattcctattcttttttggtttccagtggcttggaatatctttttccatccttttattttcagtctatttgtatctttatagatgatgtgtgtttcttgcaggcacagatcattggctcttgttttttcacctattcggccactctatttgaagtcagtcttctcattcagactctcattcagtattctcttccctctttccttctgtcttttctcccttttagtgaaagtgattttctctggtgctatgatttaatttcttcctttttattttttgtatatccattgtatgtattttgatttgaggttaccatgagccttgcaaataccatctaataatccattattttaactggtgacaatttaacaatgattgcttaaacaaacatgcaaaaagtaaactaatgaaggctctacactttaactttgtctgcctgctttttaacttcttgttgcttctctttatgtattattgtattgtgtatgtcttcaaacgttgttgtagttgttatttttgattggctcattgtataatctttctacttaagatatgagtagtttacatgccacaattacagtgctataatattctctgtttttttctgtgtgcttattattgccagtaacttttgtacctatagatgatttcttcttgctcattaacatgctcttctttcagatttaagaactccctttaacatttcttgtaggacaggtctgttgttgatgaaatcccttagctttggtttgtctgggaagatctttatttatctttcatgcttaaagcatattttcaccagatatactattcctgggtaaaagtttttttccttcagccgtttaaatatgtcatgccattctctcctggcctgccaggtttctactaaaaagtctgctgccaaacatattggagctgttatttgttatttgtttcttttcttttgctacttttaggatccttcctttatccttgacctttgggactttgattattaaataccttgaagtaatcttctttggtttaaatctgcttgcattctataatcttcttgtacttgaatgttgatatctttctctagatttgggaagttctccagtattatccctttgaataaactttctacccccacctcctctttaaggccaataactcttagatttgaccttttgaggctattttccagagcctgtagttgcgctttattgttttttgttgttttttcttttgcttcctctgactgtgttttttgttttgtttagttttttgttttcttgagatggagtttcgctcttgttgcccaggctgaagtgcaatggcatgatctcagctcactgcaaccttcacttccttggttcaaacgattctcctgcttcagcctttaagtagctgggattacaggtgcccaccaccatgcccagctaattttgtatttttagtagaaatggggtttctccatgttggtcaggctggtctcgaactcccaacctcaggtgatctgcctgcctcagcctcccaaagtgctgggattacagacatgagccactgttcctggtctgactgtgtatttttaaacagcctgtcttgaagctcactttcttctgctgcttgatcaattctaccattaaaagactctgatgcattcttcagtgtgttgattgcgttttttcagctccagaatttctacttgattctttttaattatttcattctctttgttaaatttatgtaatagaattctgaattccttctgtatcttatcttgaatttcttttgagtttcctcaacacagctattttgaattatctgtctgaatggtcatgtacctctgtttctccaggattagtccttagtgccttactgagtttatttggtgaggtcatattttccaggatggtcttgatgcttgtagatgttcatcaatgtctggacactgaagagttaggcctttattgtagtcttcgcagtacaggcttgtttgtgcctgtccttcttggcaaggctttccagatactcaaagggacctaggttctaagccccctaatgctgtggtttttgcagactcatagaagtatcattttggtgatcttggataagatctgaaatgattctcttgattaccaggcagagactcttgttctctttccttactttctcctaaacaaatagagtcagtgtctctctctcaatctctcgctctctctctctctctgctgagccacctggaacttggggtatggtgatgcaagcacccctgtggccacagccattgaaactgtgctctgtcagacttgaagccagcacagcactgggtcttgccccacacacactgtaaacactttctggctaccacctctgttgactcaaggcactagggctcagtgatcagcaggtagcaaagccagccaggtctgtgtccttccctttagggcgggaagttcccctaggtcctgggtgggtccagaaatgctgtttgagaagcagagattggagtcgaaaaccttttaagtttacctgatgttctattctactgcaggtaagctggctctcaaaccacaatacaaagtccttcctagtcttctccttactgtttttctaatgcctgattatggatcctagacttgtttttgtacttgaatttttacaatagtagcaggcctaggactgtgttctctgccttggtctttgacagttctcttccaagagattgatgtccagtccctgaatcccaaacaggtcctttaggccctgtgccacctaaatttacagctccaatgggaatgaatagctttgatgctttgccttacttagattcctttatcctacctgctactgtcaattgtgcaatgtgcagaccaaatagtactgcttcaaagtgactaatcatgcatactgacagcacttaataagtaaagagaacattatgccccccaagaaaaataaatattggcaataagaaatctatataataagcgttcatacgttgtttacactgtgttttctataacatttaaaactatcagtggtgggcagaatataacaagtcaaactttattagtgactcagtaaaaggttctatgcttcagtagagaaaagagttataaaaaattcatcatggagctatgtggattagcaatactatgaaaaaaatattaggagttacagctgacagtatgagtcagactgtaacatgccagttaaagaaattaatgtgacattagctgatttaatacaagtatgatatttcacctagaaagagtgacaggcctccactcttcagtgctaattagtattgggaatgatctggcttcacaatttcataaaaggcgggctaactggattgtgctgaatttcctttagtaaggctgtgcaaggtcttattcatcaaagagactgggggagacttggccttctgacttacgaaagatcttagcaacaatcaggaacccagaggtagacacagtagttgcccaaaagtaccaataatgtagtttttcaaatcagaaattaggtggcctagaggcttttctagactactttgatagggcatctcactgaatttgcttcctagcacagctctattcttagccacatgggaaaactaaagcatcttaattgacactacaggggaatcacacatgatgcacttggcttggtgctggggctgacacttgaggagaggcaaagaccaaatggaccgttttctgtgaacataagtgaggaaaatggtgagtattaaacccctgtcatgtgagaaaagattaaataagaaaaggtgctgaggaacgtgtatgacaaacatttaaaaggtaaaatagtgattagaattgttatctatctctaaggaagtagaaataatgcagatggggagatggtaacagggacagatattgcagctgatgataagatttctaataattagagctttgcagtataaaactggctgcttactaagtagcaaactctctgtccctggagtcttcaaggctagcctgatctatacaaggcatcttcttttttttttttttttttttgagacggagtctcactctgttgcccaggctggagtgcaggggcgcgatcttggctcactgcaagctccgcctcctgggtttacacaattctcctgcctcagcctcccaatagctgggaccacaggcgcccgccaccacgcccggctaattttttgtatttttagtaaagacagggtctcaccctgttagccaggatggtctcaatctcctaaccttgtgatccacctgcctcagcctcccaaagtgctgggactacaggcgtgagccaccacacccagcctatacaaggtatcttctgagtgtagaagatagcagtttgaattagacgagttttaagatgctaagtaaatgagagaatcagaatagaagttttgtattagtactatggtacaagttacctgaatatattcactgcttcctgaattttttctgataatgggggaagtaacactaatacaagagtgtgggtttatggcttttttaaagttagaaatgactcacagttccaaatgactcaaggtaggtgaaagtttttggaagtggtctgactactctgacatcttcccacaatatcaagaaaaagtatcccctgaagatttacaatgacattcaaataagaaaaactacaacatgaatatgaaatcagaagaaaaataacttttttttaaaacgaagatactttaggtgggagcaaagaatgaatgacagaaaggcagccatgggggaaggagcatcacgtaacagtggtaggcagaataatggctctgaaagatgtccatgtctgaatccctggaaactaggaatacattacgtaacacatagcaaaaggaactttgcagatgtaagtcaaggatcttgctatgaggagatcatactgcattatccaggtggcccactatactcagaaaggacattataagtagaagagggagaaaggagagccagtgtcagtgatgcaacacgaggtatctgactggctgtcactggttttggagcttgaagttagccatatgtattagtctgttttcatgccgctcataaagacatacccaagactgggtaatttataaagaaaaagaagtttaatggactcacagtcccatgttgctggggaggcctcacaatcatggcagaagagcaagggacgtcttacatggcagcaggcaagagagaacgagagccaagcaaaaggggaaaccccttataaaaccatcagatctcatgagatttattccctaccatgagaacagtattggggaactgcccccataattcaattatctcccacaggatccctcccacagcataggaatcacgggaattctgggagctacagtccaagatgagatttgggtggggacacagccaaatcatatcaccatgaatcaaggactgtgagcagctcatagaagctggaaaaggcaggaaaacagattcttccctagagcctccagaaaggaaagcagccctttctatattttcgactggtagggcccattctggacctccagaactgaagaataatacatttgtgttgtttttttatgccactaaatgtgtggtaatttgttacagcagcgttaggaaacaaatgcaataatataccagcagaaggcatcacacagggaggcatgggctaagagaaggacataaaattggacaccagtgggaaaatacaccttatcattttgtactgactcagtattttaaagatggtgattctttctcgtttttaaatgtaatacaataccattgcaatacagtttccctccaactccaacttagttcttgacaagtaagcctaaagtgcatttggaaaaataaatgtgtgacaatagacaggttatcaatttgaaaagagaaaggtaatggagggagtggagatcaacctttatcagatatttatgtaaactacaaatggttctggtacaataattgaaaggcaagataacagaaaaaatactttaaaagaaggttctgatgcttgcagaaacttattacattataaaggtggtatttcaaatcagtaagaaaaccacgggttatataataattgtcagtgaggtaaccaactagtcatttagagagaaataataaacttgaattactactgcattccttatatcaaattaattcctgataaagatttaaacaattagcaaatatatttgttataataatcttgaaataagaataacttttgaccagaagctacaaccagacacataaccaaggttgtacagaaaaagattgataaatttgaatatatactactattaaatttgtataaagaaactaaaatatcataaagatcaagagacaaaaaatttgggaaaattctttgacaaatataacaaagggttaatctctttaatatatataaagataataataaattgagatgaaagagaccatcaacctaagagaaaaaaatgagcaaagattacaggcagttgtaaaaatagctagaaatttcttacatgaaaagatgctcaacttcatttataattaaatatatgtacatgaaagcaagataacacaccattcttgatcaaattgctgtagataatacacagtgttagtgagggtttgaaaaaaatgggcactttatataaaagttaaaagactaaccatctgttagtcaaagtgtgaattgatgtaaacctctttctggctaatttgtcatttgttacaggagatcgttagaaagcagatctttagacagcatggactttagaacttttgccatgttaaaatttttccctcacctcggaacaggtgggattgataaactaccattactatttctaaaacatggtactgtaaagcaccatttacaggcattgcataattattactctatctaaaaaatgctaaatgctggatatgctgtatgtttctattaaataataaaatgggagtgtgggtggagggaagcctgcctcttggtgtcatgcatgagaaaaactaatcagatctcaccaatatcaatcgtctgagctgtgaatgggtgtcgggatagcatccctctttagaagttactgatgaaaccccatgaagcttgattcttagataagccttgcttggtcagccacttcaaaattggaggtaccaatttaacatttgaaaacaaaaaatctcaacaacaaagttctgagaaaccagtgtgggtactacctaagaatgttactttgggtatgatatgggttaaactatgtcctcccaaaattcacgtgtcaaagtcctaaccccagtacataagaatgtgacattatttagaaatagggtcactgcagatgcaattagttaaatggagatgaggttattagggtggaccccaatccaatgacaagtgtcgttataaaaagaagaaatctggagacagacttgtacacaggtataacatcatatgaagattggagttatgctgccacaagccaagaaatgctaaacattgtcagaaaaccaacaggaatggaacaaattctctctcacagacctcagaaggaaccagtcctgctgacaccttaattttgaacttctagcctttagaactgtgagacaataaatttctgttaaggtatgcagtttgtagtactttcttatggaaaccctagcaagccaatatagagttaaaaaaaacagtaaaaggtactcgttgaaaaacttttgattaatctcttagcattttaacatatttactccttgggaaaaaaataacaattagggactatcaaaaaaggggattatctttcttcttgataaaattcccaaaagtgtaataggtatcaaaattttaaaatcacgtaccctttaataaaataaataagtattgttgctgtaaacaggcaatatagtacaatatagaggtctacagactttagactgcacaaagtccacctggatcacttgttagtaatccggatttgtggctctccccggaattcttactaaatcggaatctctggtggtagccatggagagttatatcttacaattatcccaggtcatgttgatgcaaattgttggtgaaatatacttggaaaatacaggaagagtagttcaagagcatgagccctttaactggagtcagaatcccaactctgccttttttaacaaagttgccttggcaaagtcttacagtttcctcatctgcaaaattagaatagtaatagtatctgcttcaaggttttgttggtagttgtgaatgaaataataaaatcaataaataactttgattaaaatgtatcaaaccaccaatgacattcttaacataatgagaaaaaaactattttaaaattcatatgggaccaaaaaaaaaaaaatggcccaaatagccaaggcaattctaagcataaagaacaaagttggaagcatcacattacctgacttcaagctatatactacaaggctacagtaaccaaaacagcatggtactggtgctacagtagacacatagacaagcagaacagagtagagagctcagaaataaagccacatgtctacaaccatttgatcttcgccaaacctgacaaaaacaagcaacgggaaaagtactccctattcaataaatggtgctgggataactggctagccatatgcagaaaattgaaactggaccccttccttacaccatatacaaaaaatcaactcaagaaggattaaagacttaaatataaaacctaaatccataaaaaccctggaagaaaacctaggaaataccactctggacatagaactagacaaagatttcctgatgaagatgccaaaaacaattgcaacaaaaccaaaaattgacaaacgggacctaattaaactaaagagcttctgcacagccaaaaaacagaacaaaaacaaaaacaaaaaaaaaaacaaaaaaaaaaccatcaacagagtaaacagacaacctacagaatgggagaaaatatttgcaaagtatgcatctgacaaaggtctaatcccaaatctataaaaaacttttaaaaaattacaagcaaaaaaaccaaacaaccccattaaaaatgaggaacataacatgaataaaatgattcatttcaaaaagatgattcatttcataaagcacttagtctagtgtctaaaagcctaagtgatcaatcaatgtagccattattactactcagtaatttttaaaatgagataaatgtgcaagtactgatatgttaagctaaaacaataaacaaagggaagaataatatgtgatgtatgttcatatctgtgtgaaaaaagtatgcactcaaattatatattcctggaatatttctagaagatattattagaaacatttggtgtttaacactgggaaatgagatcatattctcttttgctttgcttgatttaaaaaaattatatgtacatgtgattttcagggaaaaaatatagtttgtgaatctaccacctgaggaaagagatgataccatttcaaatacaaatgagctttgatttttatttctggcactactgtgtagaaatttgcataccccaggtgaaattggaaatggtgaaatcccaagaataatctctgtaatgaatcatacaaatgcaactgaaaacatgccaaatgtcaggtaaaactaaataggaaccacctttgtacaaatcctcaaaaaaagacctagatgatctagatcagaagtcaacaagaagtcaaaagaagtggaatgtagttcaccaataagaagatgacaaagaggagaatgttcacctagactcgaacccttgaaccatttatctttctcttgttctatcatgcttactgtttctgtaaagaagccatcaacaagttgggcgtattagctcacacctgtaatcccagcactttgggaggctgagatgggccgatcagctgaggtctggagttcaagaccagcctggccaacatggtgaaatgctgtctctactaaaaatacaaaaatgagcagggcatggtggcgtgtgcctgtaataccagctacttgggaggctgagggaggagaatcacttgaacctgggaggcagaggttgcagtgagcaaagattgcaccactgcacaccagcctggtgacacagcaagactctgtttccaggaaaaaaataaaagaagaagtagtcatcaacttctgtaagcttttcacttcctaattacccttaaatccacactatttttctacgtccataatcactaagctagttcaagcttcatcagctcatacctatgttacatatttaaataatctccaaactcccatctaatttagctccattttaaccaggagttcccatcattctgaatactaaaacatttttttcgaagtaaaaatttttacagattctctaagtgataatattaggattaatttaggaatgtagacagtataataaatgactttcttatttactctctaaattatagataagagtccagggttcaagaaaccaaccagagattttaaacatttaggctttgcaggccacatggtctctgttgtaactactcagtattggtgttgtagcacagaagcagccacgtacaatatgtaaatagaaaagcttgtccagatttggcctgcagtgagtcagaactgtcctagtgaccacagattgccagactgtggcaaagaggtcatgcaaaagagtttaaaacatcagtaaggctagtgatgaagcagatactggtttaggcccttggcagtgtaggcttcctactcctacactctagaactacatagactggcatcaggtctcccaagcgagttctttattgctaggcttaccttacatactttctgcaggtgagaagatcacaaagagaataagtgacacaagctcagtttctgctcccaagtttaggagtcagttaacttccctgagaaaagaacaggaacagagagaagcccagtcacacttatccataactctccacgtgaaaatacaaagtcaggggaaagaatctcactttccttgcccaactgcaacaggtaagttgtaccactgtattaaaaaaatcagcaaaaagcaaaagtgattttccatttttattaatcacaacaaaacttatgcaaattttaaaataataaatatggacatggatatgtaaaacctaccatttatttaatctacagacagaggttagtatctgtatggattttcaagcccttttcagcaaccccatagtggcccacttgagatccacagcttcataccacttctaaaaggtagggactattataaccctcacagtatagtactgtcagaggacaatcatgatcatccaataaatatttgttgaataaaaatatgaattttatactaatttattctttaaagctttcaaagcctctccaaggataccttttaatacaaaccctctcttcccatatgcctgatatactcagtagcctccatcctgaatgacatattcctgcctctgtcttcttgcttatgttctccttattccctctgagtagcagggccctcccaggcctatagaaattctccctttccttcataggcaatcataaattctacttagtccagtaagaattttgtggctacacttgactacatagcttgctttcttctctgaacctaaaaacaacagtaatattctgtttgatattaaatcagtatctcatgacacattagcttttcaggactgcatttataatcaatatttttattgttagctacttttgttgttgttgtagtatacatttttatttttactttttatttcaatagctttaggaatacaagtgttttttggttacatggataaattataggaacctcccaactctccccccttctgagtctccagtgtcaactacaccacacagtacacctttgtgtacctataacttagcttccaattataagtaggaatatgtggtatttggttttctatttccaagttacttcacttaggataatggcttccagttccatacaaggtgctgcaaaagacataatttcattctttcttatggctgagtagcattccatggtatatataccacattttctttatccggtcatcagttgatgggcactgagattgattccgtatctttgcaattgtgaattgtgttgcaattaacatatgagtacaattgtctttctaataacttccttttctttgaggaaatacccagtagttggattgttcaatagatggtagatgtgcttttagttctctgaaaagttgccacactgttttccatagaggttttactaattcacattcccaccaacagtttataagcattctcttttctccgcatctgaaccaacatctattgttttttgactttttgaaaatggccattctgactagggtgatcttgtagctcactgtggttttaatttgcatttctctgatgattagtgatatcgagcatgtgtttgttggccatttgtatgtcttcttttgaaaaatatctgttcatattgcttgtctactttgtaacgggattgtttttttttttcttgctgatttgtttgagttccttatagattctgcatattagtgctttgtcagatatacagtttgtggatattttctcccattctgtaggttgtctgtttactttgtggattatttcttttgcagtgcagaagctttttcatttaattcaatcacatttatttttgttttgttggatttgcttttggggtctgtgccctaaattatttgccgaaggcaatatccagaagagttttcctaagttttcttctacaatttttatggtttcaggtcttacatttaaggtttttttgttgttgttgttgtttgcttgtttgtttgtttttgagacggagtctcgctctgtcgccaggctggagtgcagtggcccgatctcggctccctgcaagctccgcctcccaggttcacgccattctcctgcctcagcctcccgaatagctgggactacaggcgcctgccacccaacctggctaattttttgcatttttagtacagacggggtttcatcgtgttagccaggatggtctcaatctcctgacctcgtgagccacccacctcggcctcccaaagtgctgggattacaggcgtgagccaccacgcctggtcacatttaagtttttaattaatcttgagttaatttttatacatggtgagagataggaatccagttttcattcttctatacgtggctattccattttctcagcaccatttattaaataggatgtcctttccccagtgcatgtttttgtctgcttagtcaaagatcagttggttgtaggtattttgctttgtttctgggttctcaattctgttacatttgtctctgtgcctattttataccagtaccatgttattttggttactattatagccctgtagtataacatgaagtcaggtcatgtgatgcatctagatttgttctttttccttaggactgcttttgctagttaggcttttttggttggttccttgtgaatttttggattgtttcttctaattctgtgaagaatgacattggtattttgataggaattgtattgaatctgtagattgctttgagcagtatggtcattttcacaatattgattcttccaatccataagaataggatgtttttccatttgtttgtgtcatctatgacttctttcattggtgttttgtagttctccttggagagacctttcacatccttggttaagtgtattaggtattttattaatattatattattttgcagctattgtaaatgggattgagttcttcatttcattttcagcttggtcattgttggtgtatagcagtgctactgattagtgtttatgttgattttgtaatctgagactttagtgaattcatctatcagatctaggagtcttttggaggagtctttggggttttcaaggtataagatcatatcatcagcaaaagaagatagtttggcttcctcttttccaatttggatgttctttctttctcttgcctgattgctctggctaagacttccagtactgtgctgaatagaagtgatgaaagtgggcatccttgtcttgttccagccttcagggagaatgctttcaacttttccccattcagtatgatgttggctgtgggtttatcatatatggctcttatcattttgaggtattttagctactttttagattctaccctcccagtgagctagtgctccatttggtgtttcatttgtgtgtgtgtgcacgcttctattttatgcttcacagaaatccatacaattcctacacagagtagactttcaaaatattgaattatttatgttaaatgactcaattaattaacaaaagaatggataaataaataacataaatgaccaatattaataaaaattaagtcttaaaaatatggagaaaaacttgaatggcctcccaaaaccttccaatccctgtgctattttaacagaaacattaattatttttaaaaaaccctctttgtagtcatttacttcacagagacaagaaatatggtaacataaaggtaaataatataaatctgtgacttgaatccttgaaaaatctggaacaacaaaaatattgacaaataatatcattgtttaaaatactgaagaagaatatattgcaatgacaatatgaaaatatgttttggtatctccagtctcagtcttgttagaagtatgttcagaagtgaacaactgaatgagaagtgaagtgctcataggggaaggataagtccagaaatctgaatttagtcccacatagcaatgaatgtttctcaattatacaaattacagtcaccacttcagtgataatcatgtcatttgccatttattgttttcactcatcaagggataaagaaaaataaaagatgaaagttacttgaaaaataatgatgaatccatatgctgagagaaaagcattgtgttctaaatgacaaccaacacctgaacccaggactcacttatttggttaattaatatacattcgaggctgtgaaattgtcatttctacacataataattaaacaccattaatggaaacacctaaaataactacatttgctttctcagagaattacacattaggaaagtaagttaatgtgataaacattttacaatatatttagacttttaggaaactttttttttcttttttcttttctttttttttttttttttgagatggagtctcactctctcacccaggctggggtgcagtggcattatttcggctcactgcaagctccacctcccgggtttaccccattctcctgcctcagcctcccgagtagctgggactacaggcacctgccaccacacccggctgattttttctatttttagtagagacggggtttcaccatgttagccaggatggtctcgatctcctgacctcgtgatctgaccacctcggcctcccaaagtgctgggattacaggcatgagccaccgcgcccggccctttttaaaaaattaacgtgatttaggaggccacttgaagatattcagcttttgatggcataaaattctggctttaataaccaaccactagttatttaatatgattgtgtacctgcaaaaagcttaagaaacttttagctaaatgaaggaattctttaagaagacaaaataagaattagtcacatatctgcttttccactattcttgttaccattactctaccagcatccctgcaaagcagatcagcaatatttgtgtgttttgaaactcctctggtttcctggcttctaagatccagtccatcaccaagtcccatgattggtccactcttgttgtcccacgtccatgttaaactaggtttcagcatcacacatgcagattaatgtcactgtctctgaactcatctcccttcttggacagcttcacttcatcctatataccaccattagaagaatctttgaacacaattattctcaaattattcctagcccaaaaactcaaatactttctaaataaattttattcaaatcaaaactctctagcatagcgctgtatatcccaacatgccaatttcaccttctttatttcattttccattcaactgtatgccaaggctctactttgagctcatctgcttgttagatcagcttaacactgaatttgaacatgccttacctcacaattctacttcttcaagttcttcacctattttaaaagccagtgaagaagcacttacagaggtagaataagaatctccagaactccactccttcataaaaggcacaggaacactcaaaaagttgtcaaaataaactttagcacttaaccaaaggtttgcaataatccatcaaggatttattcaagaaaatcatcagaatttttgtgaaaacagttaacattgtgtatttaaatttgctctaatcccatttccatctccccagctccacaacagtctcacaatcactcttaaaaccaacatatactagagggcgttaaatgggtttggagctctacaaactgtcttgcactcacagagaattcatatttgatgtatgcagcagctccctggaaaagctccatttataggacatgtctttatttgacctgatacagaactcactcagtgggaaaggctctgttcttaagatgttagtcaaaatcaatcctgacccatagaatgtacatcaagaatgaaccctaatgcaaactatgaactgagggtgatgatgatgtgtcaatgtaggttcatcaattgtaacaaatgtagcactctggtggggatgttgataatgggggaagctacacatatgtatgggggcaagggagatatgggaaatctctgtactttcctcttaattttgctatgaacctaaaactgctctaaaaaattagtctttattataaacaaaactatgtatttttctacaatcaaatttcttcacagctatatgttcttagctcctttcatgcttttatgtgtttgtataccttttgtgttccagtggttgggaatagttttgtgaaaataaaaaatatttccataaagaaaaaaagctagaaaagttgttgctattagacctactctataagaaatatgaaatttttattttaatttaaattttgtgtaggtacacagtaggtgtatgtatttatagggtacatgggatgttttgatacaggcatgcaatatgaaataagcacattatgaagaacggggtatccaatccctcaagcatttacccattgagtttcaaacactccaatcacactctttatttttaaatgtagagttaagttataatttattatagtcaccctgttgtgctatcaaataggtcttactcattttttctaagtacttttgtacccattaaccctccccaccttaaccacaaaccccacactaccattcccagcctctggtaaccatcctccaactctctatctccatgagtttgttttgctttttagatcccacaaataaacaaaaacatttgaagtttgtctttctgtgcctggccaatttcacttaacataaagatctccagttccatccatgttgttgcaaatgacttgtctagatctcattatttttatggctggatagtactccattgcgtataagtaccacattttctttatccattcatctgttgatggacgctttggttgcttccaaatcttagctattgtaaacagtgctacaataaacataggagtgcagatatctcttcaacatactgatttccttttctttgggtatatatccagcagtgggatcgctggaccatatggtagttctatttttagttttttgaggaacctccatattatcctccataatggttgtactaatttacattcccactaacagtgtataaggttttcctttttctctacatcctcaccagcacttgttattgcctgtcttctgaattaagccattttaactgggtaagatgatagctcattgcagttttcatttatatttctccaatgatcaatgatgttgaacaccttttcatacgcctgttttccagttgtgtatgtcttcttgtgagaaatgtatattcaaatcttttgctcatcttttggcaaagttattttcctatagagttgttcgcacactctatatattctggttattaatcccttgtcaaatgagtagtttgcaaatattttcttccattctgtgggttgtcctttcactttattgattgtatcctctgctgtgcagaagctttttaacttgatgtaatcccatttttccatttttgctgtggttgtctgtgcttatggtatattgctcaagaaatttttgcccagaccaatgtcctggagaatttccccaaagttttcttatagtagtttcatggtttgagggatttgatttaagtcttaattcatttttatttgatttttgtaattaatgacaaataggggtcttgtttcattattctgcatatagatatccagttttcccagtaccatttattgaagagactgtcttttccccagtgtatgttcttggcacttttgtcaaaaatgagttcactctaggtgtgtttatttgtttctgtgttctctattcttttccattggtctatgtatatatttttatgacagtgtcatactgttttggttattgtagctttgtagtataatttgaagtcaggtaatgtgattcctccagttttgttctttttgcttaggatagctttggctattctggtttttttgtggttccatatacatttttggattatcttttcctatttctgtgaagaatgttattggtattttgatagggatttcattgaatctgtacatttctttgggtagtacaaacattttaataatattgagtcttccaatccatgaacacggaatgtctttccatttttctgtgtcctcttcaatttctgtgtcaatggtttatagttttcatcatagagatcattcacttcttttcttaattcatttgtttttaatcttatgtgtggctattgtaaatgggatatttttatttctttgtcacattgttcactattggcacacagaaatgctactgatttttgtatgttaattttgtatcctgctactttaccaaatttactagttctaatagttttcttgtggagcctttaggtttttctaaaatcatatcacctgcaaacaaggataatttgacttacacctttccaatatggaggccctttatatctttctgttgtctgattgctcttgctaggacttccagtactacgttgaataatagtggtgacagtgggcatccttgtcatgttccagattttagagaaaaggctttcagtttttctccattcaatgtgctactagctatgggtctttcatatatggctttaattatgttgaggtatgttccttctattctcagtttttgagggtattttatcacgaagagatgttgaattttatcaaatgctttttcagcatcaatcgaaatggtcatatggtttttatccttcattctgttgatatgatatatcacattgatttgtgtacgttgaatcatccttgcatcccagggataaatttcacttgatcatgatgaatgatagaaatactaaattattaaagggaggctttctggctgaaaagacagtaaacagtaatgcaaattcacactaaaaaacgtaaaaagtgtgggtaaaggtaaatataagatagtataaatgtacttttatttatactcttttcaccacccttatgccttaaaaaatcaactgcataaagcaataattacaaatctctgttgatgtgcttatatgaagatgtaatttgtacaaaagcaacaatacaaataagggaggaggaaatattggggcaaagtttttttgtatattattgaaacaaactgttgatattaattcaaaatagattattttaagttaaaaaatcaattataacctctagaataccaactaaaaaataactcttaaaaatatgtatgaaaaacataaaggaaattaaaagaataaactagaaaatatctatttaatacaaaggaaggcagtaatggaggtatagagggacaataatgatataagaaatattagaaacaaatagcaagatggcaggcataaatactaccttatcaacaattacattaaatgtaagtagattcaacactccaaacaaagagatgagcagaatggactcttctgtttttgtttgttttaggttttgcttttttgttttcttatagacagggccttgctgtgttgcccaggctggtttcaaattcctggcctcaagggatccttctgcctcactctgcctgccacaaaatgctgagattacagacaagccactgagccaagccagataaattttgttcaaaaaatgatccacatgttgtccataaaagatacacttaatattcaaagacattaataggttgaaagtaaaaatatgaaaaaaagatacatcatgcaaataacaaccaaaagataacttcagtgactatactaatattgaacaaatagactttgagacaaaacttgtcactagagacaaaaaaaaagacattttataaagataaaacagtcagtcaggaagacacaacaagcataaacatatatacacctaaaaatagggcctccaaaacatgaaacaaaaagtaacagaattgaagggagaaatagacaattaaaaaataatagttggagacttcaatatcacattttcaataatgaatagaacaattaggcagaacatcaaccagcaaacagaagacttaaataataccataagccaagtagacctaacagacatctatagactactctaccaaacaacagcagaatgtgcgttcttcttaagtacacgtgaaacatcctgcagaatagaccatgcaatatgagacttgccataaacaagtctcaatacattttaaatgttttatgtcatacaaggtatgttctctgaccataatagaaaaaaattagaaaacaataaaaatgaaaattgagaaattcatgaatatgtggaaatagtcaacatgctccttaattagcaatgtgccaaagaagaattctgaagggatattaaaaataatttcaaatgaatgaagacaaaaacacaacataccaaagcttatggaatgccgcagtgcttagagagaaatttatagctgtaagcctatttttaaaaagacataagtcaattataacctttagtattaagaaactagaaagaaatataaattgaaagcaagcagaaaagaggaaataataagagcaaaaataaatgcaaataaagaatagaaaaacaataaagaaattcaaagaaatgtaagttggttctttgaaaaaaaatacaattgacaaaatttcaggtagactgaacaaaaaaaaagagagagaagactcaaattactaaaatcaggaatgaaagagaagctatcactaccaactttacagaaataaaaaagtttataaggaatactatgaataactccatgccaacaaaacagataggctagctgaaataaacaaaatcctaccaaaactgacttaagaaaaaataaaaatatctgcgtagacctataacaagtaagagattgaatttgtaatttcaaaactttccatatattacggccaggctcagatggcttcaaaggtgaattaaaccaaacatttaaagaagacaataacaatccctcacaaatgcttctttaaaaaaaacaaacaaacaaaaaacacaaaaaaggaaacactttcaaattcattttaggaatcttgtattacactaatatcaaaaccatataaacacatcacaagaaaagtagacatcaacatcccttataaatgtagacacaacaaccttccacaaaatgctggcaaactaaatgcaacaacatacaaaataattatatatcatgaccaagtgcctcaggaatacttggctggttcaatatatgaaaaatcaaccaatatcatacactatattaatagaataaaggacaaaatccacaaaatcatctcaacagacacagagagtgcatttgacaaaatgtaacatgcttctggtcgggcatggtggctcacatctataatcccagcactttgggaggtgagtgaatcacctgaggtcaggagctcgagaccagcctggccaacatggtgaaaccccatctctactaaaaatacaaaaattatctgggtgtggtggcagacacctgtaatcacagctacttgggaggctgaggcagaagaaccacttgaacctgcggagcggaggttgcagtgagccgagatcatgccactgcactccagcctggcaacagagcgagactccgtctaaaaaaaaaaaagagtaacatgcttccatgataaaagcactcaacaaactagaaagaatgagaattctctaaatctgataaaggcgtctatgaaaaacctacagctaagattctatttaatggtgaaaaactgaatatttccccctaagatcagaaacaagaaatggatgtcactcactatttccattcaacattgtactgaaggttctagtcagggcaatagataggaaaaacaaacagcatccagattggaaagaaagaagtaaaactatcttaatttgtagatgacatgaacttacatatgtagaacaatcctaaagaagccacaaactttatttgaaataatggacaagttcagcaagtttgcagatacaaggacaatactaaaaaaaccaattgtatttctatatggtagtaatgggaaatgcaaaattaaatttaaataaaatttcatttacaatagaataaaataaattacttagacatgaacttcacaaaaaaaatctaagatttgtacactaaaaatttaaaaacatagttgaaataaattaaagaaggcataaataagtggtaagacattgcatggtcatgggttagaagacacaatattttttaaatggcaataatctccaccaaattgatcaacaggttcatcaaaatccctataaaaaaaatccgtggtgctttttttcacagaaattgaaaagctggttctaacatttatttatatggaaacagaaggaactcagaatagccaaaaaattttgaaaactttgaacaaagtgggaggagtcactcttcccaatttcaaagactactaaaaagctacaataataaagacagtgtggtacagcataagaatagtcatatagatcaatagaaaaaatagttttttcaacaaatggtgctgggataactggatatctatccacatgcaaaagaatgaagttgaatacctacctcatataatgtacaaaaatgaactcaaaatgaatcaaacgcctaaacgaaagggtaaactctacaaaactcttggggaagaagtatagataaatcttcatgaccttggatagggtaatggtttcttagatataacaccaaaataacaagtaacaaaagaaataaataaactgaattttgtcaaaatttaaaacttttatgcttcaaaggacatcaagaaagtaaaaagacattcacagactaggagaacgtatttaaaaatcatatatttgatatgggacttgtattcagaccatatgaagaactcataattaacaataaaaagacaaattatccaatttaaaagtgggcaaaggaataagtatttctctaaagaagatctacaaatggccaataagcacataaaaatactaaacatcattagtcattagagaaatgcaaatcaaaaccacaataagaaaccacttctcaccactaaggtgattaaaataaaaaagactaacaatagcaaaagttggcaaggatatggaaaaattggaaccttcatacattgctggtggtattgtaaaatagtgtaaccactttggaaaatagttcggcagttccttaaactgttaaatatagagttaccatatgactccaatattctacctctagttatatataacaaagaaatttgaaaacaaatgttcatacaaaaacttgcacataaatgctcatagcagcattgctcaaaatagtcaaaaagggtgaacaacccaaatgcctaccaattgatgaatggagaaacacagaattgaatattattttgtaataaaaaggaatgaagtactgatatattttactatatggataaattttgaaaacattatgctgtgatacattctacaacataaataaactttaaaaacattatgctaagtgagaaaaaaacagatagaaaaggccacatattacacgatttcatttatatggcatatgcagaatagacaaattgataaaggtgtatgccaacttagtggtagaaaaaaggaaggccaatatgggacaccgaagctaataagacatgagtaggattaaattttcagtctagtaacacatgaggaatgcctgtggcaaagcaagaccaagataaatgacataagaagacaaataaaattgcaacttcactgggaatgagatatggtagttgaatttgaagattctgccactatgtttcacaaaatatatagagagaaacatatataaatacatagacatatgaacccctgtgaaattgtgtgttgtaagaaaaagaaaaataataaaattctttaaaaaaaaactaccttgtgtttggattgtgccaaccaccacatggtaatatctgaataagtctgggtaatatgtgaatgagcatacagtttgttggcatgaacaaatattgaaatcaataagttataccagttatgaagtatttcaattctcactcctgattctgatatcagtgacagtcaatgtagtaggtttttaaattccaatctgccttaggtgttcagatccattttctggagcaggtttgaagtctgacagtccctacccggactctggttcctatgctttattatgtgcagcaagtcactgaaactgcgagatttcttcatgtataaaatcagaatgataatatgtttctcaaaagtttgtttcaagaacgaaacaaaatgtcctgtgtaaaagatctaataccacttccagaacacagtatgagctttcttttaggacagcttcattgccactgcctatgagctgaactaagcatttcatgacaagagaccctggaatataaggagtctacaaacacctacattatttagtcattcaggatgacagaacaagtgacaagagcaattgttcccaaccttagctgtgcatgtggaacatctgtgaagctttttaaatgcatataggtctgagactcacctcccaacaaccctccagcacctggtcccatgctgataacctttcttctgtataaagtcttacatagttttcacaaatactatttataaaaccctcagtgttttcttcttctggctaaaagtgcctgctgttttaactcttccactgcaaaacactgtctaattattggattattcttaaaactcatctgtgagccctggctacattatctgactgtctctttggttatgtggcttcatttatcattggtcgaacttactggaagtgaaaaggaaggttaccttaattgatagagctattgatataattctaagatatgattaattgcacaggacattttaattatatgatccgttcttcatgagacaacaaaaaccaaggcattctagacacccatgagggagctctatttctatgtctgaaaacgaaattagacttcttgcttttatttttcccttcccaaatgacatttatataacacacttaagttctgatggagtatggcaaatgtatttaactttcgaccaatatttatagaatcctttatttcataagggataaaagcaagcccagaatttttcctgtcttttaactcttgaaattgtcccctaagaatataaacaaactaaaaggcgaagcaaaacatagacaatatccccttgaatgattcataataaccacatttaagcctctctgggttttgtttgtttgtttaggtcacagcactattgggaggcaaaggggttattggctattgaagtgtttgctgttgatgaagaactaaatttaaggcatgtattcttttcttgactagagtttgattagcttcgtcatacttttgctttagggaaagaatggtatagaagaaataaaagaactaacggaagcccttccatttcaatcactgtaaagaatttatcatcataagatcaacaaagcaccatttccatgtaccttttgcaatatatatatacacacacatatatatatattttacacatatataaattatatatatatatatataaaattattgcatcggggcttctttgttgcttttctttttcctcaatgacattgagactttacctatatccaataacatttgccttcctttctattttcttgcatgttttaatctcatagtgtcacatgggttcactttacctaaagatggaatattctcctccgttggagaagaaccccaaattaggccagaagaatactgaaaaatgtatggactttgtagtcagaacctgggaagaaaaatcctaactctgccagatgaaatggtccaagtcaagttgaatggaaggattaaaatagaagattaataaaatgcagctgtagacagctggcacatagtgacagtcaataagtgacaatttataattcattcatttattctacctgcctggagaagtgaaatctaagagaaatagacaatagaaataaaatacaaatctatcaaataaaacaaagtgaattaatcagtaagcattcttgaacactaatatatataaggaagggctaacttaagaaagacatgcttttcaagagtttataaactggcttaccattttaagacattttccataaaaattatgccacatcatataaattagtaaaactctattccaatcttaacctacttgtactctatgttctagtcactctagaagtcctaatcacatgccaaaccatgccacaagtttccagggacacatttcacatatctgctgctctcagtagagggatcaataattcttccctactgggctgcagagcgaagaaaatgggatctctgataagtacaggcaatcaatccatgctggtgtccactgcagaatttaggaactccatgaaatcaggagtaagggaaggctagaccaccctctgaaaactgaacgttaagggttctactttatgcatgataaatacatagagcaaagtgaaagaaatcagatggagtctggtcagaacgaatggaagggaaaaatagttaactataacaggattgtgagatggtctagttctagtaaggggaaaggagctcagtaaggttggagaagtaggcatcaattagttccagggtacatgcagtgtagcaggttgggataaactccaacaacaaggagaactgattattttagcaagaggaaacaagacatctctgacaggggcagggggaggatgaataaacaagaggatgagtgtctggattaggctgagatccctacagcagtgggacactgggtggactctggggggaaatctgtggtaaaattcccagtaagtgtggccttggggagaaaaagagagggaaattccaagaacaaagtacttgggttttggagtcagaccagggtttgcatctgagtttgcccctttactttctagatcttagacttgaagcaagtcacctaaccagtaaataatttcttaatcacacaactttgtacaataatgcctacatcaaaggactcttctgaggattaggagataacatgtgggaaatgcctggtattgttcagatatactttgtttttattttcttttattttggtataaaatataagttcttactataagaagtttatctttctgatcaggagagatgatccaacccctaattcataaaaaagaaacaggaggaatataggaacttaaacacccaggggtgttatgaggcaccagccctagaaagaagttggaggctgaaattttagccccaactctaaagcaaagcaataatattgtctgggagctgaatccacccaaagtgaggtgcccttttctaatcctttcaaaggctctatatgggataatgggtgatcctgaaagtgtctccctaggaggtagaatacaaactactcaactgagtggcaaaacctttcatgttcaacatatgtaacatttcagtcttaaatgttttctgaattgaaccgagcattattcaggaagtgaaacactcccatgtcttgggaatacattgttcaaatagtctaaaacatcaggtatgttttattttctttttcacattataactccctgaattatattccaaaggtagaagagtttatgctagatttttacagaggatgtcttcatgcaaaattaagggattgcagactacaaaactgttggcagaagattcgggttgtttttgaggaataaatgtatgcccttccctgatgctgtcttatatggcaataaactaaataaaaattgtagttgattgacagtaattataaacctgcaacagcaataaaatttgtgttaattatcaaaaatatcagaccagttgtgctgcccattacagaacaatattgaattttctgttaaggaaattggtccacctttccctaatttttgttttgccttcctaaaggtaagcctgaaatatataatagcatatcatcagaattcattccactgactccactaaatgacttccagaaattttgctataggttgctaactaaagacagcagcatctccttgcatggaatatcagattcaaatttctttgcctgattctgggtggctctctaccaaatggccctttcccttttcctgttaactgttttgctttctaatccccaacagtttagcacattaggtgctcaataagtatctgtggaaagaaagaaggaagaaatagagagatgggcaggactatgaatgtttttttaaagacaatagaaatccccccaccaccattctacaaaataccttttgcatctgacaaatataggtaatgttattattaataatatattatttcagatattaacttctttaaaaatgtaaatcttcttggagaatcaacatttagtaatgtaatttactcatccatgccacactaagaagaaattttgaagccagaaaaagagagggtagtagaaatttgaaaaagaaaaacaataagaaaaggagaactctggaaaagatagtgctctttgcctttgtttttgctaaatatattcattcctttgatgaaccattaaaaaattattagctcctatatatcttagggatacagacattcagtcattagaagttgcgaagatcatcattccacaaatattactgggttcctgctatatgccaggtgcataagtgtagggaacaagattgcctacccagaattatgaaaccaaaatagataattacaactatgattaatgcaataatggagaactgccatggggacataacatataacaaaaaggcatactagtggggaactggaggtgggggtgactagcaatttacctatatcttttttccaaaatgatcttcaaactagaaatataagatcagttaacataaagaagaaaccgaaactctagataggtcatacaatagttagagagcatcaacccatgtgaacagtcaagtctccagtccaggtatactatacctcagggcactaaaggaacatacatattgattactgtaaataacttctgtaattctttagaaatcacagtaagcgtgatggcagaagactggagatgggtaaatctttaatccaattttcaaaatagaagttgaggcaaaagactaggaagtttaagatcagtccctgccaaaattcttagagttaagcagatggtttttgaagtcttagtaaataaactggtattcatgaaaaccaacagaatttgctaaattaagttatgctaagatgaatttattttattcttcttcattctctttcttccttcttctctccctcactcttttctttctatctttcataatttctgttattcaacaagtgcttgtccaacactttcatgaatgctttacatggaatgcttgacaagcaagctgttaaccaaaccagtggtttgcttagtaatagcaattagatattgcttagtaatagcaattagataaaaactaatttgcctaaggaacatgcattctatagtcaatgcatgaactaacctagttcagtgaatgtaagataaagaagatcctgttagcccaacattttgtaaactcccgccattccacagaccctggtcacagtggaaaattccactaaggcttgggctgtgaaaaacatcctgctggataagtcccaggcctaactgcctaactgcagaaaattcctcccttttcagcagctaacctcactgtccaccccatttcacaacaagcccagacccctcccgctcggacctataattactccagcatgcaaatggcagcgggctccagcgctagctggtatccccttctgcaggtcttttgtccaataaacctgtgttgttgttgagccagcaactctctctctcttttaccctcgccttcccttcaaagcctaacagatccctagtggtttcatggtgctctctatctatcttgagtgctctctatcttgagtttccagtgtaacatttctctcagtgtcttgataaagtcctaagaatcacagacatgttgtttacataaagcatagaaacataactagcacttgtgtcaaaatcataagggctgcttgctcaaaattcaaattcctacctatcccacagatatatttagtcaaaatttccaatcaagcgcggtggcttaggcctgtaatcccaacactctgggaggctgaggcaggcagatcaattgaggtcaggagttcaagaccagcttggccaacatggtgaaactccgtctctactaaaaatatacaagttagctgggcatggtggctggcacctgtaatcccaggtacttgggagactgaggcaggagaatcgcttgaacccgggaggtggaggttgcagttagccatgtttgggccactgcactccagcctgggtgacagagtgaaactctatctcaaaaaaaaaaaaaaattgaagtttgaagttatgtagaaatttttatttttaacaatcaccacagttatttattttgcacacttaggtctaagaaccctcactgaaatgtttaagacacattacctacccacaatcactaactaaccccatgtgtatagggggcctaattaaaatacaacaacaactataaagcttctgtagataaatgctaaaagatctcaaagatttgagggatcttccttatcctgcaatcccttttggtcttgctgcttatccttgattatcttcctctgctgcattcttttctttgatcattaatttaagtgttatgctctaatttgtttttaatttggatgacccctctgtcctaaggatgtgttttggtaaaaccctggcatcctactaccagctctacttagactccataattaaccctacacaatccctgacctctatgtcccagcctcctggaagcacctgacaacaaatatggaatcaagaaattgtgatagcactttcagtagtgtaaacaaaacacctaaaacacagagtctctgatgaattatctaattttatttctcaccgtttctactcccacttctatcatcaattccagccacataaaataatttttagctcctcaaatacatcatcatactcagcaatatcatatcatacaataaatcttttctgaaaactgccccaagtcccttccccacacctccatctaatttctagctatgtctctttagggctttctaactgtctccatcaaagcacttttcacattgaactatggaactatgatctccactaaaaggtaagccgctttatggcaggaaccataacctaacagtgtcagattcttaggatatgtttactatgagttggaaggaaaggagaggagaggggaggggaggggaggggaggggaggggaggggaggggagaggaagaatactctggagcacacaggtgggaatatctgggaggagcagaaaagacttcagaaaagagatgacatttgagctatgtcttagagtggcagagaaactaaagtgagaaggcagacatttctcttcatcacaatggccaataatcttttttgagacacaaaaatctctggcatgaattagtgtaacagttccctactaggtgtcactatatccaatatttactgtctcctagccattttccacagttcagcctagtggtctcactaaaatgaaaatctgagtatgtcctgactcttaatgtaggttgcaagattgtttataatctgactcctgcttgcctctccagatttaagggccacctccccccaccacacacacacatctgaaacactgttccaatcatatatgtacagttcctagcatgtgccaagcttgtccttttacctctgggcctatgtaccaagaacactgttccttttatttctgcctggatgatccctagtgctcctttaggactcagtttctacatcagttcctgtaggactcagttttttttatctttccttgtgaatgactaggtcaaatcacctatcacacattcttgcagaatcctacactgatcacaattataatgaaatgattgtgaaatacttgtcttccaaaaaagattacgagttccaagaaaacaggcagttggtctttttcttattgtctcctcaatgtctatcatggtgtctggcacaaagaaaatgttcaataaatatttgttggcttaatgaccaaactgaagtaaatgaatagacaaatgtttttatttccaattagattttaagcaaaatgagggcaagtttcatgtctgtcttgttcatcattgtattcccactgtctagcacagtgtctgacacataaaactctcactaaatagttgtaaaataatgaataaatgacagatcaaatgaacatggcatcctgccacattgcattactaaatgctctatgataaacacattttatctttctaaagttatattatggctgggaattaaattataaaacaatgattatcaaaaatcatagatataaacaataacatggctgtccctcagtatccatgggggattgattccaagacaccactgccccagtcccacgaataccaaaattcacaaatgtgcaagtccctatagaaaatggtgttgtatttacatataacctatgaacatgctcacgtatactttaaatcatctctagattatctataataactaatacaatgtaaatgccatgtaactagttgttatactatattgtttagggaataattatgagaaaaaagtctgtacatgttcaggacagacacaaccatctatttttttccaaatgttttccacccatggttgatgaatccatgaatgcagaacccacggacacagagagctgactttatatcacaaaaaagcttcaacagctgtaaacatttgtcatcatttaaagttataaaaattaggctctatatccaataaaacattcatgcatatatttttcacaatagttggagcttcaatgtaaaataaagcctctgtaggccacataaatttttactagctaaacgaagtatactaggtataaaaataatcaacaaaaatttagcaaggctttctagaatttagaagttcttttaaggaaaattaggatagccctcatcattaaacccggttggggtttgttaatattttccttaaatgaaagttgatattattcaatgcagtaaccaaatatctgaacatctcatttaaggtccttagatgagaggatttggaagactggaatcatcattattaatactgttgctatggatgcttttttcctaagctctttgactttatttgaagtagaccaagaatattagatcaaggggccagatggtaaatatcttaggctttgctggccatatgctgtctgtttctactactcaactctactgattcagcatgaaagcagtcatagacaatatataacagaattaatgtggctgtattccaataaaactttacttacacaaacaagcagcagcagtttgttctgcaggccagtttgcagattactcttaagtaaacaattgctgttttaactgcctagcattcattgacaattcatttgctaaaggcaccttgatttttatttgcgggatcatctctcctcctctccaaacccttgtagttgcagtggaattgacccgaggcctttagggccagaattagtcaggtggccgaagactgtccaattagaatgtctttacgttagcttcagtgactggttcaaggttgaacaaatgaaccacgatggtctactgtgtctcaatcctgggactttttggacaattgagaaacattttttatggtggggtcacaatgtaagtcttcagctgctagtagaaaccatgtagagaaaaactgcctgtgggtgatgccaacacagaagaaagcaaagcccagatatgaagagaaagagagagaccaaatccagaagggctcatctaagcaatacaacctagctgtgcctaaagacacatctcagcctacagccaaaagagatccaaattcaactgcatggataacatcaagaaaactcttaaagaagaaaagtaacccaattgagaagtctatgagatactgtggaaggtacagttatatatctctgagccagtgcagaagagtgagaggaataaggaaggatagatagccatggaatggatatgagtcagggattttttaaaccatgaaatgctgaaacagtctttctctcccacgttagtatctaaagagtctgtaattacagaacctacaaattgctccacaaacttgggggtaaaggtggaaggtggaaaggagagtcattagctaaatcatcctgaataagaagataatatacaaaatctcccaaagcagtatttccctgtaatctactaaaggcttaaaattaagggatagggtccccactcaaacagagcttgatgttttctactgcactaaccataatccatgaagaaaagaagctcagaactttaaagagggaagcatttcaggtcactttggtccaatattggaattatttgtttttgttaacttttattttaggttcaaggttacatgtgcagttttgttatatagataatttgtgtgtcacaggggtttggagtacaaattattttgtcatccaggtagtgaacttaatatccaattggtagtttttcagttctcctcctcctcctacactccatcctcaagtatgacccagtatctgttgttcccttctttgtgtccacgtgtcctcaatgtttagcagccacatataagtaagaatatgtggtaattggttttctgttcctgtgttagtttgcttaggagaatggcctccagctccatctatgttgctgcaaaagacatgatctcaccacattttctttatccagtctaccattgataggcatttatattggttccatgtctttgctattgtgagtagtgctgcagtgaacatacacacgcataggtctttatggtagaacaatttatattcctttggatatatacccaataatggaattactgcgtgaaatggtagctccattttaagttctgggagaaattgcccaactaccgtccacaatggttgaactaatttacattcccacaagcagtatacaagcattctctgttctctgtttgctgaagttgtttatcagttctaggagcttttgggtggagactatatggttttctagatatggaatcacacaccttcaaacagaaatagttttactttttctctttttatttggatgccttttatttatttctcttgcctgattccttggctaggacttccagtacgatattgaatacaagtggtgagactgggcatccttgtcttgtttcagttctcaagggttatgcttctagcttttgtgcattcagtatgatgttggttgtgggtttgtcatagatgtctgttattattttgaggtatattccttcaatcctacattgttgagggtttttaacatgaaaggaggttgaattttatcaaaagccttttctacatctattgagatgatcatgtggtttttgtttttagttctgtttatatggcaaatcatatttatttgcgtatgttgagccaaccttgtattccaggggtaacatctacttgatcatggtagattagctttttgatgtgctgctgaatttggttttctagtattttgttaaggatttttgcatctatgttcatcaaggatattggcctgaagatttgttttttgttgtatctctgccaggttttggtatcaggatgatgctggactcacagaatgagctggagagaagtctctcctcttgaatttttttgaatattttctgtaggaatggtagcagctcttccttatacagctgatagaatgtgacagtgaatccatctgatccagggcttttcctggttggtaggcttttggttactgattcaatttcagaactcatagaattgttcaggatttcagtttcttcctggttcaatcttgggaagttgcatgtttccaggaatttatccatttcttccaggtgttctcgattgtgtatgcagaggtgttgataatagttcctgagggttttgtgtatttctgtgggggtcagtagtaatgttccctttgtcttttctggttgtgtttatttggatcttctctctttttttctttagtattccggctagtgggtctatcaaacttatttattctttcaaataagaaactcctggattcagtgattttttttgggggggagcatggcttttcatgtctcaatttcattcagttcagctttgattttggttatttcttgtcttctgctaacattggaattagtttgcttttgtttttctagttcctctaggtgtgatgttaggttattaatttgaaatctttctaacgttttgatgtgggcatttagtgctataatctttcctcttaacactgctttagctatgtcccagagattctgatatgttttatttttgttctccttagtatcaaataatttcctgatttatgatttaatttcactgtttacccaaatgtcattgaggagcaggttgtttaatttccatgtaattgtacagttttgagtgatattcttagtattggtttctatttttattgtgctgtggtcagagagtatggttggtaagatttctgttttcttgaatttgttgagaattgttttctggccgattgtgtggttgcttttagaatatgcgccatgtgcagatcagaagaatgtatattacattgttttggagtggagagttctgtagatgtctattaagtccatttagtcaagtgtcaagtttaggtcccaaatatctttgttagttttctgtctcaatggtacaacactgtaagtgagatgttcaactctctcacctcacttttgtaggtgacctgtcccttttctctagctgcctttaacattttttcttttattcaaccttgaagaatctgatcaatgtgtgtcttggggatggttgtcttacatagtatctcacagggtttctctgcatttcctgaatttgaatgtcgacctctctagtgatgttggaaacattttcatgaatgatatcctcaaatatattttccaggtttcttgctttctctccctctctttcagagatgccaatgggtcatagatttggtctcccatatttcttgaaggttttgttcatttttttaattcttttttctttatttttgtttgaattagttaattcagagtaccagtatttgagctctgagagtctttcctcagtgtgatctatttgtgctattaatacttgaaattgtatcataaaacttctgtagtgagtttttcacctctatcagatgattgtgactccttcttaaaatggccatttcctctctttcagctcctgtattattttattgtatttcttagattccttggactaggttttgactttctcctgaatcttgatgatttttgctcctattcatattctgaattctatgtctgtcatttcagccatttcagcctggttaacaaccattgctagagaactagtgtggtcattctgaatacaaagacaatctggcttttcaagttgccagagttcttgcactgattttcttatctaggcaggctgatgttcccttaatctttgaagaagccgtcttttagatgaggttttttgcttttatctctctgatgcccttgaaggtttgtagtataaggtgggttcagtcaacaggctttgtttctggaagactttagggggccaaggctcagctcagcactgctgggctgtgtgctctaactcttatgggcgtttaccatgcccccagctttgttctctgaccccttgcagttaagaacctgctgtggtggaggggccgaggtattcttagactgctagccacaacgctacaatggagagtgtaagcccaagtgcttcatcagagcaatggcagagatctgtgctcactcattcatgccagcagtgcagtggggatgcacacacatgatggggtcagtgggagtggagtggcggtattcgtatgcatgctcacattggtgaccgtagcggtggggcaggggcaaggcattggcagagatggggttgtcagagtccatgtgcacatccacgccagcagcagtgcagcaggatgcccaagcatcaggaggagcaggatagcatagtgtgctcacactggcagcagtggggcagcggggtacacacacgcatgccagcatgggatgggaggcaaggtctactcacacatgcaccagtaaagcaatgtgtgtgtgtcaaggggggaggggaggtagtggtccatgcctgagtaagtgccagcaaagcagcagtggggaggctgtagtgggtgaggttgtaggtgggttggtgtgtgtcaacaagagctggtctgctggagctctccagtagtcatgcacagactgccagtgaaggagctatgatgagatccctgaggaagcaccttggttgggcttgccaggctgcactgcaagtgtgtggccaggctggagccccaggagaggccaccagacagaggggcactcagattggactggacccatcacatgggaaagaccaccctgctctatccaggtctaacagttgcccaaaagctaaagcctcctggaggagcatggcaagccttggtgtatgggtatccctggccatgctccacttcagccattcccatgccaaaccttctgctcctacaacctatctaggcagctctccctgccagctcaagtgtctgtggggattgtggggtgtcctgctgctaggattctcaaagtccatggcaagagctggtcactccttccctgttcaactcaccccttccttaggagttgctggggaccagtaatgaatcttggtgctccgaaaccctgcgcaccgttcccagcttcctcccgcttcagcccagcaactgaatcctctctccatccactctcaatgccttctctctgaagatctgcttagagtgtaccagtcttcccaatgttcttgtttctcagtgaaagatgttcctcctagttgcatctagttggccattttggctcagatcagaaattgccattttaaaaatcagatcttcattgagacttctatcaagtcaggctcaaaggcttagatttttaaatcagtgttgattttgcacaatattttagaagcttctttctgcacattaaatcaatgtttatgtcaaatacttgttctagacctccccacatctctcaatcagtgatgaccattagttttcacataaattcaagtatttatgtacttgacaaattaacaaataatttgttaagatgatcacatagaattaatattactcgttccagttgcatggtggggaaaagaaagcagaatcaatattttctgaaaacctattttgttgcaggcattatattaacttgatgatttatagctatatccttgtataaccctcacataattcaatgaggtaggttttattttccctgttctcagaaaaagaaacaggttcagcaaaattaggtaacctgtacaaataacatagttaataacaaaagtcagatatttctgcaatactctagtgcctaacatccctggaaacaaagagaaaaatctctgtggatggtgaagataagtattgctgcttaagttttgatataaaaatcatatagaggatgcttacatgcaacagataatatccaaaaaatgcataagaaaaaaatttcctcctgagaggatttaaatctaatctttgaattaaaagtaagacctaaaataattgtagaagacaacatacaatgaggcctcggtcaagtgtttcagtacttcagaaaatgaagaattttacgtgatatagaaatatttacttgaagcaaacattttataaaacagtatgaagcattcagtaatacagctgaggtacacctggggtactaatttggttatttctaggctagaaagtggtttcatgtttaattcactgctttctgaagaggaattgatctctaattgactgtaaagttatggtgagttctagttgcttattttctttgttcctgtaatattaatttcttataatctccaagcaaaatataacattatctaatgttcacttgagtgtctgaataccacacgttacctcaatagatatgttgttttttttcacatagcccaacacatttttcttcaaagtacaatacagttttctatgattttttttaagaaaaaaaaaatccaaattcagttgcagatcctctaaaaccttatccgtatccatttctttctcttgttccctagctgtgatctttaaaataaagttgatatgcaggcataccttggagattgtgattttgatccatatcaatgaagctaatatcacaataaaataagtcacacaacttttttcatttcacccgggcatataaacattatacttacactatactatattctacttagtgtgcaatagcattatatctataaaagcaatgtacataccttaatttaaaaacattctattgctaacatgctaacaatcatctgagccttcaattagttataatctttttgctggtggagggtcttgcctcagtattgatggctgctgactattctgggtggtggttgctgaagattggggttgcaatggcaatttctttcttttttcttttttttttttttttttttttttgagacggagtctcacactctccttcaggctgtagtacagtggtgccatctcaactcactgcaagctccgcctcctgggttcacgccattctcctgcctcagcctcctgagtagctgggactacaggcgcctgccaccatgcccagctaattttttgtatttttagtagagacgggttttcaccgtgttagccaggatggtctcaatctcctgaccttgtgatccacccgcctcggcctcccaaagtgctaggattacaggtgtaagccagtgcgcccggccggcaatttcttaaaataagacaacaatgaactttgccacattaattgaatctttctttcatgaacaattcttctatagcatgtgatgctgtttgacagcattttacccagagcagaacttctttcaaaatcggagtcaatcctctcaaaccctgccactactttatcaactaagtttctgtaatattttaaatcctttgttgtcatttcaacaacattcacaggattgctgagggattgttcacaggattgatgaggcctcattgtatgttgtcttttcttctacaattattttagttcttacttttaattcaaagattagatttaaatcctctcgggaggaaatttttttcttatgcattttttggatattatctgttgcatgtaagcatcctctatatgatttttatatcaaaacttaagcagcaacgttcctcaggagttgattttgtctcaagaaaccacttttttttttgctcatccacgagaaacaattcctcatctgttcaagttttatcatgatattgcagccaatcagtcccatctacaggctccatttctaattcactcactatttctaccacatcttcagttccttcttccactgaagtcttgaacctctcaatgtcatccatgagggttggaattaacttggtctaaactcctgttaatgttaatgttgatatgttgacctcctcccatgaatcacaaatgttcttaatagcaagtagaatggtaaatcctttctagaaggttttcaatttacctttcccagatccatcaaaggaatcattatctatggcagctatagtcttacattatatatttcataaaaaagacttaacagtctaagttaatccttgatccacgggcttgcagaatagatgctgtgttcgcacacataaaaacaacactaatatccttgtacatttccatcagcaatcttgggtgactaagtgcattgtcaatgagtagtaataccttgaaataaatcttttgagcagtagttcttaacagtgagcttaaaatactcagtaaactatgccataaactgatgtgctttcatccacccaggcttgattgttccatttttagagtacaagcaaaatcaattttgcatagttcttaagggccctatgattttcagaatggtctatgagcattggcttcaacttagaatcaccagctgcattcacccctgacaaaagagtcagcctgtcctttgtagatttgaagccaggcattaacttcacacctctctagctatgaaagtcctacatggcatctttttccaatacaagactgtttaatctacattgaaaatctgttgttaatgtggccacgttactaatctgctctcatgctgctacaaagaactgcctgaggctgagtaatttataaaggaaagaggtttaattgacttacagttccacatggctggagagacctcaggaaacttacaatcatggtggaaggggaagcaaatatgtccttcttcacatggtggcaggagagtgaagtgctgagcaaagtgggaaaagcctcttataaaaccatcagatcttgtgaaaactcactcactatcatgagaagagtagcatggaggtaactgctctcatgattcaattacttcccatgaggtccctccctcaatacgtgggtattacaatttggattacaattcaagatgagatttgggtggggacacagagccagaccatatcagccacctttatcaattaccttagctagatcttctcaataactttctgcagcttctccatcaatacttgctgcttctccttacagttttgtactatggagacagtttttttcttttaacctcatgaaccaacctgctagtttcaaacttttcttccgaagcttcttcacctttctcagccttcataaaattgaagagagttaagccttgttctttattagcttttggcttaagagaatattgtggctgatttggtcttctaaccaggagaccaaaactttattcacatcagcagtaaggttttttgccttgcttatcttttgtgtgttcactgtaatagcacttttaattttcttcaagaacttttcctttgcgtttacaatttggataactgtttggcataagatgcctagctttggcctattttggctttcaatatgccttcctcactaagctgaattatttctagctttgattttaaagtgggagatgtggaactcttcctctcacttgaacacttaagagcccattgcagggctattaattggcttaatttctatattgttgtgtctcagggagtagggaggcctgaggagaggaagagaaataggggaatagctagtcggtggagcagtcagaaaacacacaacacttactaagttaactatcctataatgggcacagttgtgtcaccccaaaacaattacaatagtagtatctaagctcattgatcacagataaccataacagatataataaaatgaaaaagtttgaaataggatgaaaattaacaaaatggaacacagagcaaatgctgttggaaatatgtcaccaatagatttaatcaatgcagcattgccacaaaccttcaatttgtaaaaagactgtcattacctatgaagtgcaataaggtaaataaagtgcaataaaatgaggtatgcctggatatctttcccacccactttaaaacatttttactgtgtattttctcatagacaatatattgtactattgcatgcactttaaaattacattaatagccaaataatgtacttaccctctgccacttttgtcagtcaagatcatgtttgcaagatttctagatatagttaatgatatgttttctacattttatagttttctagatatggatatttcatcacttattcactcggttctctagagatgaaaatttggattgtacttgttttgttttggtcttgcaccattacaaacaggattgcaatcaaaacttctatgtacattgaatgaaaacttctctagagttcatacctacatgtgaaattgttgagctcacagaaatttgccaaaaggttcatacaaaaatatttactacagcactgtttacaaagctaaaaactggatacactgaaattataccaaccaatagcagaacaggtatataatttttaatatatttatgcaatgcaattaaagagaattgtatagacgcatacgtgctgatacagaaagacgcccaaaattgattgctcagtgaaaaaaaaattaagttataatactctatataaaattatcccattttttataaaaataaatgataaaattaataatatatgtacatatttagagaaaaaatagagaccaatttaagaaattcatgttaataactatgtatgatatataagataaacttgtattttctctattttaaatttcaatagtaccagatacacattacttcaatctacacttataacctgaatgaatacataatttcttcttatcctaataatgacacattttgcttttctgaccactaacatcccttacaagactaactttttccattaattcctaaccaatttctgtttttagcacaaacaataatagtctgtacttacttacactactgcaatctccttgttgctatatcttgaaatttttcaaacttgaaattaattacattcattaccactgcttttaccaggaacccttctgactctataatattctctctcagacctgaataaatatcatattattataacaaccttctaggtcaattatgggatttcaagttaaaaatatataactgtaaaatttaaagaaggtgtgcagtgagaaggaagagttgttcattctggaaaaatatatttggatacccaatcaagtttccttagaatgtcatttacttgaaaaaattaaccattatccataaatgatactcttattcttaaagaattacaaaaattaatccctgtattatttctaaattgatcagaattatgggttctaattcagtctaataaaggtcacaaataattataaatatttagtaagctgttattcattgggcactatgtgcaagaaatagaggacatagtggtaaataatatagatgagctccaagtctaaaatggcatcaactaaattaggtggggatgaggctcttcattgcaatccattaagtgcagctcctggggcacaaatccttccatatatggacccatgaaatgaaagagacaagccatccttcttcaaaccccccaacctataatggtaggataggcacagcacaacagctatagacatcacagttctaatgggggaaaatgaaaagtaaaaaggagtcacaggggtcactgtttcaaaggagttctgaaatccagggagtaaatgggagtttcttgattaggtttcaagggcagagaataatcctccttggctctcagctccattctctgaaggctccatccttcttggttctgccctctgagtcatccttcctttttcatgaaaggtaacacatgtttgtagcttagtggttttatcagactgcttcctgctggtagaattttggggacttaaccatctcctttccttttgtagtattgtctctgacctttttagatgaagctggcagtgtttctgcttcaataaatttctcaagaactttgtgggtcttccatggatttcacagggattcacaccataaaagaaaagccacatccacagatgtttttaagattgtcccttttctatatcttggcttcctgctgagagggctagaggacaatgcccttcagcctcctagaggccctcaggtttgtgtgaaaaaatcagtgaggcacacccttaatctcttgaaaagagcctttgtactgaatacgctgacattttgatctttctgatatttttagcaaaagtcacacactctcaatgccatacttttgagtatggctatttctcaatgccatacttttggcagccatttctgaattttagcatcttttgccatctggagaggctgcgaattttcagtcacgtaatcctaatccattttctttaacatgtcttccttcaacttatctctcttttgcattctattacaagcagtaagagaaaaccagtagcaacttcaatactttgcttgaaatctccttagcactacatacaagcaagttcattgcccacaagttcttctttccataagatggcagaatgcacaattttgctaatagttctgcaagtatataaaaaggatccctctccttctaatttccaataacatgctcctcacttctgagcctaacagcagtgctctcaaagttcagatttctactaagggtctgttcatggcaactcaggctgctatggtttgaatgtgtcccctaaatttcatgtgttagaaacttaatccttaaattcatgtgttgattagaggtggggtcttgggggctaattagggttagataatgtcatcagggtacagtccccatgatggaactaacggctttataagaagaggaagagagagagctctgagctgacatgcacactcttgctctcttgccttgtgatgccttctgtcatggaatgagcctcactagatgacggcaccatgctcttggacttcccagcctccataaccatgaactaaataaacatctattgcttataattttctctgtctgtggtattctgttacagcaacagaaaatggactaagacataggcttcctctatcatgttctgcaaacatttcctagcctttgtctactgtctaatcccaaagctgctcccatattttaggtatgcctcttggtaccaaaatatgcataacatcttggtggcttaaaacaacactcagtcagtttctcctgcttttcatcagtcaggagtctgggcctggctcagtcttatgctcaaagcctccaaagctgcactgaaggtattggctggactatggttctatgattctgatctagagcttggggttctctctcaggtttactcaggtcattggaagaattcagttccttgcagctgtaggactcaggccgtcagtttatataagctgcctctctccataggcagtttacaaaatgattctttgctttcttctagcccagcaggagaccatctctctttaaagggcttacctaattaggtcaagcccatccagtaaaatctaccctcaataaccttaaatccaactgactgggggccttagttacatgcaaaaagccttttatatgcttatatccctctgagtcaggaaaaaactaccagagttctcactcccccatcaagagccccccgacacacacacatacaaacacatacctaattatagataatatttttttctaaaatacatccatatggttgtgtgattttctccagtggtgctgaacaaccttggttcagaagtaaagaatcttgacactagaactaatccaagaaaagtgggtaagaaaaggtccctaaaaggttctcaacatgaagcagcaggagaaattcagaagaggaagagagatctccatcagccacttggagtagataaaggtatcaggaccaagatatgctaaagggggcagataatcatcctgtcacagaacagaaatctcaattagaaggctttcctaaaaaaatttcaaaagaccataactgctcttaccacactttacgtaaccaagaagtggtaatcagataaatctcctaggaaagagcttatcaactcaattgagactacatttatatggagagggacagaggcagccaggcacatgagtcagctcccctgcccccagcaccaccttccactgtgaggttttcagacttgacaacaaggacaatttattatttcacattgaccaaaatccagtggttaaatgagattacagtcctgttgtattagtttcttattgctgctgtaacaaattttcataatttattggcttcaaacactcacaatattttactattctctaagtcagaactatgaaaatcaaggtggactaaaagtgtcagcagggatgcattccttctaggggctctaggagaatctgttttcttgccttttccagcttctagaggagacttgcattccttgggctcatggcctcttcctctaccttcaaaagccagcagcatatcattttcaaatctctctcctactctgagatttccaccttcatcttattaggacacttgtgattatactcagcctaccttgattacccaagataatctttccatcttaaaatccttggcttactcacacctgcaaaatctcttttttacagaaggtaacattttacaaactttcaggcattaagatgtgggcatctttcaggggtctcattttggttatcacaacttccaaatacctttctaatattcaaactcaatcatttcatttgggctgatgataaaaatgctctgtaatgttttaatgagtttgcttataaagtttatctgaaatatatttctataaattcttatattctctgacaaaatcaacagaggtgttagattgaacaaatttgattagctaatagaaattgttaagtaacatcatgttcttaaggagttgcttcaaagcattcacaaagcacctaatttatccttgcaattgtcaaataagtaaaagtaggtatcataaaagaaaatttcaagtaaggaaatgaaagcacacagtggctttcctagatctcccagggagaaattctggaagaaatatgaatagaactcagcttctcttactcccattcagtagcttaaaaggctaggaataatagttacaatgattcatactgattacctagtgcctcttctccaaagtactgcaaatccacaagagaaatcatcacagacacggtgatatgtctttggttagtttttctacctcctggtttcaacaaagctttaaagaagtatagagaacatggaacaatctgtgagaaactactccacctcgagtggttccacttgaaatgtaaataggtttggaaggtcttaagtaaacatgacttgaaatttaaaaaacatatattgttaacctgactggaaggtaaaaacaaatttagaagaataatggatgtgctgtctggaggctataattactggtgctctaacacagcagtgtagcgagaggctgggaactgcttcatgaaaagtgctggggaactggacagaaattggttggaatctcaattcttctgcttatactagctgtataaccttggacaagctacctaaactctcagattcctcatcttaaaaataataatagctgtcttatagagttgatataaaaattaaaggtactacatgtaaaatacccggcacataaaagcacttaatatctttcctacttgggaaaaaactaaaatgtaggaacagactttcctgttaagaatgtttgtagtggatgctctgttgtgctgcccagattctgcttcagagaggaagagtttattctccaagcggctggaagagctgctaatggaaagctctttgttgtcagcccctacagggatcgccttagttgaagagagccttttcacccaatgtccaccccattaagaatgacttgcctccagtgactgatcaaagagcccatcatcccagatcagaacttgccatggaattggcagaggcctctgttgagccagcctgccagttcagcttctccctcggtccaatcctgcttccttcctatgacttcccttctagaggtgttgatctcaatgccctccctaataagccctccgatatcctagtcacggttgggagtcagtttaccagggaacactatccagcaacaatgttgcaggatgaactgttgctcagacttttatatagcccttaccatcaccaaccactccccacaagggcccaaaggcacataactcacccaagtatcttttggttgctctggtaaggattgaagagtaaggattcttaagccttgaaccttgcttctgctgatgtttaacaagcagctggaataagtgtgaaccctctgccccagctccatttcaccccttctcaacatctttcatctgccagcttgtataaagattcagcctgccacattagaaatgttgcttatgtcacaattgaggaaattttaatatgagctgtatagcaaatgatattaataattattaatattgttgttcttgagctttataatactccagataaaaaaaaaaaatgaaggcggataggccgggcacagtggctcacgcctgtaatcccagcactttgggaggccgaggcaggcagatcacgaggtcaggagatcaagaccatcctggttaacacggtgaaaccccgtctctactaaaaatacaaaaaattagctgggcatggtggcgggtgcctgtagtcccagctactcaggaggctgaggcaggaaaatggcgtgaacccaggaggcggggtttgcagtgagctaagattggccactgcactccagcctgagcgacggagcgagacttcgtctcaaaaaaaaaaaaaaaggcagataaatgaaacaagattggcaaaatgatgaacattgatgaagctgggtgactggtattatactattctccctatctctgtatgtttgaacttttccataataaaataatgaatattaatatactttataaaagtatatacaatgtacgtactttagagatcaattgttaaagataggtttaataatatatttaacttcaagttggcttatgttaagcaaataaatcaaaatatagaaaattcatattctccaaagcaaataaaatggggcttgttaggcatcttgccaaatagttccgaaatttattttttttaagtgctgagactttctttaaaagaaaactccataaggcacttcaaactaaatttttatgttaaaagatttattttacatattaaagtacagcatacaggtattttgttcattatacagacttttagattatgaagactttatatgtaatagcatattatcccaatttttaaaagctcaattttctagatgtcttttttgataacaatgcatgtgatttaccataacatgtgtataaaatctagccaaaccacaccattcttcctccacaacccttaaagaagatcctatagactcaacaactgtgccacctaaggctatgtaaactttggtcaaacaactctgttgtatacacaaatatagctatatctacaggtatagatagagagatataatatatattatttatacataatgattaagaattaagaattaggtcaaaaatcacaacaagaaaaaaaaaagtagtatctgattcaggtattcagtctgtgtagagtggtactatttttgccaatcctcaaatgtttacttcaagtctgctatgatgagaaaacccagaaggcctaaatatataacacaaacatgtttcccatctttgtatccttctatgtttgaagatctttccgaatgttaaggtctcatccatttaaggtgatttgatccagaacattggggaatactattattcagaaaatgattcttcttaaagggacttgattatttcaatgatcatagagctgctctaagggatttctatagccaagtcattattatatccaggtacttttcatataaataagggttcaagcatctgaaacaaaaaagaaggaaatgaagtgttctaaggacaaagacaaatggtgtgagttaggagctggtctaacagcatataaagcctgaattttccaaagtattttacctgactctctggactaccccccaaataaacaaacaaacaaaccaataaaatccaaatatgtataaaacatatgcatgttgagcctagtcctataggaaacatgacaggtttgagaagaatttgatgcaaaataaaatgggatgagatgtgataacgatcaggaaaattaggatctagtactagatgtgcactaactaagctctatgaccctgggcacttcacatcttggctctcagtttgtctctctgtaagatggaggtcccttacagctattatattccaagattaagaatcaagtatgatactttcaatattaataagtaaccataaaaattttaagcaattggattaataccatcttgaattgaaataaaacaataaaaaatttaaaatttttttctaaaagttgaaaataaatgttttttattatatgagtttaggtttccaaatatgtttttctcccatactacattttcctatagctttgtgaaataatatgagattaatcttatgccaggcagtccagtgggtgctctgcaaacttggctctagaggaacttgataattcagatataagccatgcaattttatatttcaaatcaaaactatctaatgtataattaagttaaaattcaacagttacagtctagaatagccatcaattcagttttaaacacagtgtataaaattttaagtcctgcattttaggtacttgtgggctattcagcagggaaactactttaggctagtgagataaatataaaatttcatgttgtaatataattttgaggcagcattaaatgggtaaaattcaggtagtaagcctaaaaatccaagataactatagagataaataattatttttgtaaattataataattcccatatctgtgataataatagcaactacagatttgtataaggctttaatttatacaaataaatctgtttcaattattacaaatgtaatacaagatacatataatatgtatcgtgtttacattcttacggtatattttgaatgtgttacatcatttaagtaataacataatttaggcattattatctttattcattattatcatctccattttatggatatggaaattgatcaaataaaactttaaagagcaaacaggctgcctgaactggatggagagatcatggtgctaaccacatcaaggttagttgttaagtttctcatcctagtggagtctcagtcagataatcataatagaaatggaaaatgtatttaggccacaaacagattttcagcatctattgatttactaatatagctttttgttccttaatttattgatgcagtgaattactttgattgagttgctgctgtttaaccacctttctattcctggagtagattctactaggttatagatattatccacttattaaattgctgtactctcttataaaaatatctagacatacattgacatatgagatgattgatttttttaaaaaattggtattatcttaattggatttagggatcagcattatattagcttcaaaaaatgaatgttttatctttttctattgccaggaataatttagaatttatagtgatactcacacaccatgatcactttcttttctctctttattgtatgtatctgaaaaatcctaaccatggctaaatctaattccctgcctattcagagcagcttaacatggttgggggaaaattaagtttcctactctttatgatgactatttcagaccttctttcttctccagcacacaatgccccacatcactctcaatcaataatcattattatttcactgaaaaaataaaatagaaaaaaaatcctcactcttccagcagtaaatcagaaaatctacttgtatcaggatgtatatactctcatttcactccttggcaataaatgaactgtccatgttcctctagtgaagtcaatacgtccacctattcactgggtctaaactttgccttatcaggacttcgctactcaaaaaaaaaattttttttaatttctcttttttatcatttttttcacttgctacttgtaagagatattccagtctgcctttcagatttctcctcaagatagtcactaatttcccccaaatgccagaagtgttgcctacagaggtttacaggaattgccttgaccaacatgacaccacacatccagtgttttgtcagtgggtttattcaattccatggcctcagttgagttttctcttaagggtcatctcagtttcagaggtacataaagaatccaatgaaatctctgttacagttacatcacagttcaacttcttttgttccaccttattcctttcactcctttactgtattgttcccgagagcacttcccaataaatcacctacacgtaaatcttagttgtagagtcttttttttctgggaaacctaagctacaaaagttgttgccagggaattggataaaatcttcaatagtaagacattcagtagagaggataaattagtcctacacaacaggctgctatggaatcatcttagcaaagctaaaaagccattgttatacagataccaaaatcagacagactttaatgaaaacaacaggccaatatctttcatgaatatatacacaaaaatcctaaacaaatattagcaaataaagctcagcaatatgaaaggaggataatgcattatgaccaagtgaggtttatccctgggaatgcaaggttgagttaacatttgaaatcaatcaatgaagttcctcgtattaaaaaaaaaagaaaccctataatcatcttcatagatgtggaaaaggcatttgacaaaatttaatatatattcatgatgaaaaactctcagcatctgaggaaaagggaaactttctcaacctgataaagggcatctatggaaaccttacaattaacaggacaatgatgaaaagctgaatgttttcctcctaagattgagaaaaagcaagaatgcctactttcaaaattccatttaccatcgtgccagaggttctagccagtacagtgaggcaaactaaacagataagaagtatacacatcagaaagaaagcaataaaattatctttattgacagacattattatcacctacatacgaaatactacagaactttaaaagctactaaaactaataagtgattataccaaatttgcaacatacaaggtcaatatatatcagtaaaccattggacagatcctccaaagtcttaaaggcagccagagagaagaggcatgtcaaatgcaagggaactccatcaggctaacagtggtcattttagcagaaaccttacaagtcagagaggttggggacctatagtcagcatccttaaagaaaagcaattccaaccaagaatttcgtatccatacaaactaaacttcatacgtgaaggagaaatatgatcctttccagacaagcaaatgataagggaattcttaccaccacgcctgccttacaaaatgtccttaagggagtgctaaacatggacatgaaaaagcagtactgtattagtctgttttcacactgctaataaagacatacccaagactgggtaatttataaaggaaagaggtttaattgactcatggatccacatggctggggaggcctcacaattatggtggaagaacaagggatgtcttatatggcagcaggcaagagaaaataagagccaagtgaaaggggaaaccccttatcaaatcatcagatctcgtgagacttattcactaccacgagaacagtatggggaaaaacacccccatgattcagttatctcccactgggtccctcccacaacacatgggaattatgggagctacagttcaagatgagatttgggtggggacacccaaaccatatcaagtactttccaccaaaaaaatacactcaagtacaaggccactgaaactataaagcaactatataataaagtctacataacaaccaggtaaaaacacaatgacaggatcaaacacacacacatcaatactaaccttgaatgcaaacaggctaaatgccccaattcaaaggcacacagtgacaagttgggtaaataagtaagacccagctatgtgttgttaagagacccatctcacatgcaatgacaccgataggctcaaaataaagggacggagaaatatctatcaagcaaacagaaaacacaaaagggcagaggttgctattcttatttgagacaaaacagattttaaaccaacaatgatcaaaagggacaaagaatggcattacataatgagaaagggttcaattcaacaagaatacttaactgtcctagatatataggcacccaacaccagagaacccagacttataaaacaaattattacagacctacaatgatacttagataaccacacaataatagtggaagacttcaacaccccactagatcattgagacaaaaaattaacaagatattcaggacctcaactcaacacttgaccaaatggacctaacagacatctctagaatacttcacccaacaacacaagaatatacattcttctcatctacacagcacatactctaagatcaaacacacacttggctgtaaagcaattctcagcaaattcaaagaaaccaaaatcataccaatcacactcttggaccacagcacagtaaaaatagaaatcaataacaagaagatctctcaagaccacacaattacatggaaattaaacaagctgcttctgaatgacttttgagtaaaagacaaaattaaggcagaaatttaaaaattctttgaaactaatgaaaacaaagatacagcatgccagaatctctgagacacagctaaagtagttttaagaggacaggtttttctttttttcaagttttattttagatttagtggatacatgtgtgtgcttgttacctaggtatattgggtgatgctgaggtttggagtataaatgatcccaccatccaggtactgagcatagtacccaatacttagtttttcaactctcactcccctcactatctcttccatctagtagaccctagtgtctactgttgacataagatgaaagtttatagcactagaaacctacattaagaagttaaaaatgtctcaaattaacaaccaaacattgcacctagaggaactaaaaaaataaaagtaatacatgcaggaattttgtagaggggagtttaaaaaagcagcagaaaataattaccctgaatctcaagacctagaaatactgatattgttttgatatatttccatccagtctttctctgagttttttttacccagttaagattatactgtgtacatgcaattttctgtcctgctatttcacttaacaaatgtcttaaacatttctccttgtcattaaaaactctctgttcacatcaaataaataaataaataaataaataaataaataaataaataaaagcaaaccaaccccgatgctagcagaagaaaaaaaataaacaacatgacagctgaactaaacaaaactgagatgtaaaaatccatactaaagatcaacaagaccaaaactttgttgaaaaaataaataagatcaatagactgctggatagattaattaaaaaagagagagaagatccaaataaaaacaatcagaaatgacaaaagggatattaccaccagccccacataaatacaaaaaaaccctcagagacaattataaacacttctatgcacagaaactagaagaaatgtataaattcctggaaacatacaacctcccaagactgaaccaggaggaaactgaaacactgaacacatctataaggagttccaaaactgaatctgtaataataaaaataataaaccctaccaacagaaaaagccctggaccagatggatccaccgctgaattctactgcatgtataaaaagctggaaaccattactattaaaattattcaaaaagaattaaggaggagggactccttcctatctcatcctataaggccagcaccattttgaaaccaaaacctgacagagacgcaagagaaaactacaggccaatatctctgatgaacatagatgtaaaagtcccaaactaaatattagcaaaccaaatccagctgtgatcaaaaagttaattcaccccaatcaagtaggcttcattcctgggatgcaaggttagttcaatatgcacaaatcaataaatgtgattcaccacaaacagaagtaaaaataaaaccatatgattttgtcaatagacatggaaaaagtctttgataaaatccaacatcccttcatgataaaaaccctcaacaaattagatatcaaatgaacatacctcaaaacaacaagagtcatctatgacaaacccacagccaacatcatgtcaaatgggcaaaagctggaagcattccccatgagaaatgactgcacacccactaaccactcctatttataacagcactaaaggtcctagccagagcaatcaggcaagagaaagaaataaaagacatccaaataaaaggagaggaagtcaaactatttgtctttgcagattatgattctacacttagaaaaccccacagtctctgcccaaaagctcctagaataaacaacttcagcaaagtttcagaatacaaaatttattacaaaaatgaatagcatttctatacaccaataatccaagctgagagacaaatcaagaatgcaatcccaatcacaacagccacaaaaagaataaaatgcctaggaatacaggtaaccagggaggtgaaagatcactacaattagaattacaaacactgctgaaagaaatgagagacaacataaacatatggaaaaacattccatgctcatggataggaagaatcaatatcattaaaatggccatgctgcccatagcaatttacagattcagtgatattcctgtgaaactaccaacatcatttttcacaaaattagaaaaaaatgattctaagatttatctggaaccaaaaatgaagtcaaatagccaaaacaatcctaaacaaaaagaacaatgccagtgacatacattacctgactttaaactatactacaagtctagagtaaccaaaacagcatggtactggttcaaaaacatatacacagaccaacggaacagattaaaaaacccagaaataaagctgcacacctaaaaccaactgatcttcaaaaaagttgacaataacaagcaatggggaaaggacaccctattctataaattgtgctggaatagctgactacccatatgcagaagattgaaactggatcccttcctttcactatatacaaaagtcaactcgagttggattaaacacttaaatataagacttaaaatgtttaaaactttagaagaaaacctgggacgtatcattttggacataggtctgggcaaagacttcacgatgaagtctccaaaagcaatggaaacaaaaacaatcaaagataagtgggatctaattaaactaaagagcttctacacagccaaagacactattcaacagagtacacagacaatctacagaatgggagaaaatatttgcaaactatgcatccatcaaaggcctaatagctagaatctataagaaacataacaaaatcaacaacaaaaacaaataaccccattaaaaagtgggtaaaggacatgaacagacacttccaaaaaggagacatacatgtagccaacaatcacatgaaagaatgcttagcaacactaatcatcagagaaatgcaaatcaaaaccacactgaaatacaacctcatatcagtcagaatgactattattaaaaaggcaaaaaatgacagatgcttgcaaagttacagagaaaagggaatgctcatactttattggttggcatgtaaattagtccacccatagcagaaagcagtctggaaatttctcaaagaatttaagtcagaactaccattcaatccagcaatcctattactggatatatactgaaaggaaaataaatcgttccaccaaaaaaaaatgtacactcatatgttcattgcagcactattcacaacagcaaagacatgaaatcaacctaaatgcccatcaatggaggactggataaagaaaatgtggtatacacaccattgaatactatgcagccataaaaaggaatgaaattatgtcctttgcatcaacatggatgcagctagaaaccattattctaagcaaattaacataggaacagaaaaccaaataccacatattgtcacttataagtgacagctaaacactgagtacacatagacacaaagcagggaacaaacactggggcctacttgagggtagagggttggaggactgtgagggttgaaaaattacctaccaggtactatgctcactacctgggtgacaaaatcatttgtacaccaaacaccagcaacacacaatttacccatgtaacaaacctgcacatgcacccctgaacctaaaagttgaaagagaaaaaaaattaaaaattaaaattaataaaatcatttataatatgttcaaaaatatgacctattagggataaatataatgacagaacattgctcaaagaaatttgaaactggagaacattatgttatgtgaaataagccaggcatagaaagacaaatattgcatgtatttactcatatgttggagctaataaaaatgatctcataggggtagaatggtggctaccagaggttgggaagggtagcgaagcgggggatggtgaagagaaattggttaatgggtaaaaaaatatggttagacctaaggaataagttctattgttcaatagcacagtaggatcactatagttaatgataatttattgtatatttcaaaatagctagaagatttaaaatgttcccaatacatagaaatgatcaatatttgaggtaatgaatatcccagttaactggatttgataattacctggtgtttgcatgtaccaatgtgccacatgtaccccacaaatatgtacaatcattatgtgccaatttaaataaaaatcaagtcctaaattaaggtagctatgcatgatgttcatggatagaaaattcattatttataagatgccaattctttccaaattgacctatatattcagtgcaatcacagtaaataccccaggatttctataatttctatatattatagaaattgatgggctgattctaagataaataaggaaacgcaaagtacctagaacaaccagaacaatttgacaaagaacaatattgggaaattaacactatttgatttcaagacttaatacaaaagtagagtgatcaaaactgcatgggttttgacataagaataggcacagagatcagtggaataaaataagagtgtccagaaataaactcaccagatgtgaccatttgattttctacagtgacaccaaggtaattaaataggaaaataatgaaattttcaacaaatggcacagaaacatttggatatccaaatacaaaggaaatgaacctcaaaccttacaccatatataaaaaagtaacttaaaatgtaaaatagacttaaatgtaggccctaaactaaaatttctaaagaaaaatatagggtaaaatctttgtaactttggcttgggtacagatgtctctgaatacttaaagcacaaatcataaaataaaagactgataatttgaaaatcaccaaaataaaacatcatttcttcaaaacacactgttaagaaaatgaaaagtcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatggcgtcaacccgggaagcggagcttgcagtgagccgagattgcgccactgcagtccgcagtccagcctgggcgacagagcgagactccgtctcaaaaaaaaaaaaaaaaaagaaaaaagaaaatgaaaagtcaagccataaacttggattaaacatacatctgataaaacacttgtatcaaaacacataaagaattcttacaactcaataataagactaactggtttttgtttaatcattgaaagatataaagatactttataaaagaatatatatgaatggcaaataataagcacaaaaaagatgcttaacatcattgatcattagggaaatgcaaataacataccagaacatactctttagaatggccaataataagaatatgaacaataccaagtgatggaaattattgaatcaaccagaactctcagacattcctgatgggaatgcaaaatggcttagccattttggaaaacaattcagcagtttcttttaaacatatatttaccataagactatgtaatcccacatctaggtattttttaaaaaaaaaagacagagatgaaaacatttgtccacacaaagacttgtacttgaatgttcaaagcaacttttttcataatagccaaaaaacaatcaaatgttcatcgactgatcaatctaaaaacaaactgttcaatatccataaaaaataatgctactcagcaatgaaagggacagacaactaatatgtggatgaacctgaaaacattatgctatgtgaatgaattcaggacacaaaagaatgcatagtatctggttctattagtatgtaaatgaagacaacgcaatactatgtgatctgtgaaagcaaacagatcaaagattgcttaagtcaagataatgaggggattgattgcaaaggtaaataagggaatgtttttaagatgacaggaatgctctaaatcttaaggcaaatctttgacagttatcaaacctcatcaaattgtataactacaattcatgaatttcattgtatgtaaatgacatgtcaataaaaaaaatcaaaagtatcagacaccaaaataaatattcaaaatttatttttggaaaagtgttgatggctatattttacaaaatatttcaccctctattttcctgaaatacctgtccccctttggtgtacttatattatttgatttacatgaagctttgtaggaacacctctaaatctagatatgagaaatgcttattgtaccactatctaaaattgtgttttgtcacaaaccaagtgctttaagatctaaagatggtgaaggatacaacacatacagtctaccctggaagactatgtcattggtttttttgttgcacatacagtacactctattgctttgggatcaccaaaattaatcacttcaactaaaggtacatgttggtttttctccattccaagagagtaacaacacaactgattattcttagtgtgtgagctgagtaatgaaaaacctacagaaacatgaatataaatggaagtatataaactgtcatttcttaaaagtaggtcttcaggatagaatggggaaggaagaattacaataattaattgtaaacatttaagattctcagtgtgctaggtactgtgcataatgcagtggctataaattaatgaatggtactgatttgaaccacattatacctatttttctttatatttccaacaaatgactaacactattttatgatcagttctttttccactggaattactccattaataaatgactttttagatcaaatggctgtgaagtaagttaaaaaatatgaaaatcatatataagcaaagataaattcagggtgcttcttttttttcaattaatgccaaattatttttcaggatatgcagcattttataaaattcctaggcaagttaaagcacagatcaacaaatatttatgaaactcccatattctacaacactatattccatatggtaggataagcaacagaaacagtgtgggatccaaaggactttaattttaattgaggaactaaaacacaggtacatagattcgcatatatgttattaatgccatttcttcacagcaatactggcacatgcctgctcccttaaattactttgcctattcaaaattacctgtcaatgttagagttggcctcttgaggcccatttttctgaaaaaatgaagtgtatcattctgctcttaaacagagactctagagcccctttttcctttttcacaacagggttcattttagaaaatgtgtagctgccagatatgacaatgtaaaaaggtaggcagagaaggagataaacacagaaagaacagaaaggtgaattaggcatttaacaatttattcagaaaaatgtgccagcacctcaattttataaagtcatgggcaaaagcttatgaaaattgatttagcaaaacaaagcccagggaaatacaataatgcatttccaacttcacatggcttttatgtgaaattcttctatattaaaacatactataggccaggcaccatggctcacatctgtaattccaggactttgtgaagccgaggagggaggactgcttgagcccaggagtttgagatgagcctggtcaacatggtgaaactccgtctcaatgaaaaatacaaaaattagtgggtgtgatgctgcatgcctgtagtcccaactactgggaggctgagttaaaggattgtttgagcccaggagaccgaggctgcagcgagctgtgactgcatcactgtactccagcctgggtgacacagcaagatcctgttttgagagagaaatatatatatatatctgttctcacgctgctaattaagatatacccatttataaaggaaagaggtctaattgactcacagttccacaggggtgtggaggtctcacaatcatggcagaaggtgaatgaggagcaaagtcacatcttatgtggcagcaggcaacagaacatgagcaggggaactgccctttataaaaccaacagatcgcgtgagacttattcactatcatgagaatggcacaggaaaaacctgctcccatgattcaattaccttccactgggtccctcccatgacacatggggattatgggagctacaattcaagatgagatttgggtgaggactcagccaaactacatcatccaaactatatcatccccccggcccctcccaaatctcatgttctcgcatttcaaaacacagtcatgcctttccaacagtgcctcaatatcttaactcattccagcattaactcaaaagtccacagtccaaagtctcatctgagaaaaggcaagtcctttctgcctataatcctgtaaaatcaaaagtaagttagttacttcctagatacaatggaggtccaggcattgggtaaatacacccattccaaatgggagaaattggccaaaatgaagggactacgggccccaggcaagtccaaaatccagcagggcagtaaaattttaaagctccaaaatgatctcctttgacgccatgtctcacatccagggtacactgatgtaagaggcaggctcccatggccttggacagctccgcccctgtggttttgcagggtacagcccccctcccggctactttcacaggccagcattgagtatctgtgacttttccaggcacacagtgcaacctgtcagtggctctaccttctggggtctggagaacggtggccctcttcttacagctccactaggcagtgccccagtgcggactctgtgtgggagctccaaccccacatttcccctccacactgccctagcagaggttctctttgagagccttgtgcctgcagcaaacttctgcctggacatccagaagtttccatacatcctccaaaatctatgtgaaagttcccaaacctcaattcttgtcttgtgtacactgacaggaccaacaccacgtggaagttgccaatgcttggggcttgcatcctctgaagccatggcccaggctgtaccttggctccttttagccatggctggagcagaaatgcagggcaccaagtccctaggctgcacagagcagggaggccctgggcccagctcatgaaatcattttttcctcctgtctctgggcctggatgaggggggctgccacagaggtctctgacatgccctggagacattttccccattgtcttgatgattaacatttgacttctcattatttacccaaatttctgcagctggcttcaatttctcctcagaaaatgaatttttcccttctattgcatcatcaggctgcaaattttctgaacttttatggtctgctccccttttaaactaagttgcaattccaaaccatgtctctgtgaatatataaaactgaatgcttttatcagcatccaagtcacctcttgaacagtttgctgcttagaaatttcttccaccagataccctaaatcatctctctcaagttccaagctccacagatctctagggcaggggcaaaatgccaccagtctccttgcatagcaagagtgacctttactccagttcccaacaagttcttcatctccatctgagaccacctcagcctggaccttattgtccatatcattatcagcattttggtcagagccattcaacaagtctctagaaagttccaagctttcccacatcttcctgtcctctgagccctcccagtctctaggaagttccaaactttcccacattttcctgtcttcttctgagccctccaaactgttccaacctctgcctgtaagttacttccacatttttgagtatctttacggcagcatctcactctactggtaccaatttactgtattagtctgttctcatgctgctaataaaggcatactcgaggctgggtaacttacaaaggaaagaggtttaactgactcacagttccacatggctggggaggcctcacaattatggcggaaggtgaatgaggggcaaagtcatgtcttacgtggttgcaggcaaagagtatgtgcgggggaactcccctttataaaaccatcagatctcctgagacttattaactatcatgagaactgctcaggaaaaacctgcccccatgattcaataacctcccattgggtaccttccacaacatgtaagaattataagagctacaattcaagatgagatttgggtggggacagaaccaaaccatacacaaaacatatatatatatatttgctactaagaggattttgattgattgtactctattattggtaataattagacaaagtgggagctaggaacaggaaaacaaaaagaagataaagcaaatggcagagcagggtaaagaagctttttcatcaatattagatcttactactttttgtctaataagaagaaaggttcctgccacatacatgaagtatgcttccaacatatcttaacatcatttcactaggattaccctgacactgaggtggtggaagagtggaagtcagtaatcacaggtcctaacattgaaatttgacacaggaccttatgaaaaagccctcttggtatgaatataagctgcaaaaaagtaaaatagatgtatagcaatgaaactgaggaaaatagaaagcctaagaagtttctaatgatcaagtgattgccaaggaatgattttacaatgctcattattgttcactaagatgtgtaatatgtcatctctaacctctgtatagaatgttcagttttaattgctctatcttagcgaatcaaacttctatatttgataaggtcttttctaaatttacttgtgacttcagtaaagagaaaatgggtcctaaattagggtagtagcaatgaaaatagcagatcacataaaatgctgtgttctcacttcataagggtagatggtactgcctcaatacaatttaggggcgaatataaaaagtttcacatttgtacatgttgccatatgacacactttcagtggattcagaccaagatttttataccataagtagttttacatgggatctttagcacaaaaaaaatgacctaggtaaaaaatagttaaatccatgagatagaattggggtgaatatcaacatggagggattgaaaggataaggaggagtatccaatagagcagttaagagaagaaacacaagaaaaaagtgttacagaagacaaaggagaaacaggggtggttagaattgttcttcagcctagatgtacgagttacattgagtcagatattatgacatattacatagcctttctatagtggagaaagtcttgtaatattaaagggaaatataatgaaacagtgcaaagttaatacagaagaacaaatatctgaaggttttagctctggaaacagaaaaaaaaaacagtaaaatgctacaccactggttcaagacaaattacagtgcacataaaaatgctttgagctaaacactcttagaattaataaactgtctggttattcaatataaattcacttgatttataccaaagattcatctgcattctacagagggaaaaaatccattttctcttctctttctaaaggatttctggactctgaaagaaagtctatgatgattaataaaagtctgttagaaatttgtgttcagagaaaaaatgtaatcttttttttttgtcttttttttgagacagagtctcgctctgtcacccaggctggagtgcagtggtgccatctcggctcactgcaacttccacctcccgggttcatgctattctcctgcctcagcctcctgagtatctgggactacaggcacccgccactacgcccggctaattgaaaaaatgtaatattttgtacataaagatgatattacttccaggccaactatcagccaaaatggttttgaatttttttttattctatggaaggtacaatttatactgaattttctagaactttcctatgtgaagcatatcatacactaattaaatggttagctggagatagggacatggtgtatggcctgctccaggctttctccactttcatcttatcttaagtttagtgccatgataactgccacatccaaaaataatttaacagagatcatattttagaaatattaaactgatatatttttccatttcccctaaattatagtgacttgcatttccctacctattttattaaataacctatcagataaaattaagacaatctctggacagtgaggcttgttactcattttccctggcacacactacaaacacttcaaactctcctcaaagtagtgctgtgtctaccactttatggtactgcccaggcagtgggatcgaaatggtttagagagtcatctgagtagagaagacctgaaatggtctctctcaaatctcccacagtcatagagatggggtgaagaaccagaaatgtatatggatttccaaggccttttcaaaggtgaatggaacatggttgaaaattaacagtgagctcaagtgcttaaggtcaccacgttactactttgagtcaagatatgtttgactgtagagacaggtttatctctcttttcctcagaagcctataataatttccaactacctatttttataaactaaaattatttcatctgaagttccccttccccaggattttcaatcccttgattccacaacatacacatgtacttctgatctccttaatcgtctctacttctcatttaggttcccttgctcctgccaggctcctttccattaggtcatctatattgccagtttcaaaacctggtaaaattacctaaattatgtcttaatgaagtataacttaactttctggaaaacaacttggcaatctatacaaaagccttaaaaaagatactaacctctgtccaatgattccatttttctgagcaaatataataaaagatacagagcttaatgcataaagatatccatcagaacataattcagaagaggaaactaatggaaaccacctaaatgaatgtatggtacaatagggcgactatagttaacaataatttatagcatatttcaagataataaaaagagtgaaattagaatgctcctaacacaaaaaaatgataaatgcttgaggtgatagacaccccaattaccctgatttgactatgacacactatatctttgtattaaaatatcacttgtaccccataaatatgtgcaactattatgtatccacataactaaaaataaaaacattttttaaaaaagaatctcagtagggtggttagtcaacatggtacatttctataatcaaatattatgtaatcattaaaacagttacataggaatatactaaaaatataatgctgaaaaaagtacagtatgtatttattttaaaaattccaattttgagcacatataaacatatatagatatgtgaattaatatgaaaaaattcacaaaaatgttaactcatgtgtttattttcagtgctcattcatttaaaacattcactcacacccacacccacccacacacacacacacacacacacacacacacacgcttatttaccatctaacttctctaaacaaaaaaggcatagtccttactctatggagttgccggtctaatggggaaggtacatttaacaagtaattacaacagattatagtaacacattccctttttcttaattatctgtctctattataactgccaactccatgatggtagagatcctatttctcatgtctgtcccttgcatccacagcatctaccacagcgtacaggatcataaatatttcatgaatgtagaggaggcccagagactaaatgggagcatattagcaggagggcctaaaataactcaggaggtttgaaaacttttttgagggcaagtgccatttaaaataaactctaaagaaagaggaagaactagccaggtgaaggaggttgaaaacactgctcaaggtagaaaatggctacaggtaaaagaagtggtgttcactgaattcatagactcaaacagtggttatttccgaataagggtttgtaggcaatttctttttcaaatttacttcagtgaaggcgtatttttgtgtccatcagagaaacaatagtctaaactaaacagattttaaaatctctgacttctcagagatcaccctgattttacatgtttattttcttactttgaactgtctctatacatacaatatggaacaaattattgcaaattcagtgtcctactttagaactatcttatacttcctcctatattttaagttctttcgggtaaagaatattttttttttcctttcctttatttggtatcttccatagcactggtattgtgctgtgtacccagtatgctgtattttaaagttaaataattatagtcgagaatactgatcttattatctggtggctagtttttgttccaatgactttacagagttagtcccagagaaaccaatgagaattatgaaattttcttttatataactttaaaaaatttatctcgttcgataaaaatacttcataccgaattagaataaaaattaatattatttattatcctaaaatctcagagacagatgtttttatttttttccaggataaagagcaaagaaaaatattctgatggtcaaagtaaccatgactacggttttcagacttataacaagtgttattttcatacactctatattggtaaaaataatatattcttataaaatatatttgtggtgaagcttacttttatactgcaacaaaattcttaaaattattcattaattctaccatcagtagcttctagggtaactatttttccagtaaataccatagtgtggactcttgagagaccagaagcggtccctgcccccgaaaatatgtaaaattgccactctggttactactaagaccataaatccattttaccattgttacctcgattctcaagggtaaggaataattctcagcttccccattccaggcccatatctaaagggtagcacaagtttgataggggctctcttcgagaaagaggaacagtgtggcattagctatgttactagaaagacccaatccctagtcaaagccattgagtcttgcccctctacataaatggatatagaccctcacatctagagctgcattctaggctattaaacaatctttttcaattgctgttgctggtatctaaaatttcaaattatctttagacaatgtttcagcttctatgataacatttcagaaacagagcaaataatgtgtatggtttatttaaactatactcaaatgtactgaaaattggttcacatttccaaagaaactctgtgaataagtacagcatgctattatactttaagactgtcattctgttcatactaatataatggtgactttattactagaaacaagattttctctatctgggtaattttagttctgttcattttagcaaaattgtaatgactagaaccatcttggtggttgatctaaagcacacgaaatgctctttattttgccagctacaaacatgttaatatgaaatgcattcacagaacggaaggacagttcctttctaaagtactacggtttgaagtgaatagtcctatcatggcaaagcacaagtggaaggaaactgaccattaggtcactattggatggtaagggtatttcattccactatccaccccacaactcaaaagaggaatctgacctagtggcttactagagattggaaatgaaaaaaaaaaaaggtgaaaagaatttatttttatttatatacttggccagaaattagagagaagcttttataatacagatatcaaagggttctgaagaaaaagacatggagaaggactgaagagaagagaaagaagatgaagacaataacgagaaaagaaaaagaatgttagactatgaaagttttttcaatgaaaagagtcaaactctgtcaaatatttgaagagatttattctgagccaaatacgagtgagcaatggcccatgacacagctctcaggagatcctgagaacatgtgcccaaggtgctcagggaacagcctagttttatacattttagggagacaaaaaacacatcagtcacatacctgaaagatatacattggttcagcccaaaaaggtgggacaactcaagggaaatggggggtgttccaagctataggttgattaagaaattttctgatcagtaattggttgaaacagttattatcaatagaaatgaatgtctaggttatgataagggtttatggagaccaaagttttattatgcagatgaagcctccaggtagcaggcttcagagagaacagattgtaagtgtttcttatcagatttaaagagtctgttctatcagtagttcaaaaatagaggagagtataatgaggcacgtccatccctcaacccccatcatggccagaaccagcttttcaggttaaatttggagtgccctggccaagaggagaggtccattcagatggttggggttgggggggtcttataattttatttttggtttacagtcctcatgaagtacagtgatataataatcaaagaaaacattaattttggtagtcagagaccaaatacagatgactgcagtcagaatcttgtgattctgaattttagtttcctattgaaaaaagtttgaaattcagaagcacaataatataatttataaagaatacctaaacttacttcattaaggaaatgggtaggcatcaaggaatgaacattctctgcaacaaataatacactatggcaaataatttaatgttaaggtacataagaattcttctcatccgaatactggatatcaataaaagaaaacattgattgatttcaacaaatgatccttaattaaaacaatcgaagcgataaagaaggaattatcaaacataaattgctaaactagtagcagacagcttttacatttagcttcatttgttaaatgaagtaaaatgcctatcttacttcaaagaatgttttaaaaattatatcagtaggattaggttgtgacaatagcatttaaattccatgagaacttattataaggaaactgcctaccctgacatttcctccatggtaaaagaaaagcattcttatttataataaataaattttctttagtctttttcagtttacaaagtgcctgtatacacattatcatttatgctgacaagcagctggtgcagtgggtgtttttttttaatctccgtcttgacagagagcagcaaagcacacagtcttagatgctagaatccatgatctatcactgaatagtttgtgacttcaggcaagttatttaaactctctaaatctcattctccccctatctaaaatgggggtatttatctgcctcatagggttgttataaagactaaattaaccaataactgtgaagtgcttaaactgtcaagtgctggagttagctgttattactacagataaaactgaagtggtcctgaggatgaggagaaattggaaacttcgtgtactgttgtaagaatgcaaatttatgcagtcattatgaaaaacagtatgaaatttcctcaaaaaactaaaaatagaaccaccatataatttagcaatcccacttttgagtatttatctaaaggaaataaaatcagggtcctggaggcacttgcacaatcatgttcatcgcaacattattcattaacagccaagatgtagaaacaacctaaatgtctatcaacagatgaatattttcatcagaaaaggtgatacacagacacacactcatacggtggaatattattcagcctttaaaaagaagtaaatcctgcaatatgtgacatggatgaatcttcaggacattatgcttagcaaaatacaccagtcacagaaggacaaatactacatcattccacttaaatgtgaaatctaaaatgatcaaactcacagaggcatagagtagaatcgtggttggtacgggctggggagaggaagaaatggggagttgctattcaatggatataaagtttcagttatgcaagatgaataagctctagaaatctgcagtacaaataccatgtttatagtcaacaacactgtactgtacacaaaatttgttaagaaggtaaatctgatgttaagtgttcttactataataaaaaaaaattatggttcatagaactggcctaaaactacagagtaaataatcagaagagtcaggattcaaattctaatcttttacataaggtcaagtgactttaagtaaaccttaaaatctaatccacattagttaaagcaatatgttattcctgaaagagcatagactttggtgcagacttaggcacaaataatagtttaactcatcagtgaaatagagacataaatacctaacttgtatagtcatataagaattaaatgagaacagaaactccatgagaccaaaatgtaagaactttataaatttaaaattgatgtcttgcaatatgtggcctcactgaaaatattttaagaggtccctaaacctataatgttatggttaccagccacaaaagacatatgagttagtaagatcttacaagattgtttccttaatgcaatagatgctaatatttggacaagcttcaatgagaatttactctcgtgttattagaaaattgtgtgaaaatagtatgaattgttccaattgcctgtatattttatatattctttttctagtaaaaaatgaaaagtaataagatgaatattttattttaaatgctgaaatgtacaaaacacatttttcagaaaagaggaaatcttattagtattagtatgtatcaactcattttagaaaatataaaactaattatgtccaactgaacaaattaacaccatcatagtctagctaagcattccaaggtcgttcctttaattttatgatctcgcacattaactcatattaaagaaaagaagattcaagtaaatctacttgggttaaaacatgcccctgtataatacctcttaacacctttaaataaatgattcaaaacaaaatacatatgctttgtgcatagtacatagcatacatcttttattgtactaaaatatgcaactaatccttcaattcaaccactacattattcctggggaattttctcaccaacttttgaaattacaacctaagtttttgtaagtatccaaaaatcaacacagtttggttcattggcaaatgtttgtgatatcaatttaaatagatgcatggcatctgtgaaatatgagatgctgggctccacagctagctatgaaataattttaaagccagaaactaccttgccaaaacaaattagttggtagactcttcgatctgaataacaatgtatatttttattttcaataaatagaaatatattaaatttctagcactgccacaacaaactaccataaattgagtggcttaaaaaaaacaaaaatttcctatctcagttttggaagctaaaagtataaatcaagatgtgagtagaaccatgttccctctaaaggctccagagaaggatctttccttgcttctttcaatcttctcatggtatcatcaatccttggtgttccttggcttgaaggtgcattaccccaatctctgcctatatactcatataaacctttttcctgtgtgtcctgtgtgtgcctctgtgtcctctcctcttgttataaggataaaaaatcatattggatttagaacccatcctactctagtatgtccgcatcttaactaattatacctgcaaagcccctacttgcaaatatggtcatattttgaggttatgatgaacatgaattttgacctagtatgggggtaggtttatgcttatttcatgcaattttaatctttaaagtatgtttaagctgtaaaattctgtgattccataattgtgagaccaaaaaataaactttgtctagcacaaaaatgcacaagttgttttctcaaaattagtgattttctcataattaaaatgtttattaccaaatcagttaatcctatatgtaaacattacagtacttcctcatgtttctggactttactcatgtaggtctttaatttcactacgctacttttacctcaggatagggcaaaaaagagaagtaaggaagcatctatattgttaggatcagagtgcaggaccgaggagaccaggagaggatactgatgagcaaaaaatgaattcattccttttgagtagattcctaggagtggaattgctgagtcatatggtaaatttatgttttactttttaagaaaacacaaactattttattgaaatgactatgcaattttatatttctaccaacaatgcataaaattctagtttctccacatcctaaccaacactaatattgtccatctttattattacagtcattaaaattacattataattgtaatctgtattgctctaatgactagtgatgtgccaggaagtcttcttagtggtcgttataaaaggtgaataatacataatacttgcctttacaacatttaatgtctgagggagagagagagagagagacagagagaagcaaaaattacaacacactacattaaatgtacacacactgttataccttttactaaatagttttgtgaaatttggacattttcccttatgaatgaagaattttgtggaaattcaactaagattaaacaaagcccaacattatatacaagccatcaacctgtgaagtatttcctccatgtacttctgatctttaaagcaatcatgtaagacgttctctcaactaagtacttcattttctttaaaggacatttgcaatagaataaagtacaaagtaatgctgcatttaagtgtcctcagggaaaagaaatgaacattattattttagcagaatgtccaaaaggtgattttaatgacaatagacttttctgatgatgatttttactgattttctcatagataaaatgtttattatcaaatcagttaatcctatatcaaatggtttctataataaaaataccaaaaatatcaaatggactttcaaaaacatcgaatggcgcctataaaatggagatcaaggcacatgaaaggatctctagcactcagcaatcctaacacttctattaaatatggaataattctatacctcttgacctctatgattgcaaagccatgtaaatgagctgtatacatagtcattttccttaaaccaagtgttaaattattttttaagtctctcagatggcctacctctgaacccagtaaaaactgaaataggggtgagaaaatgctgacctcttgaattatatacaaagttgaaaatattcttaaggccctaccaagaagtagagaattaccatctgagtcttgtatccatcagaactccagtctggagatgagagctaatacattgccacattagataaaacatatagataaaaatatgatgtaacatttttttgaaggatgaatgaacacaggaataggcattgtgggagctccaggtaagggaatagtgacttaatagtagccaggcactgggtattacaagaattcctccttccttcaaagagctcattgtccagtgaagagacagtcataaatacaatgaaaatacagtaccgtaaaagcagctaacatttattgaacacattctatttgcaagctatcatttttacttagattatctctttcaatcctcacaacaaaactacaagatagataccgttactatcctcattctacagatatggaaacaggcttagagacacaacttgcacaaggctacttgacccacctctaaccgattcaagtggcccatattcataaccactgaggcagctttactgccacttataccactactataaacatacagatgttaaaataaacatagcaggcacaatgggacagagggccgacttgccagagagagtcagaaaaagtttcacagagtgtgctctgaaaattaacaagaattttccagacagagaaacagaggagaagcattccagattgggggcaaaaatatatgtgataaaaagaagcatacacggaaataacagaaacaactgttgtattagtttcctatggctgctgtaacaaaataccataaacttgttacttaaaacaacagaagctattgcagttcatagtttgggatgccagagtctgaaatcaatatcgctgggccaaaatcaaggtgttgggtgggccacgctccctccagaggctctaggggaaatttcattccttgccttttttcagcttctggtgactgccagcatcccctggcttgtaatcatattgcacaatttttaagtctagcatcttgaaatttctccatgtctgtaaagatctccctctgtctccttcttataaggatacatgtgattgcacttagggcccacctagataatccaggacaatctcccatctcaagatccttaacttaatatctgcaaagaccctttttccaagtaaggtaacatttactggtaccaagaattacatctgatttctttgggggcatttttcagtctatcacaacagtgataggggagtccatgttggtagaattggaaaatacacaaaggagtaaaggtcatgagaaatgtggcaggtgggaggggtaaaatagaagaaactaaaagaggctagcaggtcagcagggaccagatgatgatgactagattggctacagacatgtttaaattgtattctgtaggtgacaggtaaaattgacatgttttgatttgcagcattatattgtgatatttgcctgttagaaaaaaatcactacagagttaatagtgaagagagatcagtagaaggcaagagattattgaaacccttaataattattcaggaataaaaagaagagatggataagatataaatttggccattatggatgaaatatagagaaaagaacaaggagaaatttaggataactcctaaatttacagttttgggcaactgggtggatagtggggataactgtgaataggaaataccataggaggtactaaaggcaaggatgaacctggctttggacatgcaaatctagaggtgtctgcatggcatccaaattgagattctggtagataaattgatatgaaagtctggagtacaaaaggatttagaacttaaatgtatacatctaaatttgaaaatttagagatctagatttaggaatcactggccatgagtatagttgaaagtatcaaataagtcagtgttagtagaaactgcttttattgctggtcccagtgagttccaaggcagtctcttcagaatttttatgctgccatgaatgtttcaatttgttcattggtgaattttagccacctagactgtatctaattatctcattttctttagacactgcctgtaccattttggaaaattatcttattaaagtcagctcagaaaaaaaaatagagcatttagtgttctatttacatgtgattatacatactcagggtcctggtgctagggacctcataaatgctgaaaagaactgttaatcttaaaaggctttgggaaaaaattattactaatattaaccctctagggaactaatgatgaaaaattaccctaccccagtggtccttaaaactttttcatcccgtgactactcaagctctacatcatttcttctacaataccacatcacataactgcaggacttttatgccgctgcgaagggaagaaagagattatcatcttcatgagaccacagggtacactaaataaatgttgaaaacagagcaccaggcagtgactgagaaaagctacaggaagactgcagagcctgaggctttgacaagcaggtgcttccgtggtcatcaaatcactattcatagacatgtcgttccaggccagagaatccagctctgagaaacaatgcctcagccattagctcccaaaagacatcaatcacgcctgccaagacacacagttagctcaggagggatttcaaaacttaactgggtcaaaaattgcttctaagcaggttttcttaatctaatctaaactgcaacttgagaaaatagaaggaattctacctccttctaaactgtggttcctacctacatctccaacactatttttatctcttttgttttccaagtacaaaatgttttgatccaatgtaaatgagctatgtattgctttctataagacctacaaattccttcctaccttctcacatcacttattctacccagaaagtcttccctttcctccttctactttcaaaatacaaatttcatagaaatttgctgggaccatgccagatagtagtcataatgcatcttcaatatttctgccataattgtaaaatttggaactcagtaaatgctgtcttgcatatatttgctttctgtatatgttatatgcctctaacaagattttaagttctgtggatggagtcagcatttaatatcttactgggataccggtgtccagtaggtctcaatagatgaggatgacaaagactccaaaatatacatctgccttttatttctgcctacgaagattttaacaaatttttaacctgtgtaaatttttctaactaaaattttcacctctttcttaccaatatagttttgttttcatatatgagatttccttactatctttgctttaataactattttatctcaaattttaacattgcctggaaaaaaacagatgacattgtagctttagattaattttcaaagtatctgattattttaatgtatcaagagaaagcaggaagagtaagagattgccttttgtgctattttgcatatataattggctttacacaaaaaataatgcatcctgtaaggacagaaaaggtgtaaaatctttcttcactcatcataaggatcacggtcaacactcttataataaaagacaagataacaagagaaaagcataacaggtttatttaatcaaagttttgcatgacacaatacccttcagaaatgaagattcagagacccaagggacaactgtcaatttttatacttagattcgatgaagaatggacagttgtgtagaaatgagattggacagaaagggtatgacctaatggtagactgagtgaggaaacctagtaagacctcctgttcttattcttcttgaactctctgtatagcagttcttggtcctaggtataggtccggaccccttctgaaatgagtcttgtgacctactataagacaaggtagaccagagtatttctttgtggccagctcttatacaaaaagctgggagaaagttagggtaatatttctaggttttatgtctggctttaggggagagggtttctagtttctatggcctgccttgggagagaaaggggagcaggcataaaaagggcaggagaaggtcagaaagatcttgcttctgtgacctttttctttagttcaacttattcagcatgctaaagtgccatactttgtggtaccattttctgagcccaacattcccccatctgaaacttccccagaaagtttaacagtaaaaaaattgggttgttggattgtctcataagccatcaaatcagtctttcagtcctgaaaatatgtctgtccaattagacaaataatggttgtgtctaatttgaggaggtggtattgcaggtaggcctccaccaaacttagtcctccatatggtgtgagtaatcagatatttaacaatagtcatttctataaaaacaaaagaaaacaaaaggtaatgtttgaagtaatccataaactcattcctgagtccagagggtatccaattgagacaatttctagatttggcctcaaagtatcttcaggtgaagacagtgcaggcagtggcaatctaacagctttttcttgcttttagttttcaagtgagctttctgagtaatctatacagcaacaggcatgaaggttgttcatacaaaagctgctgtggtgatttccctgaagtctacatcaagtcatcaagctttggctaattttagggcttcaggaaaagaacagttttaatttcaatgatatcaagccagaagggtgggagaaaaattaaaaatattattttggagagttgtggccagatattagaggaaactagaagaatttcagaatacagcccagatttcaggtagatatggaccctcaaaaacaattagttagaatctaataacaagtgcactatagttttcatctgacacataatttttctctctatacgcactttcatttctagtaaagatactcaaagtagactgatttgtttgcaaaataagtttagtctccttaaacttctcctgattatttacataaatccagcaaaaatatttattgaccattttctttgagatgagtcttgctctgtcgccaggctggagtgcagtggtgtgatctcagcttactgcaacctccacctcctgggttcaagcgattcccctgcctcagtctcctaagtagctgggattacaggcatgtgcatattggctctttttaagtttgttttgctgaaattttcaattaggaatctcagattagacttttaaaagcttcttgaggctaggaatccaagccaaggactcactgtcaaatttcccatagtatctatatagtttggtgaattcctctctgctcaaggggtccaaaatatcctgaggtttcagggctgtcagaaagtgacattctttagccatctataaggcaaccatgtgaactttgttcaagaaaccatgccagttattgcaaagcgggctttattggctccataatgtcaaccttagttcctcgatgttgtctgaaaatatgacattccagtcaaagccttgataacatagccagtgtttccaattgtgtcatgttacaaggagaacaaattcttactgaagttacacaaataataatattgccataaaataagaatccttacaaatagtttctgaattctggagggatacagtagaaaaaaaaagtaaatgttttaattctgtttacaaagttatactttaccaaattgttataagctatagatgccttcagagaaaaaaaatctttaaatatagaaaataaacatttaaaataagaaccagaaaactttcaaataaaaagtcatgaaaacatttcctcatcagttgattcagtcctgtgtaattaattcttattatgtttgatcttggttagcagtctcattaagtcatctgtttattcattagagttgtggaaattcttacctagtccaatgatatgatcccaaagttatcagaaacctgtacttgtcagagttatttccatcctttccctgaactttcttgaagacacaacactttacaattctagttgcttgcaaaaacttttcagaaagatcatcagaataaagcaattaactatagacaagacttaaaatgatcatggttagaaatctgttaagagttcattataaccagcaaatgacaaggaaatttggtgatttctgtggcatacaacattttaacataataaccaaaaattgtgaataatagcatatcagacttctaggaatctcataatttttaaacactcatatgaataacatccatagatataacttacaggtttagcatcccttattacttgacaatgcttcccatataatttagcatatcaaataagccaactggcttatttgaggccaactggaaaatctcaaagttaatttgggtcaaaaagacttaatttagaatttaattttgagaactttgtcaaaaatgtcaaaagctttaaaacacttggttaaatattatcttggatatttattaatcaaaatgacaataaaaaatgtttaagaggctgggtggagtgcctaacgcctgtaatgccagcactttgggaggccaaggcaggtagatcacctgaggtcaggggtttgaagccagcctgaccaacatggtgaaaccctgtctctactaaaaatacaaaaattagctgggcatggtggcaggcatctgtaatcccagctacttgggagactgaagcaggagaattgtttgaacccgggaggtggaggttgcagtgagctgagatcacaccattgcactccagcctgggcgacaagggcaaaactctatctcaaaaaaaaaaaaaaaaagaaaagaaaagaaaaaattgtttaagacaaatagagaaggttacatacttgtgaacaaaaactgagctcttttaatagaaaactcagttttcttaagtaatcaaagactaatatgtgaccacatgaaataaactacattaataaaacacaaaattgtttcctaggccaattacataaaaggaataaaaactgtcacattctcagaccaaaatactccaagaaacttttgtcattttaacagggaagaccaaattgtacttttgcttcagtgtactcttaacactaaaggtaattttaaataaattttaaataaatatatacaatctcagtcagctttgaccacacaacattttcataaacattttttaaacttttaaaaattgatacagaattatgcatacttatggagtgtacattgcatatatacaatgcaacataatcaaattaggataattagcatatacattatcctcagatacttatcatttgtttgcagtgaaaacattaaaaatcctctcttctagctattttcaaatatataatacattattgttaactacaatcattctactgtgcaatggaatactggaaattattcatcctatctagttgtaactttgaacccactgaccaacctctcctcattttcctctcccctctacccttcccaacctctggtaacaactattccactctctagttctatgagatcaacttttttagctcccacatatgagtgagaatatgtagcatttgtctttctgtgtctggcttatttcacataacataatgttttccagcctcatccatgttgctagaaatgacaggattgtattcttttttatagttgaacagaattaattgtgtaaatatgccaaatattttctaaatccattcatccattgattgacatttcagttgattcaatgtcttggcttttgtgaatactgctataataagcacaagtgtgcagttatttttttgacacactgacttcatttaatctgaatatataccctgtagtaagattcctgaataatatggtagctctatttttaattttttgatggaattccatgccaatttccctagtggttgtgctattttacattcccatcaacagtgtataagagttcccctttcttcatgtcctcaccagcatttgttatttttgtctttttgataataaccattctaattactgtgatgtgatatttcatcgtggtttctatttacatttctctggtaattagtgatgttgagcatttttccatatacttcttggccatttgtatgtcttcctttgagaaatgtctattcagatctttcacccattttttttagtgaaattatatgcttttttcctattgagttgtctggtttccttatatattctcattattaaccccttgtcagatgcatagtttacaaatgttttttggtataacataagcatttttcctattttttaacaaaaatgtgttctttattcattatgaaacattttacttcctcacaaagagttgtttcctttataatttctagtattttaattacatgtattaactataatttataacttttagtaacttaatttctagttaaaagtagcaaactttgtgaactgtctcatattagtacaaatgatttcattatttctagagacatgcatttcctcaattttttacatttattaatagatccaaatatatttagcttctctatatcttataaaaagaagacgccaaagtacataaacttatgaataatcatatatgttttcatattttaacttacttagaaataactcagacaattaatgagtatctctattacttaatttcactataaggtttcaagttaccaaaaagaatttttaaactatgacaagttcatttataaacatttatctcattcacatttacctaactgtattcattcttaacagttatgtttaaattgatcatgggaaacaggctattcatcatcttatctttttgttcttttaaaaaacaaaaccaaactaaccctacatttgccagccttgtcctaaccaaagcctctgaaacactggacacagataccctccccattgttcaccccagccatcctgggtcctaaacatccactcagcacccagaaggctacaaaaggcaaggtccatatggatggtacagagctcaggacagaggacaggaaacagacagctgtgaagacaatgcctggagtacttgactgctcccaggatggccaagaagcagagttaggccagggaggatggggccatactgggcttggccctcccctgtggttgactggcagcctaggcgctgcagaaacacacatgtcctagacttcaccatagcctccttcccagaccccagaatccagaggctcaaaactaaatacataggctcacaagatgtacacaaggctttatgggagcctagcagtcattccccctagctttgacctaccaataagtcaggcaagtatcaaaaatatcaaagaagctaaaagttaaaagttaaatgtagtttttcctttttttttttcccccatgactcatatacattttagcaatccatatttactgtgcattctactctgaggttggatttaaagtattatgaccttaaacacctagcagaggtaacatacctgtttgatcagcaaacacaggcaaaaatgtctatattatatttaatgacataatcatacagaaagaagcagatcctacagctttaactttaagccacatgccaggtccaataattcaagactcactagctggatttggcgggacacgttacctgctccagatggctagagctttttaccaatttgtatggagaaggcttctgagacttttcatgggaccagtttctaaacatttttttctttctgatgacagtcatctccctgaattttgtatttccagaagataaatatcaagttctagagaagtcaggataggaaatttacatctcaaaagcacagagaaagaatgcaagttttttcatgtagtttgaggaatgttcacctattaacagagatcagtcttataaaggatgtggactagattttaggctggtaactgaggatctagtgtatgaatgtcttcaaagccccctatgagtggtacaaaaagtacataaatgagcctaggcaaaaattcaggagtccattcaaaataaccagctgatcccattattacattgggttttgggtctcttagagctgaggtaaaagcctaagaggacaacatcccatagttgggtcatacaacattttcacaatgtaccttgttgcatgggcattttcttgaggctagtgtgtaacctaatgtcaattagcccattttgtgtcccgcttatcctaactcaggagtctctgtctttgtgtgcatgggtgtggtaagcactctagtagctttcaagtgcgcaaaccatgcacaccatcaaattgtggctttggctccgaaattcctttgaccaacttagccaatgattttcccattctgtctgacccagtcaaacacctgaggcttctcttatgtgagggcacaagaaacaaagaggatggaaacaagatataatacctgtgaatttggaaaactggagttcacatcccctatagcaaaaaccacttacaaaccacttacagcaaccgctgtctgttgtattgaaaactgcagctctacccagtaactggtcaaccaccatgaatccaaaagtcaaatgccttctcacagcacaaactaacccttggtaccccaaatgccaaagatatcagggagctcaatgccaaagagaacagaggtccagatgtgagaaggactaactcatgactcttagggaagacacaggaccaaatgaggaagacagaggaccacaaaaaggaggtcaggggcacctttcctgtgtttttcaaggggtctcagagtctttagaggtctccttccggtccctatgtatgattaccagaatgctgatgttttctcttagtaattttttatctgctgaccaacaaatggaggagggaaggagttgaaggcccactcaaggaaactgaatggaagatagacggtggcacaaggaggatacaggagcagaagaaatggaaagaagaggtttagaggagtcaatctggggagatcttaagttcaccaaaaaggccaataaagttccacattgtcctcaacaaaaatcacactaacaaggaaggaagtaaacagaaaaacagaatatgtagttagcaggagtttgagaaaaggagtttcagttgactgtgaagttcccatgggagaagcaggatccaacagagaaactcagacaccttagaaaaagcctgaatatcagcttccacttaaattgacttttcaccatacagccttttaaaaaaatcctttcaaatgtcttattatcagatttcagccaggacaaacaacaaataattctgatttttttccttttccttttaaaccaaaggaaggtatccatcaagtaactcagaaccaaaaccagtaagtcttttacgacttaaccagtgatgagagagacgtcctcaagagggtgcgaaaaggtacagtcctccaaagactcagaaccactcccaaaagaaaagtcaaaagaacgaaagacctttgctaccacaggaccaagcaatgatggtggagatgacaaaagcccctttgaattgggactttttataagaaaaaaaaaaaaatcccctgagagctggcacgataaaacagagagcattcagggacctcatccactggctgcctgacacaagccaacacttgtgctctctggctgacagagatcaggggggatattctcacaagtcttaaggccgaactctcaggatgtaaaaacgagacaaacaggaaagacaaagacaactgtccctgagagggaaaggatccataacaaatgggtaccccaaggctaaatttacacaacagtcacaatccaaacaaatgattttctcctgctaacctgaatttggaaaggaacaaatacagataaaattttaccatctattctcaaccaggcattatagacagagaccagggaagagctgatgttagtaaataattctccctttgccggcttttggtcagttgtcctaggatctcacctgcaggcactggagtgagtcagttgcctcagccgctccacattgaacaccagagttacaagcgcagaaaaggtatgacacctttcctacctatcaaaagggtcacaaccaacactcctacaagaaaaggttaacaagaaaagcataacagatttatttaatcaaagttttatgtgacacaatagccttcagaaatgaaggcccacagacccaagaggaaaactgtccatttttatgcttagatttgatgaagaatagacagttatacagaagtgtgattgggcaaaaaggatatgacctaatggtaatagactgagtagggaaatgcagtaaggcctgtcctcattcttcctgacctctctgtgtagcattctttcctcatgggtatagggcaagaccccttctgaaatgagggtcttgtgacctaccattagacaaagtaggtcacagaatttctttacagccagcctctacacagaaaggtggggaaaggtcagaataatatttccaggttttatatctggcttttggggatagaagttctaatttctatgaaccaccttggtgaagaggaattctagtttctatggcctgccttaggggaaaatgggaagcaggagaaagaagggtaggagaatgtcagaaagatcttgcatctgagttcaaagtattcgcttcagtccaaagtactgagaatgccaaagtaccatactttaagaaataattttctgagccccaacaatcctaatttgaaaagttaatttataggattcaaccttttttatatcagagatgctagctgggtagaggtgtacaacaatgaatgaaaacagaaatttttgttactgtagaactctttttgaggaagtcaagaatatttatgagtatgccttttcttcacagcttaactaaaggtctgttaacaaatgtaatagagttaggcagtatctttgagataaggtacctcaaaagtccccaaaggttcttccaaaaacactgtcactgccaaaaaaggttctataatcacataagtttaggaaattctccctgttctcttcccactttggagacacatatcatgacatctagtccacaaagtccagcaggagagacctcttcaatttcataaacatatttaactacaaacactttatatcaatagtgcctaataatagtctagaaatcagaactcgtaatcgtaatactatttaggcaatgttgatctggtataaaacccttattttacagatatttttaaaagtaagagtcacagaagttaaatagctatctagttcagatactctagacagagccaaatgaacccaatctcccaattccacgtttcttccatgactcattctttacatgccaggcatttaacctaatcatcactttgtaatttaaaatttccccatccagcctcaaatacatgtttgtttgtttgtttgtttaagcacacaataatatacattttgagcatatccaaagcttatctatcaccctggataactttctgtaagtgcctccctgtttataaaattaaaaacactgaatctgatagcaaataacctgaggcctctgtgataaatgagacagggcttcggggcgtttcagccagcctcccctgagactaggtttaagacatctccatcttatgtgaagacttaaattgtgttgtagcagcttcagtgaaattatttttaatgcccatttgagattttttagaaataatagagcttttatgcaggcattcgaggcagaatccttaatgaggtaaggcatgaggaatgaattcagaaggaagattttcatgattggaggagctatgcgtcatacctaatgtacattccaggaatattttatttaaagcaaaattagtgaaatatcaatctgtggaattctacaagaaattcattttataactcctccattattcctgtcatcagtaacttcatttttcacatatgagaagttctcacgtaaatgtcctgaatatctaaaccaatgtattcagtgcccagaatatattatacatccaggattcacaatattcacttaaatatgatgattagagcaaaattgtcagttaaaaaatagcagcagtatttagctgcatttgagggaatgtgatctgaagtaccacagcaacctttcttaagccccaagcaatgcaaagtcatgacatgtacgggttcagagacacagagctgattgagcaaaatacatatcccaaagattaatggtcatctgaaagaagataaaagatttattgtaagtttttatttgacatagtgtcacacaaaagtgatctatgatgtcttcaataacaaccaccaccacaaaataatggctaacacatctaatgctcactgtgtaccaggcacagttctaagcactttctatataatcactcatttcattatcataacatctccatgaaatagtactactattatctccacttaacatctattgaaactgagatgcagagagtttaagtaacttgccaaaggtcacacagctagtaagaaacaacacataggttggattcgaatcctcaaagtccagctccaaaatccgcaatgtctgagccttactaaatgccaagcaccatgagaggttctttcttgcattacctcatttcattatgcttatttaactttatttttaggataaaatcaactgtaaaatgtttttctctttcatttacaagtttgcatggcttgtggctacatccttgaatttatcagtaaatctccaatataataaaaaccagctgtgttccacctgaaacattaaaacattattctttgcattgcgtaagttaaaaaaactgtttagtttctacttctctagcctttcttgagtaagcagctatgggtagtaaagcatacaggacaaagagatatctcaggatccagctcacccaatgagggagctacaaaagacagcaaggaaggccttcaagtaatgagttagcaagctgtctagtgataaccctgagccaatgggaatgcccttgggatgtgtcctatgcttaattcaaatatctgtggcacagcatagcatccttgaactgggagaaacctctttgtagcattaccaccaatctttcctaagtaaagttagccatttccacctcagtgaggctaatcttcaagtaatttctattgttgagtaaagaaggcattttcgactattattcaaaagtcaaaaaaataacagacgctggcaaggttgtggagaaaaagaaatgcttataccaacgctgttagtagcagtgtaaattagttcagccattgtggaagacagtgtgatgatttctcaaagacctaaagtcagaaatatcattcaacccagcaatcccattgctgggtatatatccaaagaatataaattgttccattataaaatacatgcacacatatgttcactgcagcactattcataatagcaaaaacttggaatcaacccaaatgcccatcaatgatacaatggataaagaaaatgtggtacatatacaacacagaataccatgcagccataaaaaaagaatgagatcatgtccttttcagggacatggatggaggtggaggccattatccttagaaaatggatgcaggaacagaaaactaagtattgtctgttctcacttataagtggcagctaaatgatgagaatacatggacacatagaggagaacaacgcacactggggcttatcagggggtagagggtaggaggagggagaggatcagaaaataactaatggatactaggcttaatactttggtgatgaaataatctgtacaacaaactcccatgacacacgtttacttatgtaacaaacctgcacatcctgtacatgcacccctaaacttaaaaataaagtcaaaatatatgcatggaaaaaaaaaagtcctgccaatgcctgaaactcaacatactccaaattaaatttaccctatcctattccaaaaagtcaactttattttcaaagttttctaaatatcccagatttaaatgattctttgattcctaattttttttttcaccttgcatattaaccagtcactggaacccaacattcattcatttatttttcttcacaacgtctctcagattatctttcctttctgctttcgaggcaaaacagcatacttgaaaatccatagaggctgggcatggtggctcacaactgtaatcccagcactttgggagtccaaggtgggcagatcacctgaggctgagagttcgagaccagcctggccaatatggcaaaaccccgtctctaccaaaaatacaaaaattagcctggcgtggtggtgcatgcctgtagtcccagctacttaggagactgagacatgagaatcacttgaatgcaggaggcggaggttgcagtgagttgagatcacaccactgcaatccagcctgggtgacagagtgagactctgtgtcaaaaagaaaagaaaaggaagggaagaggaggggaggggagggaaggggaggggaggggagggaaaatcaagcccacacataggagttaatgtaggtcctggattttccatgtactaacagcaaagaaaaaaaaaaagaattctcagtagaggatttccacttcctttctactttcacatgactgttcctatacaaatgcaccaacaattttattgaaaatggttttttttacatgtagtatatttatgtgatctctactgttggatctctctattgtgtatgtttatactgaaccaaatctttcagtgactctgttcatgcttttcactcatttcatccatttctcattatttcattattcttcccatctcaaatcagtagtaatatttctaggattttcataattcaaagagagtgaaaatattcctttcggttctcttaattaattcttcctcaggaaaaaaaaaaagttgctttagtttaaggtttttccagtctagaatgaaatgaatctcaagaaatctcaaggatctccaatgaaaggggagaacttgcacccccaccttgaaaattacttcttacgcaatgattccatccattactgatatattgtatcatgaaaatagtgtttataaaaactatgggaaattttgaaaaatgcttgttaactgcaaaagcagaattccaaagtgtttacacagatgacattaggtaggtaggtaggtaggcagatagattacacagacagacagacagacagacagacagacagatacacacacataaactcatgcatagaaaaaaatcaagaaaaaatcatcaacataattttgttgggataatatgacttgttgtcctttcttatatttctcctcatttttcaacttctttgaataatcacatggcacattcaatagttaaaaaaaatgaacatttactttgcagaatacttacacatcaggcaacaaaatatcactttcttccaaagtactgaaatttctctgaatctagccctgtagctaaacaaacctccctgacaatgtaatgttctggtttgggagtctgtctttacaaatccatcacataaacagaaccaatgacaaaaaccacatgattatctcaatagatgcagaaaaggacttcaataaaattcaacaccccttcatgctaaaaactcccagtaaactaagtattgatgtaacatatctcaaaataataagagctatttatgacaaacccatagccaatatcatactgaataggcaaaagctggaagcattccctttgaaaaccagcataagataaggattccctttctcaccactcctatgcaacacagtattggaagttctggccagggcaatcaggcaagagaaagaaataaagggtattcaaataggaagacaggaagtcaaattgtctccgtttgcagatgacatgattctatatttagaaaaccctatcatctcagcccaaaaacttaagctgataagcaacttcagcaaagtctcagggtacaaaatcaatgtgcaaaaatcacaagcattcctatacaccaataatagacaagcagagagccaaatcatgagtgaactccgattcacaactgccacaaagagaataaaatgtctaggaatacaacttacaagggatgtgaaggaccttttcaaggagaactaaaaaccactgctaaaggaaatcagagaggacacaaacaaatggaaaaacgttccatgctcatggataggaagaatcaatatcgtgaaaatagccatactgcccaaagtaatttatagagtcaatgctattcccatcaagctaccattgaatttcttcacagaattagaaaaaactactttaaatttcatatggaaccacaaaagagcctgcgtagccaggacaatcctaagcaaaaagaacaaagctggaggcatcacgctacctgacttcaaactatactacaaggctacagtaaccaaaacagcagggtactcgtaccaaaccagatatacagaccaatggaacagaacagaggcctcagaaataacgccacacatctacaaccacctgatcttcaacaagcctgaaaaaaacaagcaatggggaaaggattttctattcaataaatggtgctgggaaaactggctagccataggcagaaaactgaaactgaacccctttcttacatcttatacaaaaattaactcaagatggattaaagacttaaatgtaaaacctaaaaccataaaaaccctagaagaaaacttagtcaataccattcaggacatagacatgggcaaagacttcatgactaaaacaccagaaccaatggcaacaaaagccaaaattgacaaataggatctaattaaactaaagagcttctgcacagcaaaagaagctatcatcggagtgaacaggcaacctacagaatgagagaaaatttttgcaatctatccatctgacaagggctaatatccagaatctacaagaacttaaacaaatttacaagaaaaaaaaacaaacaaccccatcaaaaagtgggtaaaggataggaaaagatacttctcaaaagaagacatttatgtggccaaaaaacacatgagagaaagctcatcatcactggtcattagagaaatgcaaatcaaaactacaatgagataccacctcatgacagttagaatggcaatcattaaaaagtcaggaaataacagatatgggtgaggatgtggagaaataggtacacttttacaccattggtgggagtgtaaattagttcaaccattgtggaagacagtgcagcaattcctcaatgatataaaaccagaaataccatttgagccagcaatcccattaccaggcatatacctaaagtattataaatcattccactatgacgacacacatggatgtttattgtagcactatttacaatagcaaagacttggaaccaacccaaatgcccatcaatgatagactggataaagaaaatgtggcacatatacaccatggaatactatgcagccataaaaaaatgagttcttgtcctttgcagggacatggatgaagctggaaaccatcattctcagcaaactaacacaggaacagaaaaccaaacaccacacatgttctcactcataaatgggagttgaacaatgagaacacatggacctggggaggggaacatcacacactggggcctttcaggggttgggggaaaaagggagggagagcatgaggacaaatacctaatgcatgcagggcttaaaacctagatgatgggttgataggtgcagcaaaccaccatggcacatgtctacctatgaaacaaacctgcactttctgcacatgtatcccagaacttaaagtaagatttaaaaaaaaaaacaaaacaaagcaaaacaaatatacataaacatagatacacacttaatacaatcaggtaggcatatactgagtgatttttaatgtaaattaaatcacatcaatatttgtttaaaatcctccaatagcctctcttttgaattgaaataagtcagaactctttacctagatgtacaaagtccaatacaatttagctcctaaccacctctttgacctcaatccctaatgctttccataactcactctagggcagctcctttggcttcatttgtgcttctttctgcctaatagagattttctgatggctgaccccttcctgtcattaggtatcaactcaaacatcaccttcccagggaggcctccatttactacacagtctagtctgtcatccatttcttttccccagcactgtttccatcacctttaaaagcttttgtatgtataaggacaaaacactgctgaaagaaattatagatgacataaccaaatggaaaaccattccatgttcatggattgaaagaatcaacatcttaaaatctctatactgcgttttttccccaacagggttgattagaggcttttagcacgcctcagtaacttggaagtagcataaaaatagtgcataaaaatcaactctggggactttaattcaagaaggaaaatgggaatcctcagcattcgtgaaggacacccaagatccctgggaggagaatgctggccaacagcttccatgacagcatctggctgacaaaaatgagtgaagccccagtatgtgagagaggcagagaacttcccactgtaactcatctttccactgaggattggagcaaccccaactgagaaagagcactttgtttctcccaagccttggaaataacttgggaaggggcttagagacattgtgagcgcaagacaccaggaaatactgcagacattttcccagacccaggactgagagcaggattctgtttttaattcgagtgcatactaagtcaagcttttctttgtgactcagcagcatagccatgcaggcattttagtctcaggccggagattggaatggctgctctggaacaggctaggaatctccataaccagagctgtgaaaagcacctcagtagtcggcactggaattgtactctaccctgtcacaaccctgtggtagaaggagagctgctacagctgcagtttctcctgggtgatgatacttgcagacagggctggcttggtgacctgctgtgtgtgtgccattgttgggtgctccagcctgctcccctgagttcatggtgcagcaggaccctctctgcctcatacccaggcagaaattcaggcattcagagcacaccctcacatggacccacagcctgagccaccccacccttcatgagtatagatcatgatgcatcaggaccctctccacaccatgcccaggcagatttccaggtattcagagcaccccctcactcacctgaatcagcagcctgagccaccctacccttcctgtgcatagacttagatacagtggggccctctctattcctaatgtggccagacctccaggcatttagagcaccgattcacatgaaacagcagcctgagacaccctagtcttcctgcgcatagatctgggtacaggaggctctctctgcttcacacccaggcagatctccaggcattcacctggttcagcagcctgaaccttcccacccttcctgggcatagattgtggtgcagcacggctctctctactcacgtccaggcaggtctccagacataaaggatacctgctcaccgagatcagcagactgacatgttctgtgcttcctgtgcacagatcctggtgcaggaggccctctgcttcatgcccaggcagatttctaggcattctgagaacctattctcctagattaggagtttaggctgccctcatccccctgcagagaacttggggctgaggaggtttcccaactccacacctaggcccatttctgggtgcttggaggccacccactggattcttgcttggcactggtacctgtgcctgccattggaggacctgttggcagacctgcctgttccagtaccatctatcttacccctctagagctgaggagggagctcagaccactgtgcactccacacattcacccattgcctaagacaaaagagagcttctcccagtaaacagggatcaagtatacacccagctacggtggcctcagctggctgttacctataagcgccatctactggcttgtaggttgaactgcacagcccaatataaaccctgccaacagaagagcacagggctgtagaagcaaagccaaaacaccctacccagtattctctacagtcacaccccttagggagatgggaaagggaaaaggacattttgaaaataatattacagagaaaaaaagaagagaaaatcctagatgcatgagaataattacaaaaatttgaagtgccagcatctccagatgagaaagattctggcaccatgaaaaatctgaatgtagtgacaccaccaaaggatcacactagctctccagcaatggtccctagccaaaatggaaactcaaaagtgacagataaagaatttaaagcattgattgcaaagaagctcaacaaaatccaaaacaaagttgaaaatcaacacaaataaacttctaaagcaatccaaaaaatggaggaatagataaacatctttaaaagaaatcaatcagagcatttggaattgagaaatttgaaattgaaaggaattgaaatactttcaagagaaaatttcaaaatacaattgaaagcttcaccaattgactcgaccaagctgaagaaagaatttcagagcctgaagactggtcttttgcactaacccagttagacaaaaacaaagaaaagagaattttaaaaaatgaacaaagtcttcaagaaagataagattatgtaaagtgaccaaacccatgaattattggcattgatgagagagaaagagaaaaagtaaacaatgtgaaaacatatttaagggaataactcaagaaaattaccctaatcttgctagagaggtagacatctggatagaagaaacccagagaacacctgcaagatactatacaaaatgaacatcatcaaggcatatagtcaccagcctgtccaaagtcaacactaaagaaaaaatcttaaaggcaaatagtcagatcacatacaaagggaaccccatcaagctaacatagacatttcagttgaaaccttacaagccagtagagatacaggcctattttcaacattcttaaagaaaagaaattccaaccaagaatttaatatcctgccatactaagcttcataagcaaaaaagaaataaaacctcttccagacaagcaagcactaatggaatttattaccactagaccaaccttacaagacatccttaaggaagttctaaacatggaaatgaaagaacaatacctgctaccacaaaagcacactaaggtacatagcctttagaccctaaaaagcaagcacacaatagaaactacaaagcaaccagctaattatttcacaataagatccaaacctcacataccaatattagtattgaatatatattgtctaaataccccccacttaaaatcacagagaggcaaattggaaaaaaaaaaaaaaaacaagacccatctgtctgctatcttcaagagagacatcttacacataacaccacccataagctcaaggtaaagggttagagaaagatctaccatgcaaacagaaaatgaaaaagagcaagggtcactgtctttatatcaaataaaaaagactttaaaccaacaacagtagaaaaggagaaagaagggcattacatagtgataaagggttcaattcatgagaagacttaactatcctagatatatacacacccaacattgaagcatctggattcataaaacaagtatttctagagctacaaaaagacttagacagccacacaatgaaaatagtggaggacttcaatatcccactgacagcattagacagatcattgaggcagaaaacaaagaaattctggacttcaatttgacacttgactaattggatctaatatgcttctaaagaatactccacccatgaaccacagaatatacattctacctgtctacacatggaacttactccaagatcaaccacatgcttgaccagaaggcaaatatcaataaaaacaaaaatttgaaatcataccaaccatacccatggaccagagtggaacaaaaataaaaattattataatgatctcttaaaaccacacaattacatgaaaattaaataactttctgctgaattacttttgggtaaataacaaaaagcagaaatcaaaaaattttcctgaaataaaaacagacacaacataccaaaatctctgggatgcagcaaaagcactgttagtaggaaagtttatagcactaattgcctacttcaaaaagttaaaaagatctcaaattaacaatgtaatatcacaccaagaggaactacaaaacaagaacaagctaacctcaaaggtagcagaaaacaagaaataactaaaatcagaacagaatgaaataaaagtgagaccccaaaagtcataaaaataatcaatgaaaccaaaaattgtttttgtaaaggataaaggataaaaaaatcaatatactgctaaacagattaacaaaaacaaagagaagaacacaatgagaaatgacaaaggtgacatacaactgatcccacagaaatacaaaagatcctcagagactgttatgaacagttatgtgcatacaggtgtatgcacataaactagaaaatctagaggaaactgacaaattcctagaaacacacaacctcccaaaattgaatcaggaagaaactgaaaccctaaacagaacaatatgaagttccaaaactgaatcagtaagaaaaaacttacccaccaaaaaagccctggaccaggtggattcacacctaaattctaccagacatgcaaggaagagccagtaccaattctactgaaactattccaaaaactcaaaaaggaacactgctgcctatctctttctatgaaaccagtatcaccatgataccaaaacctgtcaaagacacaacaataacataaaagtaaaaactacaggccaatatccttgccaaacatagatgtaaaaatgctcaacaaaatactagcaaactgaattcacctgcacatcaaaaagcattttaccatgatcacacagacttcattcctgggatgcaaagttggctcaatatatataaatcaataattgtaattcaccacacaaacagaattaaagacaaaaaccatatggtcatctcaatagatgcagaaaaagcattcaataaaatctaacatctcttcatgattaaaaaaaaatccatcaaaaaactaggcatcaaaggaagctaccttaaaataatgagtcatctataacaaacccacagctaacatcattctgaacagggaaaaaattgaagcattttccttgagaactggaatcatacaataatggtcactctcaccacccctattcaacatagtactggatgacctagccagagaaatcaggcaagagaaagatacaaagggcacccaaataggaaaagaagtcaaactctcttcttactgacgatatgatcctatacctagaataccctaaagactctgccaataggctcatggaactgataaacggctgacaaagtttcagaatatgaaattaacatataaaacttactagcatttctataaaccaataacatttggctcttatctgagagccatatcaagaatgaaaccccttttacaatggtcaccaaaaaataaaatacctaggaatacatctaaccaaggaggtgaaagatctctattaggaaaactataaaacactgcctaaagaaatcatagatgacacaaacaaatggaaaaacattccacgctcatggattggaagaatcaatatcattaaaatgtccatactgcccaaagcaatctacattttcaacgtgatttctaccaaactaccaacattatttttcacagaactagaaaaaaactactctaaaattcacatggaaccaaaaatgaggctgaatagccaaagcaatcctaagaaaaaagaacaaagttggatacatcttattacccaacgttgaactatgctataaggctatagtaaccaaaacagcatggtactcttacaaaaatagacatataaaccaagggaacagaatacagaaccctgaaataaagccacacatctacagtcatctgattcttgacaaatcaacaaaaataagcaagggtgaaagctcctcttattcaataaatggtgctggaaaaattggctagccatgtgcaaaagattaaaactggaaccctacttttcaccataaaacaaattaacccaaaatggattaaagacttaaacgtaagacctctaattgtcaaaatcctagaagaaaagctgggaaactactttttagacatcagccttgacaaagagtttatggcaatatcctcaaaagcaattgcaacaaaaacaaaagttgacaattgagacctaattaaagagcttctgcagggcaaaagaaaactatcaacagagcgaacagacaacctacaaaatgggagaaaatattcacaaactatgcctctgacaaaggactaatatctagaatctataaggaacttaaatcaacaagcaaaaagcaaataaccccattaaaaagtgggcaaaggagatgaaaagacacttctcaaaggaatgcatacaagtagccaacaaacatgaaaacaaaaatgctcaacatcactaatcatcagagaaatgcaaatcaaaaccacaataaaatactaactcataccagtcagaatggctattgttagaaagtcaaaaaatagcagaagttgatgaggctgaggaataaagggaatgcttatacactgtatgaatgtaaactacttctgccactgtgggaaacagttgggagagttctcaaagaactaaaaatagagctaccattcaacccagcaatcccattattgggtatataccaaaaggaaaataaattgctcgaccaaaaagaaacctgcgctcatatgtttatcacagcactattcacaacactgaaaacatggaatcaacccaggtgcctatcaatggtaaatttgataaataaaatgtgatacatatataccatgggatactatgcagccataaaaaaaagaataaaatcatgtcctttgcagaaacatggatgcagctggaagtcattattctaagcaaattaatgcagaaacagaaaaccaaatgtcacctcttctcataaagcgggagttaaatcttgggtacacatgaacaaaaacatgggaacagcagacactggggagggaaggagagaggtgggtaaaggctgaaaaacttcctactggttgctatgtttactatatgggtgataggatcaatcatatcccaaacctcaatttcacacaatatattcttgtagcaaatctgcacatgtaccccgactctaaaataaaaatagaaattttaaaaaaactgtacatagcacctatcattatcaagtctccttgcttatttctttacttgccattgtttgtctccactcctagaatgcaaaatttatatcactgcatccttcttacttaaaacagtgtctgatacatagcaagagaacaataaataaacattaaaggaatagcaactgaagaaagacagtgataagaatagtagttgtccatgatacaaatgttggttttaggattctctttaaaaacatacatagctgatttccagtcttaccaacttcatgataacaatgcagctggtgtaacttaatatatgcaaataaatataaatacttctggaaaaagtcaagaagtaaagaaaacgttcacaggagaggatgagaatatagaggttttgcttatcacagagagtagtaagaaaagaaatggaaattgagtccaatgagagtaataaaagggtaatgatagtagagaattggtttctagtggtggctgaggtataataggattagtccagaaagtctccttgtggaacatgggcacttggttctatgctttggtctgccacacatcaggcatcttcttagatagccccccaaggaatggctgaaactagggcatctgtgatcatcaactaaaagatacctaaatctttctatgaggtgtatgagactgctatattgactatatggtgatctgttttcttctatatcaaaatgaaatgctctaacctgagaaaaacaggttacatgaagaactaaaacatatagtttttagttttctgggctaaatatatgttgcaaaaatacaaaaccatttaagagcaaattacaaatttaattatcacaaaacaaccagcccctaaaatatcaccttttcaatatattttaagtagccagcggtccaccattgccatgaaaaatggtacatcaaaggtatttaacatgctgtaatttattctccacttccaggtgacaatgacaaattgctcaagttccctccttgttctttgcatcatcactacatgtttgaaaaatcgatatatcacttgcaaccaaggattacaaatgcagcccacatcctttcactttcttttttctttccccatctatcagagcatttccctctaatcattgcttacctgttctttcctctccatctttacttgttctctccctgagaccatattccatcttcttcatgaccaccccaatcttttacctcacactcaacaaagcaattctttacccacctttataataggtcaagctgctagccatgaggaggccacagggcctgactggcatacattggggcgaatggaaaaccatcctgggaatctagggtttggtaaggagcaagatatcaggaaagaggcatatgagaaagaagaccatggacagggcctgagcagcactagaccgcagggtcaatcagagaggtcaggtgtattatgatccgaaggcacataaacacaccagaaataaagaacaaggttggtgatgtctttcatctttctatgattgtttctcccttctattataaaatatgcactggccattcaaaggatataataaaataatagacaccactttcccttttctctcacaaattcccttataatccctgataattttacatgctttcagaatgttagcgcctgataagtaaaacaaaatttcagtttggccacagactcaaagcaagaaataggactccttgaagttgatttgaaataaatatagctatatttttgctgctatagcaactataaaatagaactatttattgacatatgcagaaaacaacataacattttattaatacacaattgagatgttctttacctttttatgtttacttattaatgggttattagtcattattagaacatttacatgatagagtagtaattaaaacaaaaagagaaattgaatgcatcctttagctataataaaggctaatgtttattatgtgccaggttttctgttaggcacttgacaattatcagttcatttaatcctcacaaagcaatgtagtattggaattatcctcattttacagatggggaaatggagggcgattcagagaaattgagcatattgttaataagtgatacagtcagaattagtacccagactgccaaacaactcacatttgccaaaaagcaaagatgctttttacactattccagcatatctccctacaatgacaccaaaggaaacttcagaattcaacaaacatagcctgagggcctgcggcatgcaatgcacacagcagagtgtgctggagatcataaacatttgtcagaaacaaatgttatcatctaaaagaagagataaaacatgtatataaacagctataataaaaggcagaaagccacagttatcaaaaagaaattctttgcatgttaagagaaagggggttatttctggtggagaggattaaataagactttaggaaggaaatggaccttaaagtttataaaattaatagttttgcaccaactacttgctcactgacattaggaagaagtacccatctcgcattccacaaagaacgtacagtcatgtatcatttaaggatgaggatacattttgagaaatgtggcattaggtgatttcatcgttgtatcagcatcactgagtacacttacacaaacctaaatggtacagcctactacacacctaggttatggtatggcctattgctcctaggctacaaacctgcacagaatgttactacactgaatactgtagacgattgtctacagtattaaccatttgcatgtctaaacaggggaaaggtgcagtaaaaatacatcattataatcttatgagcccaccatcatatacacagcacttcattgactgaaaggtaattaggcagttcctgaccacgtctcatttagaaattagtttctaaaaatccagagtggttctacaccaatcctaatctggtttctgtttctaagaaatgtgtttaagttaaacatctaaaaaaaatttctgtgaaattttgagctttgagcttaaaagtctgaaaacttacactctggattctggttacatgtgaaaaatactttttaaattattgtccacagcattgttgccttttttctaagctttcgtttttctgtacaggataaaacattttctcatctgaaaatatttccaaatagacccttattgccttaatctgttttgtgttgctattagtataacagaatacttcagactgggtaatttattcaaaaattagagatttatttggctcacagttctggaggatgggacatccaaagtcaaggggtcccaatcttgtgagggccttcttgctgtgttatcccatggtggaaagcatcacaatggtgagagagcaagagcagagggagccaaacttactttgtatcaggaatccattcctgcaataatagcattaatccattcatgagggcagagcccttgtaacctaatcacctcttaatggtcccacctcttaatacttaatgggtaggacattcaaatattagtacatattaatgtggatcttattatcagtattaggattctaatttatttattttgtagacctgaggtcagccaacttcaacaaaaatccatcctaccacttgcttttatgagatcttattgaaacacagctatgtccgttcattttcatattatctatggctcatgatacaatagcagaactaagcaatgtgacagaggccatatagcactcaaaacccaaaatagttaccatctaaccttttacagagttgcagacctttgccatagaccatccattcactcagcaagtatttattaagagcttataagggcaggtggctggtaggtagctagcataggttgttggctgaaaaactgtagcctcattaaactaagttaaaagttaattcatactgaattgtattcttcaatataattatcttcacatacgagaaaaaaacttgaacaacttttcctgtggaaaaaaatgtactaagtgacttggaatgtaatattactaggaggtactctactattactacttacactattgagtaacacttattgagcatttactgtgtgctcaacactattataaacacttaatataaatagtatatgtcattattcctcactacacctctaggatgtaagtgctgttactatcctcactttacaaatggtgaaattaagactcaaaccaattaatttctgaggtcacacagcttatatttgttaaagctgggactttatagaagatgctttcattcttggagatattaaaataagagagtggataacttattaaaaaggtaaaatggtgtacctttttaaggggagcaaaatataaataactaccatttactgagagcctactatagttctgtcattatgctatgtgctttaaaaacattctctaatttttatatcaacccttcaaggtaggtataagttccctcttttacaagcaatgaaaaaataataggttatatgactgacaaaaggtacataccttgtaagttgcaaaactaaggttaaaatttagatctacctgtcttgttctagaatacatgctaaattctattttttaaaaaatcctaggtgtatttttctaattcttgaaactgaactgcacttacaaatgaaagcaacagatgttcagcagctgaacaatgaaatatcagataggacaaataatgaaaatataacctacacaactaaaatagcagagaaaaatatagaaatatgaagcatatttctatatgtaaatacagaatttgttcctaatggtagccaggattcaaatcagaataagctacaatagaaatttctgaaggcactaaaataatctgaaatctcattaattcattctctaataaagcactgatgcattgacacttagcagatatctctgttgtaatcagttatccccgtttccatgggagaaggggactggtcaacccatttccatatttttgctgaagaaacatctaaagatgtgaacaatacccttctcttagatatgattgaataataaagaaaaaaaaagaggggactctgggctttaggaccaaagagaaataagttggtatattcacctctgctgcttcataactgtgtcaccacaacaagctaattgacttctctgtaactgagttttctcatttaaaaggatgtttatgagagatgctgtagaaaagcatcaggcatgccctcttaaaacacatctaagggaattattattctttcagttgtaatcacttttctcaaggaagatctttaagagaaaatattttctcacttattccctttcctagtggggagtaacaggagcaagactcactgtgtgatgccccgcgttgccttgggactctacagcacgtccttaccagcaagaaggctctcaccagctctggccccttgacctttgatatgtttggctgtctctccacccaaatctcatcttgaattgtagttcctacaattcccatgtgtcatgggagggacccagtgggaggtaattgaatcatgggagcgggtctttcccatgcttttctcatgatagtgaataagtctcaagagagctgatggctttataaaggggagttctcctgtacatgctctcttgcctcatgtctcatgtaagacatgactttgctcctcattcgccctccaccttgattgtgaggcctccccagccatgtggaactatgagtcaattaaacctctctcctttataaattacccagtctcgggtatgtctttattagcagtgagggaacaaacttatccaatcttggacttctcagcctccagaaccataaaatacaaatttattttctttataaattccccagtttcaggtattctgttataagtaacagaaaatgaattaatacagaaaattgttaccgagaagtggagtgttgctgataatgaataactaaaattgtggaagcagctttggaactagataatgggcagaagctggaagaatttggaggagcaggctagaaaaagcctagattctggtgagggtttagaagacaagacaactagggaaagtttggaagtccttagagattggttaagtagtcatgaccagagtgctgatagaaatatgcacagtaaaggccatttcgatgaggtttcaaatgtaactgaggaacaagggagtggaaaccagagcaaaggtcattcttgtcataaatgggcaaagaacttggctgaactatgttaatgctgagggctttggggaaggcaaaaatcaacagtgatgaactagagtatgtggcagaagaaatttctaagtaaaacataaaagttgctgcatggttacttttggctgcttacactgagaattgaaagcaaataataacttaaagaaagaatttataatcaagagagaaggagaattgaaagatttggaaaatgctcagcctaaccacataaagaatgaaaaaatgtgttcaggagaggaaaccaagggtgtagcccagtgaccacttgcaaaagagattactacacacaaaagggagccaggtgctattcctcaagaaaatggaagaaagacccagaaagcatttcagaaatcttcaaggctctcccatcacaggctcaaaggctgaggagagtagagtggtttcacgggacaggcctggggtgctcattgcccaggtccaacttgtgactttgctccccacacccttgcatggtgctccatggttgccccagccatggcttaagtggtcccaggtgcagatcatgccacagttcctgatggtacaagtcataaactatagcaacatccatataatgttaattctgtaggcttgcagaaaacaagagctgtggaggcttggcagcctccacccagatttcaaagaatgtcatcaaaagcctggggtctcaggcacagacttgttacaggaaaggagtgaccacagacagcccctgctagagcaagaaaaagtggaaatgtggggttggagctgctgcagagaatcctcactgcatagggcagtacctagtggagccataggagcaaaaccaccaccaaaatgccagaactatacagctgccagcatgcaatcctagtcgaggagagctgaagcatgagctaagcccaggaaagccacaaaggcagggtttttcaaggccttggggacttaacccccacatcagtttgtgcagaatgctagtcatggagtcaaaggagattattcctcacccttagatttaatgtctgccctcttgggtttcagacttgtttggggcctgttactcctttcttttggcctgtgtcttccttttctttctatatatatatatatatatatatatatatatatatatatattttaattatactttaagttctagggtacatgtgcacaatgtgcaggtttgttacatatgtatacatgtgccatgttggtgtcctgcacccagtaactcgtcatttacatcaggtatatctcctaatgctatccctcccccctccccccaccccaccacaggccccagtgtgtgatgttccccttcctgtgtccaagtgttctcattgttcaacttccacctatgagtgagaacatgccatgtttggtttttgtccttgcaatagtttgctgagaatgatggtttccagcttcatccatgtccctacaaaggacatgaactcatcattttttatgtctgcatagtattccatggtgtatatgtgccacattttcttaatccagtctatcattgttggacatttgggttggttccaagtctttgctattgtgaatagtgccgcaataaacatacgtgtgcatgtgtctgtactacaaggctacagtaactaaaacagcatggtactggtaccaaaacagagatacagaccaacggaacagaacagagccctcagaaataataccacacatctacaactatctgatctttgacaagcctgacaaaaacaagaaatggggaaaggattccctatttaataaatggtgctgggaaaactggctagccatatatagaaagctgaaactggatcccttccttacaccttatacaaaaattaattcgagatggattaaagacttaaatgttagacctaaaaccataaaaatcctagaagaaaacctaggcaataccattcaggacataggcatgggcaaggacttcatgtctaaaacaccaaaagcaatggcaataaaagccaaaattgacaaatgggatctaattaaactaaagagcttctgcacagcaaaagaaactaccatcagagtgaacaggcaacctaaagaatgggagaaaaattttgcaatctactcatctgacaaagggctaatatctagaatctacaaagaactcaaacaaatttacaagaaaaaaacaaccccatcaacaagtgggcgaaggatatgaacagacacttctcaaaagaagacatttatgaagccaacagacactgtgtcttccttttctaatggaaatgtctaccatatgcctgtataacaccactgtatcttgaatgtaggtagcttgttttgatatcatgagactatgaattttggacatttgggttggtgctggaacaagttaagaatttggggctatgatgtggaagaaatggatttttatgtgagaaggacatcagttttggagggccagaagcaatatactatggtttgaatattttcccatttcaaaactcatgttgaaatttaatctccaatgtggcagtattgagagaagaggcatttaagaggtgttgggtcatgagaacagagccctcatgaatggattaatacattcatcaattaatagatgaatgagttaatggattaatgggctatcatgggagtgggactggtggctttataagaagaggaagagagacctgagagagcacattcagccccctcaccatgtgaggccctgcaccaccttgggtctctacagagttctcagaaggctctcaccagatgtagccccttgaccttggacttctcaacctcagaactataaaaaatatattacttttctttataaattacccagtttcaagtgttctgatataaacaacagaaaataggctaatatatctatttaatgcataaaaagagacttgaaaacagaaatttataccatgtccctgagtaaaatattaaatgttgtaaaatgctaattttatcctaaataatctctaaatttgctattcttccaatcaaaatctcaacaggtaaaatctaaaactgtaaaactcttagaagaaagcagaaaagctttatgacattggatttggcaatgattgctgggttataataacactaaaagcacaagcaacaaaagtaaaaattagataaattggactacatcaacctttaaaactgtgcgtcaaggggacacaatcaacagagtaaaaaggcaatctatgaaatgggagaaaatactcttaaatcacgtatataaagtgattaatatccagaatatataagaaactcctacaactcaacaaaataacccagttaaaaaatagaaaaaagacttgaatagacacttttccagagaagatatacaaatggtcaacaagcacatgaaaagatgcccaacatcactaatcattagggaaatgcaaatcaaaaccacaaagagatgttacttcacaaccatcaggatggctactatcaaaaaagctaagtaagtgttggctaggatgtgaagaaattggaatccttgtgtatcattggtggaaatttaaaatgatgcagccactatggaaaacagcactgcagttcctcttaaaattagaaatagaattaccataagatccagcaactttactgcttggtatgcatccaaaagaattaaaaacagaatcaaagagatatttccaaacccatattatagaagcatttttcacaacagccaaaaggtggaggcaacctaagtgttcactgacaaatgaatggatcaacaaaatatggtatatacacacaatggaatattattcagccttaaaaagaaaaatcgtgtcatatgccacaacatagatgaatcttgagaacattatgctaagtgaaataagccagtcacaaaaagataaatattgtatgattccacttagttgaggtatctagagtagtcaaattcctagaaataaaaagtagaatggtggttgccattgacagatagggggaggaataaatagaaagttttgtttaatgggtacagagtttcagatttccataataaaaaaactttggagactgattagacaataacatgaatacaattaccactattgaactgtacactttaaaaatagttaatatggaaaattctatgttacgtgtatcttcacaattttttttaaagttcagtagggtaattatgcaaatgtaacatttaaaatcaatagaggaagctggattattcgataaatgatgctaggacaactgatcattaatttgggggtaggaaggaaccatagataaattataaatctgaaaataaataaaactatacgaagaaaataaggtaaaatattttataattgtggggctggtcaaggtcagcctaagcaagatacaaaatccagaagctttaagtaaatacacagatagaacacttcataaaaattaaaacttttacaccacaaaaaaaagataaataccaagaaacaggctggaaaaatacttttaaaatatttttaacagacaaagtctgttaaatatatttgatctagaatatacagtctagaatatagaattctgtttggtctagaatatacagtcaattcttgctttcacagtaattttattcaataaagccaccatgaacaccaagttagtaaatactaaatcattgctcctaagagaatgcaggtttagattcctggagcctctggtcacaatatttttatcaactgatcaatacaaaatcttgttttgtatatgcttctgtttaaagacaacttatttaacatatattgttgatttattaacattgaactcacagccatgagttccacaatataactcatacctcagtgaagcttatctgacacatagattttctccataagctacatcactagtgtttcttatgcctctagaaacactagaaagtacttcagcactacactggaggccattttaaacagtgaaatgcccaaggaaaaccagaaaattttttttaaaaaactggcactaaatagaatatgaaaaggacacttgtttcttgtttacagtatgagaactgaaacaagaaggcagagtgttgtcttgttcaacctcaactgggactcaactgggaacatgtgcaattttccactgctctgtgcacgtccatgaatgagaagaaccatgaaaacaaagaaccatttatgattacaaattttagcaaataagtgaatttccaaatatggcatccactagtaataagaatttaatgttttaaaatacacttcaaaatcaattctttgaaaaatataagaagtaaaaataatttgattcacatgagaaaaaatacaattgcctcaaaaatctaaagggaaacaaaagttccttctcactaataatcaggaaaatgtgacttcagtcaacagtgatgatgatggccgggtgtggtggctcacacctgtaatccttgcactttgggaggccaaggtgggtggatcatttgaggtcaggagttcaagatcagcctgaccaacatagtgaaaccctgtctctactaaaaatacaaaaaagaaaattagctgggcatgttggcacatgcctgtagtcccagctactcaggaggctgaggcaggagaatcactttaacctgggaggcggagtttgccaagatcgtgccactgcactccagcttgggcagcaaagtgagactccatctcagaaaatagtaataataataattgatacctctgatatggtttggctgtgtccccacccaaatctcatattggattatagttcccataatccccatgtgtgatggttaatactgaatgtcaactcgattggattgaaggatgcaaagtattgatcctgggtgtgtctgtgagggtgttgccaaaggagattaacatttgagtcagtgagctgggaaaggcagacccacccttaatctgggcaggcgcaatctaatcagctgccagtgcagctaggataaaagcaggcagaagaacgtgaaaagaatatgctggcttagcctcccagcctacatttttctttcatgctggatgcttcctgccctcaaacatcagacttcaagttcttcagctttgggattcagactggattccttgctcctcagcttgcagcctattgtggggccttgtgatcatgtgagtttaacactccttaataaactcccctttctatatatatataatatatatataatatatatatacacacacatacacatacacggagagagagagagagacataaagagagaaaaaaagagagagagatcctgttagttctgtccctctagacaaccctaatacaccatgtgtcatgggagggacctggtgggaggtaattaaatcacggggatggttacccccatcctgcttttctctgacagtgagtgagttctcatgagatctgatggtttataagggtatttttccccctttgcttggcacttctttctcctgctgccatgtgaagaagaacatatttgtttccctttctgccacgaactaatatagtaaattggtaacacagagagtgggggactgctataaagacacacgaaaatgtgaaagcgactttggaactgggtaaccggcagaggttggaacagtttcgagggcccagaagacaggaaaatgtgggaaagtctgcaacttcctagagacttgagggctcagaagacaggaagatatggggaagtttggagcttcctagagacttgctgaatggctttggtcaaaatgttgatagtgatggacaatgaagtccaggctgaggtgtctcagatggagatgaggaacttgttgggaactgcaataaaggtgattcttgctatgctttagcaaagagactggtagcattttgctcctgtcctagagatttgtagaactttgaatgtgagagagatgatttagggtatctggtggaagaaatttctaagcagcaaagcattcaagaggaaagagagcataaaagtttagaatatttgcagcctgacaatgtggtagaagagaaaaacccattttctggggagaaatcaagtgactgcagaaattcacataagtcacaaggaaccaaatgttaatcaccaagacaatggggaaaatgtcttcagggcatgtcagagacattcacagcagcccctccaatcacaggtcctgagacctaggagggaaaatacggtttcctgagctgggtccagggtcccccgtgctgcctcacaacttggcgccctgcatcccagccactccagccctggtctaaaaggtgccaaggtacagctcgggccatatcttcagagggtgcaagccccaagccttggtggcttccatgtggtgttggtcctgcaggtccaacagaagacaagaattgaggtttgggaacctttgcctagatttcagaggatgcatggaaatgcctggatgtccaggcagaagtttgctctaggggcagagtcctcatggagaacctctgatagggcagtgtgaaagggaaatgtggggttggagcccccaaacagagtccccactgggggactacctagtagagattgttttagaacttaaaggtttaatgactaccctattggatttcagacttgcacggggcctgtagcccctttgttttggccaatttctcccttttgaaacaggtgtatttacccagtatctgtatccccattgtatacaggaagtaactaacttgcttttgattttacaggctcataagcagaagaaacttgccttgtctcaggtaagactttggactgtggacttttgagtaaatgctgaaatgagttaagactttgggggactgctggaaaggcataattgatttgaaatgtgagaacatgatatttgggaggtaccaggggtggaatgatatggtttgcttgtgtccccaccaaaatctcatcgtggattttagttcccacaacccccacgtcatgggagggacccagttggaggcaattggatcagggacagttacccccatcctgctgttctcataatagtgaatgagttctcacgagatctgatggttttaaaaggggcatttccccctttgctcggcacttctttctcctgccgccatatgaaggatgtgtttgcttcccttcaatcttgattgtaagtttcctgaggcatccccagcccagcagagctgtgagtcaattgaacctctttcctttataaattacccagtcttgggcagttcttcatagcagagtgataacttactagaacaacctcttaacaaaaatggtcagataggctgggcatggtggctcacatctgtaatcccagcactttggtaggccaaggtgggcggactacctgaggtcagcagttcaagaccagcctggccaacacagtgaaaccccatctctactgaaaatacaaaaattagccaggagtggtggtgagcacctatcatcccagctacttgggaggccgaggcaggcgaattacttgaacccgggaggcagaggttgcagtgagccaagattgtgccactgcactccagcctgggtgagagagcaaaactccatctcaaaataaataaataacttaattaattaaaataaaataaaattagacaaaaacgatcatacaaacaattcatcccacactgtcttcagctgtccgtacttcatcctccttgtagagcaattttgatgattcaagacaagtgaatcaaaaatacctaaaatgatgttgctatggtttgagtgtccccccacaaaactcattttgaaatttaactgctattttaataatattaaaaggtgagactattaaaagataattagaccatgaggactttgccctcatgaatggataaatgtcattattcttggagtgtgtttgctatgaaaggatgagttcaaccgtctctcattctcttgacctctcttaccctctcaccttctgccttgggatgatgtaggaagaaagcccttgacagatgccagcaccctgatattagacttcccagccttcgaaactgtgagaagtaaatttcttttctttataaattatccagtcggtggtattctgttacagcagcacaaaatggactaagacaggtatggattgaaatgaaaaatgaacggatgagtgggtaggtagatggatggatgaatggatcaatggataaattggttgaatgagtaatgaatggacagatgcaagcaataacttgcaaactattctacaggaactcatggtgccataaggagtcattacgactttttacaacttatggcatttattttttcagaaaatataaaatctttattagaaaaattagatctgcttgtcataaataattcaaacaatgtttaagtatataaagcaggaagttaaagtctcccttgaatcttaagccttagaaataaccactatagctgtatactatacatacttccagattttctgagcacatacaaattaacattgcacatattagaatgcacttattatatgaagttgttttatactatacatactgccaatcctaccaaaactgacagagtgatgtctctgaaggccacaaacaaaacaatttttaaaaatgtgcgtttgtattgtaaataatttatagagaatcttgcatttatattgaaagagcttcataacaatcctacaaacaaacaggaactagcgtcctcattttaaagaagcagcagcagagggtgagttacttgcccaagattttatggccaacaaataatagtcaggccaattactttaactaaattataaagtttctcagagcagaaaccacacataattccagttttgtatcatttacagtacctggcacaaaattataaacaggtatgaggagggtatgatgtttatattgcttactgctctatgccacacatataacaaatggtcaataaacatctgtgaaacaaatggatggaaagatgtataaaagaagaggaaatgggaagagattctaaatgaactaagatacttatcaaaccatcattttttcaatttggacaataataaatacgtttagcagctcatccactccgtaagcataatacaacatgataaccaatatcattgatatcaatatcaaaatgatatcaattgaatatactctagataagagtgacatcaacaattactgatttcctctttaacagtgaaatgccatagtaaaaaatattgaacagtagacactatacacccttattgttgctaaaagaagctattccgtctatttttttaattttatatcaaatattcacatggaatttggctcaaacacaatagatatgcaaactataaaagtataaatagtccatagggactatgggaaagtataaatagtccatagaattactgtgaaatataagtgagacaaggaacgttaagtgcttatcactgcacttggaatgtggtaggtactcaataagtgttagatatcattattaacatcactattaacatcatcatcataaggctttcctaaaatgattaaaaaattgaggctttccaaaggcaaaattatagttcatttattttaaaagttataaaaataactgcacaaaacaataaaaatctagatcacacaaatgcttgacaggaaagctgaaatgcatttttctgtaaaataaatatatgtcccatcttctgcctagatgcagactacaggcatattctccttgagtgcatctatgagagatgaaatgtctactgacctaatttctgtagctattgtatctgtttcttacagccactgtaacaaaccgccacaaacttagtattatagcttaaaataacaaaatatgttttctgacagttattgggatcaaaagtttaaaagacatttcacagggctaaaattaaggtgttagcagggctggttacttctggaggctctaaaagagaatctagggggcatggtggcttatgtctgtaattccagcactttgggaggccgaggcaggtgaatcacctgaggtcaggagttcaagacaagacaggccaacatggtgaaaccccatctctactaaaaatacaaaaaattagctgggcgtggtgatgcatgcctgtaatcccagctactcaggaggctgaggcaggagaactgcttgaacccaggaggcagaggttgcagtgagccaggatggcaacagagcaagacaacatctcaaataagtaaatttataaataaataaaaataaaagagaatctgttccctgcctttttcaacttcaaggggccacctgtattccttggctcatagcctcttcctccatcttcaaagctagcaatgtaacatcttcaaatctctgctttcctcatcatatcacactataagtaccttcataattacattgggcacacattgataatccaggataatccccccccatcataagatcctttagttaacaatatatgtcccttttgtcatatacagtaacatattcataggctctacatactagaatttagacatttggggaggagcattatgctgtctttatcacagtacatcctctggacaccaaataatcacattcttccacatataaaatccattcatgccatctcaacgtcccataaatcttaacccattacacaacatcaacttaaactcaaaatctcaaaaactcaaaagtcccaaatttcctcatataaatcaagcatgagtcagacgcatctgtgaatctgtgaaactggaataaaaagttattcgctcctaaaattcaatgatatgacaagtgtagcgaaacaattatagatatccccaaccaaagagagagaaatgaaaaataaaaagtgagtcaacagtccgaagcaattcagaactgcaactgggcaaactccattaggtttcaagccctgggaataatcctttggagttctcagctctaccctctcgggcctcagtcccatcctctgagtcctcctttctattccataaaggttaacttatgtttgcaaactcagtagtttcataagcctatttcctgcctgcagaatttcaggaatccaacagccttctttcattttatcctctgtccctttaagtccaagctaccaaagtctccgctaataaaccattcatgaaaacactgtgggtctcccaggtatgtcacaagaatttcctggataatcccaactctgaatcccatctcagcgtaattcatctcatcataattcagatctgctcaatctcttcaaagagccctctgtgtggttgaataatctcagtttttgatcctcctgaggcactagaaacaagttatctagccatgctttcagctttctctctaagtacacttcttgacagtgaatctaaaaatttcagtgttttttgcaatctggatagattgagaatgttccaaccatcaagtcctggtttctttgagtttaaatgttcttctcacaatttatctctttcctcctcccacatttcagtataggcaacaagaggaaaccaggccatacctccaacactttatctagaaatctactcagcaaaatatccaagttcatcacctactagatctgctttgcacataaccatagaatataattcctctagactatctgctattatatagcaagtatctcctttcctccagttttcaataacatgtttcctatttatttctgagtccttatcagaagcacctttaacattcatatgtttattaacattctctctacaatgatttaggtattctctaagatcatacaagttctctctaccatttcccccgctttcttctgaaccctcacagtagtgactttaacatcctcgtttgtataaacattatgtttatgacaattaggtaatctctaagaaaatacaggttttctctaccatatcacttctttctgagcccttattagcggcatctttaatgtccatatttctgttcaaggcaatctaagctctttacatcatgctcctcaaaattcttctagcttctacccagtgcccaattccaaagccatttctatatttttatgcacctgttacagcagcactccacttccaggtaccaaaatgtggaatagtttcctagggctaccattacaaattaccacaaacttagttgcttataacaacacaaatttattctctcatagttctcaaggtcaaagtctaaaatgattctctctgggctaaagttaaggtattggcagggctatctccttctggaggctcacagggagaatccacttcctgttttttcagcttccagaggcctcttgcattcctttggtccatggctgcaccactctgacctctacttccatcatcacatatcttctgactctgaccctgctgcctttctcttacaaagaccactgtgattacaccggacccccaacgtaatccagataacacccccaattcagatcctaaactgaatcacatctgcaaagttcctctgccacataaggtaatatattcacaggttgtgaagattataatgtaaatatcttttgggggaattattctgtaaaccacagccatgttcattattaactgatttctgtttaaaatacttaacccatattttcaattacatagttttaagcactaacaccgctgattgcctatcttactgaactaatatcttgccatttcctcatttcaaacgttggttcttttaaaagttttgggaagacgaaatttagcaagagaataaaatcatatattgaattaaacaattcccagagcagttatacgaataatatctcgattcattgttatggttcagagtatctccaaagtatgtagtagttttgttgttgggagagagggggaaagctaaagccctatcacaaaaccgtaactattctggagttgaaagatagctcaggggtcatctccatttcaaggctgagaaaaataaggcccagagaggttaaattattaacccaatgacataaactccaacagagaggagagagtatataaatttattttaatatatctagtgactaactatatagaaatctgatttaacagcaaccacacagaaagctgctgcattttcataaaaggaatttcttaatctcaagttcaggtagttttttatttagctatctgagcttctcaagtcttgaggcaaatgctaaaaaggtagttttctaaacagctagaggaatttcagacaaaccccatcaaattcataaaaataggtatttgccagaatgctacataggatggttatcaagccaaatgaaagaggttccaccgttgtcagtctactgactggtgtggaaaatccaaacatctataggctctataagtaatgtagtttctggcttccttggagaccagcgctctaatggaactctaagacaaatatcttgtcatatatgtgtatagcaaaaaagtacttttaagaaaatcagtaaaaaaaaaaaaaaaaggcacttaaattaaattttgctgtgtccaatactaccaatcctgttatcccttatgaaaaacatcagaaccacttggacacttttaaaacgttattttactaaatgtgtatttggtttcttggttttgccaattacaagataagtaacatagacttgaagtggaagttaagatataaagactttaggaagggcagtaaaaagtgctattgatatgtgaataggcatctcaataaataaaataaaaatactccaagtatccaaaataatcaaacatttcaatatgaaaggaagaaattatgtttgcattgacttatgcaactaaagactcaagtgggctgggcacggtggctcacacctgtaatcccagcacttggggggccaaggcgggcgaatcacgaggtcaggagttcgagaccagcctgagcaatatggtgaaaccccatctctactaaaaatacaaattagccgggcgtggtggcacacgcctgtagtcccagctactaggaaagctgatgcaggagaatcacttgaacccaggaggcggaggttgcagtgagccaagatcacgccactgattccagcccgggtgacagagtgagactccatctcaaaaaaaaaaaaaaaaaaaaaaaaaaagactcaactatggctatggctctgtgtgtgtgtgtgtgtttgtgttcacatgggttatcatgtgtactgtcatttcaataaagatattataatcttattgaattgaaaatatttgcaatacctagcaaaattctttacagcttttttttttctcaatacaatctgatggtaaagaatagagcataaatgtgatgtttaaggctcttttcattccatagccagggtatgaatgtctaggtaaaactcaaaaattgcatcaacagtttgagggtgagtcaaaacataaaatttatcatggctatagaaacagaaaaaaaaaaatacattgccaataaaatagttatttcccctggtaacagaaataaatttcctaataaaaatagaagttaaaaagaaaatgaaaattatacctaagcactttaaacatttcactgaacataattccatatccacaaacacatacacgtggtcttacataaattgaatctcacctatactatgagtttgaaatcagtttttctcttattctttaagaaaaaaaaaggtcagggatatcttttcatgtcaataaataggaaaactacgtaatcatttttagggctgcagactgtcccgtcacagaagctccataatttatttaagcaatcccctattgtaagacactaatgctgtttataattttttactctacaacaaacattgataaacatcctgtaccaatctgtttaccaatttatccaattctctctttaaaataaatgtctacaactagaggagctggataaatgagtatacagagaatgtatattaaactcttgccttgcacagaaaatttacctctaacccttttgaaagcaatttgccagaatgcattaaggtccctagatggtaggttggtggcggggtagtggtctgctgagctgtggagggcggtggggctgagggtggggtggagagggcggtgcccctgctctgaggcagggactactgggtgacagagacaaaggggtgtgtgatggggcaggtcacaatgggtaggggaggataaaagtggtcctgcggggtggtttagcagcagtggatggttcaggttgggaagaagagcagtgggattgccagttaaggttgtggaatcaaagagcaaaggctgttgtgaagtggaatatcaggctcaaatggaggtccctcccgaatgagcactgacacctgtgtgcccggacatccacgagggccccaacacctgtgctcctgacagctccatgcactaagcagggcacagtctggatccaggggactgactgtctctggcattgagcggttggtaatcaataccccaccctccctgttctcagtcacttggggacaaaaaagaaagcctgcagaacacgactgctggcccacctgccagagtagccaaggaaacaggatgcccgctaaagcatgttaaggaaggtgtggagcagctgctgggaactgtcttgatttaaaggaagacatggaggactgctgtatgctaccgtattacacggcccaaagcagccccgcaatgggcatgtttaacacctccatggggaagctgcagcggcaactgtacaaaggcgagtatactatattcaggtatgcacccatgtttgagagcgactttatccagatcagcaaaagaggagaagtgattgacgtgcacaaccgtgcccgaatggtaacaatgggcatcgttcgcaccagcccctgcctcacactacctgatgtcatgctgctggcccgaccagctgctgtctgtgacaatgccaggtgtggtcctgccacccagaaaagagaaagtccgcctgcagagatcttagaactaaccaggctgcttcccttgatgtttgtgaaaataaccatccacaacagcgtaaaaaaacagctccacctgaagcttgccacgggccgctctttttatcttcagctgtgtcctccatcggatgcaagtgaagacctttttgttcactgggaaaaccttgtttacatcctgagaccaccagtggaggcttacagtgataccagggctatcctagctgggaacacattggactcatctgtgttggaggaagtgcagaggagcccagtggtgagtctatgcagagactagatggggcctggatgctttgggggagagcaggtacaggtcctgtaaagcctttggtgctgcagctcacctgggaaatgcattgcatttggaaggtctgaaggccaaatgagcttccatttggaggccatggtacattgaggaggttcctagtgcttctccagggttctccaagcctgaatttcagagatttcttagctgtcagcaactcttcattttatatccacagctgttcattttatatcaatgttgtaatgctgtccaaagcatcctgaccagtctattctgaaacacatactatgacctaggcaggctgatatgttgtaggacgtgtctccctgcaattgccacttatatacattggtggcaacacaacatgtttgtgtacttgtgcaataatttctttttgttgtttacctataggaagagaaaggagatcttgctggtctcactgtctttgcttatttgttctctccctagggatatgccatgaagttttgtgaagagaaggagcaattcagaatcagtagacttcacatgaatgctgaaatgtttgggtccacctattgtgattatacaatagagatatgaatccaacatacctcccacatatactacgttcaagagttcacacacccctgcagtcataaaacctatagtgcctgatgaaggggcagggtagcaacagcagtagtgatgacagtaagcaccaccacaggtaccatggatgtggctgcaaccaagtctgcagactcaggagagaaacacagcactggcaaaagcagccttcagaggtccaggaggaagtatagccagcatggctattagtgggtgcttccatgtcttaatcttgttatagcaagggctgcatgcacattcttgtcctaaaagggtacttcaagcatatcagtaagtgctactggcctctccctagagagcagtatgaatgtggtggctacaggagcagagagatactgagaaggctgttgcattgacagtatctctctgctactcaaaggctgactctctgctactcagcattgggagtcagttatctcaactctgcaggatgaggccacatgcgtgaatgggatggaagccagagggtctctacctagctggattgactctgcagtaataacctcaaagcccagtactacacatggtgcagaggtggacatctcacctaagactgtggaggggaacaatgtgattcaccataataaaatccatcaactcaaattatctgctctaataacatatgctctattgacaggaagggtagcaataaaactaatggcaatttatgatcaggctctgaaaactatctttaactttcccttaactttatattttttaaataaattaatagatgacagaataaaatgttgaagattactctcagatatgatcctacattaggagaattattctaaaactgttttccaaaatataaaatgagaacccaggaatacacacacacagactctctctctctctcctctctctctccaggtttgaatcacagcattgccacacattaactgtgagtttcagtagattgtttctttaaatggtcaccttgagaccatacatgtataatatctggaacatagtaggcactgtgtaaatggtagtgttgagaaacaaattctgagtttaatcatactttccagaaagggcttaattttcccagtctcttcattcttgatttcctttcttaaatcttaattaactgctttgcaattgtcccataaaagctctatttacagtaaatcttctcagtatcttccaagaattttaatcccctgacgctatttagaattctaaattttcatgaatttgtagaaatttcaatctagttacaatggaaagataattgcaaagcactcatcttttacctggttctctccaattttagtattcttggagatagaaaaataaaatgtaatataggatcaattcataatctggacaaaaactggaaattagatcattttagaattgtaagatccacatccatgggattagccaatattctaattttgcaagtaaaaagtctgctcgagtctaaagtaatacatcacatggtttgagaaccagaatgtataggtaacctggcccccaattatgtctgtattgtttccataacactcatgattctgacaagcactgtgctttgaatataaaagatatttgatacatgtttgctggatccaattaagggctataaatgtgaaatataatttattccaatcaaacaaatctggggatataaaattttacatagtactgtactaattgtacagatcccaaaggcccctgtatatattgtaaggaagcagtttaccagtagaccctcacagcgcttacgacttaatgatttttaatggcctccaaaagtgcttcagacctgaaaaaaatggtttcaaaatatgaaaaacatttcacaggttagatgttctagctttgcgaatttcaaggttacattactgagaaatcacatctaaccataaatcacttttcagcaaataatttcaaatgaaaaaatttaaaaataaaacaatttttgtttttcatgtggtacgtagcccagtatcatatgatactggagaccccctaagaagctttaaaatgaccatattgcaaactcttaacagagaccaactttatctttatattcaaggactgtcagcatgcttaccacattgtagtcccttgataatcatagaagggatcattgttaaaagcactgcacattttgtattttttctctaaatcttaatctgactcaatctctttttaaattgtatattcctttggtaaatatttcaatctgcttctgattacaaatcctgatgcttattactatcagatcctgttcctaggtcacagttttcttaaaattctaaaacaatacatatcctgttacctcatctcttgtaatcaaagtttaagagataatttagataatagatactgataataacagaaaaagatttaaaaattaccatttgtgaatggttgagaatggttgaatcctaggtaataaactaaaaaaccagatgaattaaaaaatgttgcaaattgtgtatgtgtgtatgtgtatatactatatatatgtacaaatatactatatatacacaaaaatatgctatacatattatatttttaattgcaaaacttcaaaaattctttaatatattttgcaatgaaaatgtatatatataaacatgttatatatacataaaacatgtttacatgtgtatatatatatatacacacacatatacacacacaaatataaatgctaaaggatagcccttaaacaataatattcacagacacacacacacacacattcttaagaatttatagtgagaggctgggtgcagtggctcacgcctgtaataccagcactttgggaagccgaggcgggcagatcacttgaggccaggagtttgagatgagattggccaatattgtgaaatgccgtctctactaaaaacacaaaaattagccaagcatagtggcgcacccctgtaatcccagctactcaggaagctgaggcaggagaatcgcttgaaccagggaggcagaggttgcagtgatccaagatcgtaccactgcactccagcctgggaaacagagcgagactccatctgaaaaaaaaagaaaaatttatagtgagagaaacattagtaaaatagtcttattgctggtttgttagattaaattcagttaaaaaaaaacacccaaaacctgtatctcaagtacatttatagatttaatgcagtaaaaattaaaatcccaatagagatactttttaaactcaacatagtacttacaaaatacagattttataaagcaagcaatcaagtcagctgctagttttaatttaataatggataataccaacactgagtcatgtggtttaaaaaataggaaggcagaaataaacaagccttcagaagtaaaaccaaaacaaaaggataaaaacgagaggaatatgagttattgttcaatggaaagtcataggaaaactagatatcaacaagcaaaaaataatatagagccataattgaaatttatgttaaaaggagttctaaataagatgaattaaatgaaaaataggattgagaagcttaatcaactggatagtttttttaaattacatgatgcacttgtacacatacaaattaagacaaaaagaaaagctgcagactgggaaagattttgtggtaaatgtaactagaacatctgaggaattaataaacttattgaacaataccagtcttcaccaaggaaatggccaaaggtaaagcaaacctaatattaaaaattgtagaccaaaagcaaggtactaccaagcctaaaaaataataaaatcaaatttagaaaaaagcaaatgttagtaaggtggtagaaaatcagatacaatcatattactgacagctttttgatttgcagtcatctggctaatatagtaaataccctgattattttatttcagtaattatttttaagatataaggcaaagtaatgattaggaaatgtatttttacaaatgcagttttatgaggggaaaataggttaaaacatttaattattgataaactgctaagcagttaagggtaagctaataaaatacaacttatgcttgttaattttctttccctttacccatgtagatatgaggtaaaaaactatatgtaaaaactttaagtgaagacatgacaccctagaatatacacatttgttcactgagattcattcaactattacttcattccaattatttttttttgttttacatccatcagattttgcttgataaagaagacatttttttctcttcctttctttctttctttttttttttttttttttgagacagagtctcactctatcataacccaggctggaatgcagtggtatgatcacagctcaatgcagcctcaacctcccatctcagcctcctgagtagctagggctatgggtgtgtactaccacacctggcttatttttgtattttttgtagagacaaggtctcactatgttgcccaggctggtcttgaacttctgggctcaagcaatccaccctcctcggcctcccacagtgctgagattacaggtgtgagataccacatcgaacccattcttctgatttgccaggaactacgcgttagactgcagatgctgagcatcaaaaggttgaatctctacctttatggagctcacagtttagtatgtatttacaacaattctgtaaaggttacagtaaactgtcttaaagtcctatgaagagattttttaagtactatatactgatttgaatatcctacttagctttctacaacaaattaatattgaaatttgaggggctatgatcaaattatgatacagacatgtggaagacgtgatggtttcttagacataattgtttcgtatttgtcgtgacagaagggaaaatatctttgagatgtaacacttttctggataagtactgtgatttatcttctgtcctggactgctttttccacccacgttctatgtaattaacctcttaacattataccctttcatattaagttctttgcttattgtgcagagatattttcaccatggcttcaaatttcctatctctggaatattttagtcatttctgaaactcctctaagagtgtatggttcacaacccacaacaggaacctgaaggtgatactacagatttaaagtagtcttaatgatagtgaaatgacttgaaactaatagtcaatattttagtgttctggtttcatttttggattttattccaaaacctccagaagtacacattcccattattctacaatgctccattgtgatgtgaaaaatataatcactggctatgcttttaaacagccataatatgtttccttatatctgtagacaacttttactttttaaaaatagcattctttaaactgatatatttctggattcaaaatattaaaacctcataaacaagataacttttctgcattataaccaaactaaataatactaattttttacataaattatgtcttcgcatatgtacacatatgcacaccaagttatatgcacattttacttgacactttgagaaaaaccacaagatccaaaatcacaaagtgaacaagatcctaatttgattttcgaaggggagggagattttatcttaaaaacataggcaaccatttttgttttattgtaccttaataaaagcaaacttttacctgggcaagcatggggaagccaaggttcctacatccattacacggagttaatgcttcccaaagtcctgatggcccacacgtattttcatcatcatcctcttcttccacttctcctggtgacaaattgattgtagatgaggttctctgaaattaaatttatatcataccaatatattatatcaatgatatttagatatcttaacatcaattaaattctataaatgacagtggtatatctcggcaaacaagtcagctcacttttagccacagttacatggctgtgccctgtgcctgagataaaaatatgtatagtccaacttaagttaaaagtgaaaaaaactaggtgtgaaagacttataaaataatatatgaagttcataatgaagaatagaacatgataatggcctaataaaatatttgaatagcaacaaatgagaaaaatcttatggtttatcaagaatttaggtttaggcataaaattaaggaaaaatgcagttagggcactaacaggaaaatattttattgaaatgggaactcctgataaaccagtttgttcagaatgccactgaaataaaactttataaactttcatatcatacatataacaggagtaacagttttaaaattcataatgagacttccatatttagcacatatattttccttcgttatctcccaaatctcactaaaatgatggtagaacatttataaaaatgtttacaccataaaaataaggatgacaggagagatgaacagacaatattaagaaaacttctggataatgttgagtaacttttggataacagatgggtattacctgacttagcaaacatgagaacactgaaagcaaagaaccttcatgtggaaagaattggagggactggctacctgtgaaggtgtaagtgtaggtggggcagaaacagactgaaactcagtatcagaaagaattatacccctagacccatctccttttcacccagccaggaaactaaatctttaccactggcaagaaattagaggtttaatttttgaagaagttgaagcaaaaggattatgaattctaagactacagatatactgagtctccaaaaacaagagaattaatatctatatagtaatgaagattcataacctaccccgtgccttaccatatttgcattagacaacatggcagcacggtttatattcccagataaacaactagaatactcctccctgtagaaacagacctcctaagaaaaaaggtctataaataagcaggaaaatggtgggatctatgtatcaatctctactgtgaagccaacctctcaacaagttccactcacaagaatcatatatttgagaaaaacctcttaacagacaccaaaataaatatagagaaaaaagttataaatagtatcctcagagagaagatatttatagccatgaaacaagaacagaaagttacaaaatacataaaatccaatacaagagtaagaaaaatctgagaaaatttcccaaaagatgaacagaatttaaaagtggagaaaactaggggtcaaaccaagacctctaacatctgaacaaaaggagctccaaaaattaagagtagagatgggagggtcaaagaaataaagcatgaaaatttgcagaaactgaggaaaaacttcactctaagagcctgctgaatacttagcagactcaatttaaaaaaaaagatgtatatgcataaataaaaagaaatacactaaattgtctaaaggtcctctgaatgtagcgttcagcacaacattgatagatcatgattactaaagcaagtaaatatattctacatattggattgtaaatagcatcctccccccaaaattgttccttttaaaaatagaatataagattttatttttcctcctatttaaaagaatttgttttctgcattcacattttaacttccccttgatcacttgtcagtaactaagaagcaatgaaattaagttgtcccccaatcagttgctgtctataaaatacaataataataacaactgttagactgagaacttactatgtgacttggagtatcactggcctattgtctgttaactattttaattcacacaacagccatttgaggcaaatatttttcctctcactttataaatgaggaaactaagggacagagaggccaagtaaaacccaaggtcacgaagctggcaagtggcagaaaaaggattctaacccagactagggggctgcaaaacctactctcccctcaccactacattctgtgaccactcctttggtacaataacctgtggaagacaatatactgaaaaaccacactgatgtaaataattgcagtttaaataaaagaggtatatttggtgaatacgtttctgttacacgagtaaagtcctgagagcattttgccttctgtgacagggagtgaaaatttctgcaatttgatacatagcagcccatgctttcataaatacacacttctcaaatcaataatagaaggtgattatcacagggatttttgaccctacagatcctttgagtaaaataaaaaatcttgggaaatttaaaatcttaatctgaaagagtatatatatatatatgataaagttgttcacaggaataaataaaatgatcaaaaaggtatctcctttaccagctcatgatcagctaacagtttgaccatcaacattgatgcggcacatactataaaccacctcatagttggccaagaattatcaacattttagattaatccattcttttctattttgttaatggtgctacaatgatttaatccaatcacacagggaacttcctctatctctttctcctccctcaaaaaaaaaaaaaaaaaaaaaaaaagcttatctctcttccctgctcataaagctccaattacttcccatttcacagcaaatgatatccaaattccttaatctggcttcagagttctatagtcaaatgattttttagcccttttactttttcactatactcacctcagattataaccaggtggaattgtttacccttgcctaatcatgctctatgcttttattctttctttcaccttacttgtctgcacagcgtattgtagtggttaagggcttgggctctaaaattagacagtcctgaattcaagttccaaatacccgcctcactagccgtatgattttcagcagataagaccattgtcagcctctcttgccttatctatgcaatggaaaacaatacagtggaacctctctcagggctttttcctgatgactaaatgaggtaataaatataaagtgcctgacacatacagcttcaataagtattaactatcatgtttattattttcttataatcccactgattcaaaatagagttcagatttcatcccttacctaaaattttccagatttcccacaagcatgcatgatatcatgttcttctgcttgtctctctttgtgcaaatgtttgcatttggtatttcacattcaccttgagttgatagatgctatagtggcaaagagcattggcttttaactcaaacagatatatgtttaaatcctagctctaccacttccaagctttgtgattttgagcaaatcacataatcttattaatccttagtttccctatctgaaaaaatagtgtaatcatttccacttgcagggctgtatgaagatcaaattaattgcttgacagagactggcacataaaaaatcaataagtactgctattttattttttaccataaaagagttgtgtacacacacacagtgtgcttgtgcaaatatactacacagacacaagtgtggcttatttacccttgtgaagtaagttatttgaaagaaaacattgccttattcacattgtatctcctacaatgtgttgtgcataatgaaacaataaatatttattgaatgaatcactgaataaatgagcttcaaattattattttcatttgactacctagaaaattttactaatattaaggggtgtgtataattgtatcacaaatatcaagattgccattttagctttattttatattaactattacaagtagctttgcagaaatgaagaaacttatcagtggtttagcactgccccctaaagacagcatataaattggctgtgtaaaaccataatttttaacttcatttctttacagttaaagatttgaaggaaaatattttatcaagctacatataatcttcaattatatatgggaagaagccagcggaacacacttaacctcagatggtttcatttattccaaatgctgttcaaactttttactggagaacaaactctgttcctgaagttccagaaagatgtgaaaattctactataaaaaaaaatagacctaaatctatacagtttgaacccattagctttcttggttattacacggtaataaagaaagactggaccaattctatgttgttgcaaattgaaaaacagtcacaataatatactgtagggagacaaacttgagctcaatcaaagaaaaacacttttgagaataattatattagtctaacattgaagaaatgggatttccctgtgaggcagtgtgtgttcgtgtgtgtttgtgtgtctgtgtgtgtgcatgtgtgtatgtgtaaattatatgacaactatatataacggtgcttcataatttataaaatgctttcagatagagaatagcccaataaaatagagtaagaattatccctattttacaagtgaaaaaaactgatgctcaaaatgttactcgatttgcaagatcatactacaaatcagtccagattataatccaagccctctaaatctaggtcctattgtctttctaccacaccatggaagccacctccttaattactagaactcttcaaggggacaacaaatgttcaagattgtcaatgcaaagggaccaggccaaaaggcagaatccaggaaagaggcaatatcagagatggcaatcaaagcaaaaggcaacaatctggaatgagttagcaatctagactactttatagcattgccacacgcctttttgcctttgtttagttctaaagtaaaattgctttatagatttttcaatgaaatttaaagtaatacatgcttattgtaaaacaaatcattcataatgaaaaattatacatgaaagagtgaagctttcctagcctcggtcccacattcagtgggtgtacttccagactttgtaatacttactctacttgcctgatgactttctcacgataaattcataaatgagaaattgtatacaccaaagagtatgcctacctttatctttctttttctttttcttttttttttttttttttgaggtggagtctcactctgttgtccaggctgcagtgcagtggcacaatctctgctcactgcagcctccacctcccaggttcaagtgattctcctgcctcagcctcccaagtagctgggattagaggtgcccaccatcacacctaattttttgtatttttttagtagagatggggtttcaccatgttggccaagctggtcttgaactcctgacttcaggtgatccacctgccttggcctcccaatgtgctgagattacaagcatgggccaccgtgcctggcctaaactttctaagtattgccaatgttgtctttaacctgttcacagtgatcagagaaatgttttttcatatgagaatgtgatcatgttttcctcttccttaaaaccttcaatagcttttcatgttcttctgataaagttcaaaattcttaatatgatccaaaaggctatgcatgatctgcccctacctccctctgtatcccaccactaatctggcaggccaggtctcactaacagctgaacaggaaggcctccatgacaactgtttcagcactgactgagtggttaaattaaatatttaaagctgatagagccagtgcccttatacgaaggctggaatgtaacgaaagcccaccaagagttttgcctaggcctttccagggccttgaagcatgatgaaataacaaaggaattcttaacagaacccgtttagtattaaacaggttttactgggggtctgaaggaactccccagacctccacaaacaagttttattgaggtctaaaggaactcccaaatcttcatgatttagcaggagacaagataagcgtaatcacccctggcacctggatccatctagattgagtaaatttactgaagctccagaggaaggtcttcaggactcagaccttaggtatagatgagaagaagttaatcacttatgtctttagatgaatgcacacttacatgtagacatacagcttagaaggtatataagctctggaaaactttgtaattttgagttggtctggcaatattttccctggccttctccctgtacccgtttacagaagtaaattctcttctttcccagttggtctgcatcttgttattggaccatgagaataagcaacccgacccttggtttggtccaggaacactaacactattcctctcctttgcccataatgtttaaacacactgagcttccctctttccctcaagtataccaaacttcctcttgcctcgtaccttaccttagcacatgtggttttctctggcaaagactattagtcatctcccaatatacagtcccccctcctccttttgtctttagtaacaccttcttttattcttgtatggtactaatactccaacttttagctgggcacatgtattctttgaataaataccacattgtccagtgtctgttgcagctaggtgtgaccacatggctaagtcataaccatgggatataagaagtgctcttgaagtgaataggtgtgcccttcttcctccccttcctcttcctgctgattgaatgctaatgaaatagctggagctggagcatttgtcctgggccatgaagtatccttggaactagaggacctgcacaatggaacaacaaaatagaagaatcctgggttcctcatagaggtgatccctaccagccttggactgcctagctctaagctttagaagtgggagtaaaacaaactctttctctttaagccattattattattttagatgtttttgttatttgctattgtgtcaaaccctaacaaataaattcctttgcttgtcttcatcaggattaatcttattggtgctttaggtataaatataattcacttcctttggaaggccttcttgatgctctcatcaagattaatttcctttcttatatgccttcacagtatcctgcttttctaatagcaattatcacaatgataattttatagttactgtgtgactttggttcagtatctcctatccttagtccataaaagctgcatgattgcagagatgcctgttgggttagctaccaaagcctgatacttggctagtacattgaataacagtttatcacatatgtgttgaaaatgaatgaagagtaaatgaatgaatgaatgccagcttgccctcatagatgttttattagtgtgaacattttcactagttctaagaggaaccaatgtaactataacccagattttaatgtcctttgttctctaactccatttgctcccactgtcttccttccatattcaaaataatgtagaaaacagcatctatttgatttcatgaaagaatacatttatgacaaccattggtgcacaatttacattttaccacaaactctatagcggaggtgaatgggctttaaattgcacagcttaactcctccccctcccctatcaatatttttctccttatagtaataattgggtagaagggtgcttttcatctccccttccaccaagaagaatagaattcttggtgtctatttttgcctgcagactgttttcattagctctttaaattcttctcctctttattatgcaagcaatttcacactaggatacatcttatctgcaaatttgcatagccaatctcattacacaagagatcttacatgagaactattattttgtcaatttaaaaggcaacaactatgtaatagcatgatatatcatattttcctttttacaatcttttaaaaccggggatctaagggcttaatggggcactaagaagaaaacgtgaggtgttaagctggtttacttattccaaagctatgatagtattaatgatcagatagatgataggtcagtgatcatattactcacaaaggaacagactcaaccatcttaaatttagtcctgggagagatatcacatgccacagttgaatatattagcaatgatcagaaaacctactgttaaagccacagttgaacatattagctatgatcagaaaccctactgttaaatacgtttctataagcttagtaacactaaacatctgttcaaaattttctgaaaattaccttgcaaggctaccctacactacctttcaccacaaccatttgttccatgttagtaaaattcacaaaagctgcaacatttaagtctgctgaaaaataaaatttctctaagattaatttggagttagctgtgaatcctgtactgcatttatatctgcaaggaaaagaaaggaagaagaaaaacaagtcttgatgccaatgagtacactgagtacatctcctagtatctgcactctgaaatgacgttactatgtatggtgatattttaaacttgaggatttgccagtgccaaatgtatttcacatttattgaaggacagaattgctattaaagcaattgttttagttgcaagaaatattgaacaagaaagtaaggatagtctttctctttttaatagtacatgagacattacaattcctctgaaacgcttagttccaacacattatgttcctgcctgctgtttacatatttgacatcctttgcataacatcaggaaacttcaaagaacatattttgtttgctattctacttatatacaatcaatttgaacgtttttattatctctcaaaacttttgttcatttatctgacccttacctagtaattaatactgtttattatttcaatattagaaagagctaagtctaaactgatgccaattttatgcacaatacgcagaagctaatttcaaaaaaaaatgttaaagtcaccttagaaagtttaaactttttttttttcaacaagacagtacagaaggcaaaatgtataactttgggaaaactaaattatcctccatgacagatcattttatatgaacaaataacatttttctaaaagtttacttctttgttttaaaataaaattcattaaagtcttatttatatacctaacatgaacccattttatatatttattttttgtattggtacaaatctttaatagaatttttatttaaataggggattcttatgttactttaatgcaaaatagaaagaaaacaaatgaaattttatataaaaattaaaaacctaagagtaaaaaggtagatgtatgtagaatcctccacagtcagcgtacagtatggcattttcaaaaagctgagggaaaaggagcaagaaactgagaaggaagcaaaggagaagaaaggggagagtaaagaaagaaagaaaagatgacatgcacccattttaaatgtacatacctgtgcattcaccaccacaatcaagatacagaacatttccatcaccgcaaaaggttaccttgaatccctttcctatcaatatttccctactggtagccccagaaatcttttttctgccacaatatagtagcatatacactttatgtttggcataagttttctgtaaagcttattaacactaaacatctgtttaaaattttctgaaaattaccttgcaaggctaccctgcactatcttttcaccacaaccatttgttccacgttagtaaaattcactcagcctaatgtttttgagattcattcctacttttgcatatcagtagtttattcctttttaatccaaagtaatattccattgtatggctataccaaagttttgtttatacattcatctatttatgggcatttggttgttttcagcttgcggccattacgaataaagtcgccattaacattcacattaaaatctgtgagtgcccataagtttttgtttctcttgggtaaatatcgaaaatgctaggtcacacggtaaatgcatcaaactttttaagaaactgctaaagtgttttccaaagtgtttgtaccattttacattcccattcattgtgtcggagagtttcggtagctccacattcttggcaacacttaattttagttattctaatgggtatgcatgtagagttatcgcaatagtatgtagttatcaaatggtatgtagaattatcacaataatagtacttttaatatacatttctgccagtgctactaatgtgctaaatatcttctcctgtgcttagaggccatttaccttcttctttggtgaagtacctttacacatttttattaggttgttcgacttctttttttttttttagacggagtatcactctgttgcccaggctggatggagtgcagtggcaccatctcggctcactgcaagctctgcctcccaggctcacgccattctcctgcctcagcctcccaagtagctgggactacaggcgcccaccaccacgcccggctaattttttgtatttttagtagagacggggtttcaccgtgttaaccaggatggtctcgatctcctgaccttgtgatccgcccgcctcagcctcccaaagtgctgcgattacaaccttagcgtgagccaagtttctttgacttcttattgctgtgttgtaagagtattctttttaaatattctatattctagacatacctcctttgtactgttggtgaatatataagaaatctttgcctaacacaaagttaagatattttcctatattttcttccataagtttaagatttttgcttttacattttgatctttgttctatattgagttaattttcatgtacagcatgaggtaaaggttgagatttaagaaacctatttttttaatatataagtagaagtagtcagccccattacttgaaaagattatcctttccccattgaagtgccctgcagtttttttgaaaatcaattgaccatacgtgtatgggtttatttctgaattctactttgttctattgacctgtaaatctcttcttatgtgaataccacattgatagacgtttataagcctggaatcagagaaacctccaaatttgttcttctttgaaattattttggctattctatgttctctgcctttgcatataaattttagagtaagctgtcaatagctgaaaaattagcctgcttggattctgcttgggattgtagtccatagtacaatttggggagaacaaatatctaaaccacattgtccttcatttcatgaacatgatggtatatccccgtaggtattaggttttctttaatttccatcaacaatatttttatagtcttcagtgtacaggtcttgcccatatcctgttaaatttgtaggggtaaatttgtaggggtggtatatctttgcacgtattaggttttctttaatttccatcaacaatatttttatagtcttcagtgtacaggtcttgcacatatcttgttaaatatgaaggggtaaacacacgtttcgtgtttctggaaaatctttcaaatggtattattaggttaatttaattttcttttccctctagcactattggggcataattgacaaacaaaactgtacatatttaaggtgtatggcatattattttgctatatgtataattgtgaattaccacaatcaagccaattaacatctccatcacgtcatatagttactatggggtgtgtgtgtgtgtgtgtgtgtgtgtgtgtgtgtgtgtggtgaggacacttagaatcaactctcttagcaaatttcaagtatacaatgtgatgttattaactatagttaccatgctatgcatttgatctccagaatttattcatcttataactgaaaatttgtaaccaaacttcaaatttgtaccaaattttaaaattgaattttcagctgagtgcagtggttcatgcctagaatcccagcactttgggaggtcaaggcagatggatcacttgaggtaaggagttcgagacaagcctggccaacatgatgaaactctgtctctactaaaaatacaaaaaagtttagccaggtgtggtggcacgcacctgtagttccagctactcgggaggctgaggcaggagaatcacttgagcccgggaggcggaggttgcagtgagccgagatcatgccaccacactccagtctgggtgacagagcgagactctgtctcaaaaaaaaagaaaagaaaagaaaagaaaagaaaaccctgaattttcagttactgatagttcctcatgtaaaaaaaaaatttgatttttatgtttatttactttgcatcttgcacacattttaggtctagttgctttcctatagatattttaggattttctatgtaaatgatcatatcacctgtgaataaagagttttacttttctctttaaaatctttatgcctttattttctagcccttgtcttactgcactggccagaattgccagtacaatgttgaatacaaatcttaagtgaaaagcattcagcctttcaacattatgaagtataatgttagttagctgtggcatttttgtaaaggctttttattataaggttgagcaaattattcctattctcagtttactaaaagtttgtatcatgaatagatgcttttctacaatgactgatatgatcataaggttttcttcctttattctgttaatgtggtaaaatatattaattgattttatctgttaaaataaccttgcctttctggcatatatcccacttggttgtaatgcaaaatttttaagtgtatgccggacttgatttgttactattttattgaggattttgttactgtgtttatgagtgatattgatctatagttttccatttgtgaaatgtctttgttatcacagtaatgctgacttcatataataaattgggaacaacccttatcttttattttctaaaaggatttcaccagtaaaccacctctatgtaaagtttccttgtggggaagaatttcattatgatttaagcttccttaacataggattatttagattttatatttcttcttgagttacttttcctaatttaggtctttcaaataattcttccatttcatctaggttgtcagttattgctacaaagttattcatattgttcctttattattctattcattctcctggatctttattcatatcccctcccttttatttctattggctgtttatattctattttactgatattgattttaatcattctcactttgggtttaatttcctcttttatctcattttttttaaatgtggaagcttaggtctttcatttaagacctttctccttttcctatataagaactgaattctatgagactcctaagcactgcactagctttacctacaaagtttaatattcttggttcttatttgcatttagttaaaaatattttctaagtttctttgtgactttagcaactagattatgatgtatctttgtctagttttctttgtttttgtcatgctttgcatttgttgagcttcttgggttggtgttttcattcaagttagaaatttttcagccattgtttttgttatttttttttgttattctttcattcctaacccctcctctccttctgaatctccaattacacatatgtttcattgcatgatattttttcacaggctctgttatttattttagtcatttttttctctgtattttattttggctactttcatttgcaatattttccatttcaccaatcgttccttctgcaatgacagtctgctgtttattgcatctactttatttttcatttcagatactgtctttttcatctctagatgtttcctttgaactcttttatatctacatttctctattcatgtcacctcttcctttaaacctttgagtatatcaagcatatttatagcaaatattttattctctcatatacaaattctatcaaatctgtaattccaggcctatttttattgactaattttttgcatgttcatgactttcattttccttattttcatgtgtagtaatttttttaagagaaggcttctcactctgtcacctaggctggagtgcagtcatacaatcatagctcactgcagccttgacttcttgcactcaaatgatcttcttgcctcagcctcctgagtagctgggactacaggaatgtcccaccacacttggctctgagtgtagttgtatttctttaaaaattactggacatcgttgtggcatagagtaaagttatctggagatcagtttaattcattcaaggcttgcttttactttttttttttaggtgggtctacagtaacctttactctggagctaacttaaccccactgttaagacttacgttccctctggaatgtctagtgaatgtgccatgtattaagcatgatccctctacttgggctggtagttacttgaatgattgttggccttgtgtgagctccagggatttttctgtttatgtatctccagtattgttctttctttggaggtttttctttttctgtcttcatgaagtttcactcttgtgcagattgatattcaactgaagatacaaagataactttaggttgttttctggacctcttttttggtatagtaccctcttttctgttcctctgcctgaaaattctagctgactcagccttccccaactctagtttctgtactttcaactcagaggattacttgaccctgtttctgtttttctacctggcaccatatttaggaattggattcaggcaaaaagctgggtgatggtagggtttgcctcctttgtatcttttctattagggatcacagtcctgtcttttatccaggtctgatcatgaatgtttgacatatttttgtccagtattcagcagttttcagaaggagccactccataccctattacctcatggaagtttgacaaaacctttaaaggtttgacaaaaacactttttaaaagaagacgtgtattattcatatctgtttctccattttagacctttcttcacttcttaccggctaaataatcccatttcctctattttgtacaaatccctcaaacatattaatattctcttcctccacactgttaactgcacatttatcacataaagttagtcttttctttccatcatcatgcttgtcttgccaatttcctaattcataataaatagatggtcctaggaaaacaatctcacctgtaatatgagagttattcaattaattttttgcatcagtgaatacacataccttttacaaccaacctgaacttcctgtgtgcataatttcattgctacttaacttaattaaaaaattattgtttatgcccaatatttcaaataaatttatttaaatttattaaatatttattgattaaaaactactgtctacaaggctgaactctaggatgagggaagaaaaatataagtatgtcataaactctgaactcaaggtgtaaagacacatatctatacataactagacagtaaaactagaccaaaattataagcattacagagatactaaaacaaggtattagaaaacataaagaggaagcaaccagggcaagtagaggagagaattcacagagtgtttgcatttgagcaaaagcacctcatgagataagaattctgacagagaaaaggggagatgggaatgaggcacagagtttgcatgattaaggcagtatgaatgtgcttgctgtgtctggcaaatgagctattaggaaaggcatggtggggagatggtacatgaaaaataaatcagggctctattatgtaaaactgatagtttaaaacaagttcaacattagtcaaggcacaattttctacttcttattctactgagatcaaaaaatagaaagcttctacgtattagatacaaaaggattcagagactgtttctcttctctaaattcccataattcagatgtttggacaactcaatctattgttttgaactattttctggagattgcatgaagtatatcttatctctgtaattgcaagaacaatattttctattatttgtgtatcctgcaagatgactagcacagttcagggcacatcatgtgtatatacgttttgattagacaactcttgctctttcacatgttctattttgtccttagatgactataaaatagaaatgctttcagtgctgatgtttacgtaaatatgtacttgtatgcatgtgtgtgtgtatattggactgaaacagaaattaataggcatgtttgatcaaaaaaatgtgaagaagtctctcaacagccccgcaatcaaaagataaacacccccattattaaatagcaatattttatccttttcaatatacaacatatattccctgtcttttctcatctttatattgtatacatattatttctatcatattttaagccattttctgggaaagcagttgttcagttacatgaaagtaaaatttgggagaaaaagtatataattaaaatgtatattaactaagtcatgataaatcatcaaaacttaggactgaagcattttatattgaaaataaaatgaatataaattagacattaagtctgttagatcagaagtctgttagaactgactaactctagttcacgacactaaatcaaggtagcagaaataaagtagtatgtggtactactccagatattgccaaatttaaaatgcttcttttgtatgctcaatagcattcagtaaattttttttggttgaaaaatttattaattaacgctagccaaagaaaataaaacctgatgttttctcccccaccccaaataatctttaataaacatattaacaatgctgagtgattttaaaactcttttcttttttgagataaaattttttaagtggaaaagaatttttcagatgtaccaagacaagttcaaaaacatggcaatatccttcaacctatgcaacattctcaccatcttgtcagcatttaattaaatctccctgacccaggttcaaatgccagaattggaatacctgaaccacatcctatctagccaaggcattaaacccatgctggataagtcttctgtctgagataatgaagtaggaggtacccaggacaatcaaagacatcagcaacttctgacttaccaggtttactgttaattcattccccatttcttcactttgatcttcctaatggtgaactaatttcatcttcaagaaaaggaatttttctactcttcatctatggatttccatatctgaaaatccctttcaaatacacgtaactctgaccaaacagaactactccaaacatatctgaccctgtgccactaaatctgtcagttacaacatcaccagggaatgccatcctgtcattgcataaagacaaaacctcttcctgtggcagcctgcagctaataactggttgaagaagtgcagctacctcctccaaactgagaacaattctgaaaggtcaccccagcttctgagttcctgtgatgttggtcaagcagaaacagatcattcagtggacagcacctacagaaaccttctccagtaaggtgtgaatcccaaccttagggagaggtgctctcttccatgattgtccttccttggatactctcccccagccatagaatacctttatagtttgttttacatatttatagttactctcctatcatagtttaataatctttggtgttaaactttcttgggaaacttcaacacagaaatataagcaggaaatgataagaaaagaaaaggctaatgttgagccaaagacacaataaaactggttgaaataagaaaagaatacattatgaaatttaaactattttgtctctaaaagccaaactgattttacataaaatcaaattagtgttttggtggccaaattggagacattcaccaaaatccataccctcaaaaaggtcagaaaacatggtgtatcaaagaaatcaagaacactgatctattctaagaccatataatcttaggtgaaaaagcctgagcagagaatacaaacgaaataatcaaaaatataatagaagaaaactttccagaatcaagaaagatgaggtatacaacaaatgcctggaagaactggaaaataatcatatcaagacatactcaggcaaaatcttttaattccaaggaaaaagaataacctatccaagcttccagaatgaacactcagattgcctactgtactagccaggattcttagaggcaaataatagaaactgactctgttaagtaaatcagatactttgtttttacatcccaaacatccagaaaacaaagaaaatttaaaaatcctgaagtccaccatatctatgccaagaagaaaaaatattatgttgaccttatatttttggaacatatgcaatataaacaatagtataagcattatatgacataaaatgtcaacagactactcaaggtacaaggttataactcaagaattttataccaagaaaagttactggttatgtttaaaagcaagacagataatgcagtcctcatgaataattcttgagataatacatttatcctatttgaaaataaattacaacttgccaagagacaaattaaggaatcaaaaaggtgcaacatgtcatataaagtataattcatgaatattgaaataaattaaatacaaagttttaagcataacaatatttattaatataattatagaatatggttattaatatggtcattattttcagtgaaacaattacatatttatagaactcaagatcagctcaaaattataatttagaagggtaaagtatggcaactagttacaagattaatataaaaatcaacagtctttctatttataagcaaagacttctagaatatacaacaggaaaagaacatgagtcaaaaaatttaaaaatcaaaaattaaaacaactaacaataaccttaaataagaaacgttggtgccctagggaaataaaactaattatgaaataaagaaatacatgtcaagagacaaaggaaaattaatttaaatggagaaaaatgtcataataatgtttgagaaagctgaacttttcaaagatggcaaatcttcctcaaataaaagtgtattggggattataataatttatggatgctttatataagttatacataaagtgagggctgaaactttgtcatattttattatatctaagactagaactgtacataacacacatttgtttaacaataaatactttccaataaatggttaaagtaataaattaatcctagctggacctgcaaggaaagatggcaatatgaatttaaaaaccgctataaaataaaagaaagaagagaagagctaaggaaatgtatgacaaagaatataagtactatgaaaagtaaaacactacaggacttgtgcaagaataatagagtaaatagttctagttcagaactgaatatataatctttattataaaaacacatgaaaaagaagcaccaaagtttataaaaaataagtggattactcaataaactatgatgggaaatgagtttatgtgtctgaaaacaaaacatgcgaattgaagtcttctgtgggaaaaaataggcattttcttttaaaggcatttctactataaatagtagtaaatataatagaagaaatgatttatagacttcatttcattaaaaaaattaacccctgtatttgaacattaatactaaaattctaaaacacgtgaaaactttggaaaattatttacaataaatacaacaaaataataatatccttaatatgcaaagactctatataccagtaagaaaaatagcacggtaaatgaaaagcatacaaaagacttgaaaagatcattttaaaagtagtacaattgaccactgatcatacaaaatatgtttaactactttagtatttatagcaattaaaactcaaatagcaaggagataacatgttttatcaatcaaactggcatgttttcaaaccataatgtttggtgaggggctttgcattgggaatgtaaattaacaaaaatattttgaaggataagttggtagtatgtgtaaagaatctttaaaaagtttcttctctttcagaaattccacttctagttatctatactaagagaataaatgttatatgtatgtgtaatgatattcattattccattgatataaaagcaaataattgaaaacacttaatatttaactgaaaaacactgttaaataaattagagtatatctatgtaagaaaatatttaaagatctttaaaatcatattctcagaaaatatttagtaatatgaaaaattgtcattttattattttaatatgttgcactgttttaaaaagtagtataataaaccctaggaggataaattccagttttaaatgttttttaataaaatttatctttaaatagtgaaataatggcctatttaaattttttaatacttttctgaattttgcaaactttcaatgatcaattcagaatgcttttataatcaaatattactgatgttatatgtgtcaatgaagttatttcacctctaccaatctaacccaaaaaaaggtagatgtgcacaaagattttttactcaaggatatttatcatcatattatatataataaaataaatgtataaacaatctaaatgtttaaccatagaaaataattaaattgtgctacctctgtgtgtatacttttatatattaggatattattactataagtaaaatttcataaaatgttattggcatgggaaaattttcatgaaaattaagaaataaaatgcacagcatgattctgtttcatttttatagtgacttgtgatagggtttggctttgtccccactcaaatctcatcttgaattgtactacctgtaatccccacatgtctttggagggacccagtgggaggtaattgactcatgggggcagataccctcatgcagttttttgtgatagtgagtgagttctgatggtttcataaggggtttttccccctttgcttggcacttctccttcctgctgccatgtgaagaaggacatgtttgcttccccttctgccattgttttaagtttcctgaggcttccccagccctgtggaactgtgagtcaattaaacctcttttcatcataaactacccagtcttgggtatgtcttgatagcattgtgagcatagactaatacactcgcatatataaaaactaagataaaatatattaaaacacatctctgtatgacaggtgaattttcattattcatacatatcctattttccaaattgtctataataagaaaaaacaagctttttaaagaaaaatggaagattattcctccatttagaatcccataatactaagtgatttgttgaaatgttcatcagaatgcagaggcaatcctaagaatttaactgcaaattacagaattttcctatcttcacactttctaattgccaaataatttataaaaataagtaggacttaatttcatgacatgtattaaaataaataaagtaaatggttttcaatttgaaatattccattaagtcttttctaacttgagcttatgaaatgcatgcttgcttcttgtttctttttaggcctttgcttccagaaatgttaaaataacatgattactaaatatatctccaagtttcatacagctactgtgaagtcaaaatctggaaaacaagtagaaaagtggagtacttactgttggcaagaactaccacagatccctaagactattgttctataaatgttaaattataaagtgatacaaataaattagattttaaaagggaggaatggagtaggaagaaggagaatgtgttgtgagacacagtagaacacacaggaagagttgaggtatatatctttattcttactgacatatatcccaaataaatgaaagcaaactcaatatttcatgtattcagattaataacacctatttctaattttaatgtaataggttctttaacaaaaagttttcaaaatatttcaaagggcttataaaagtgaatctttagctttcttctaagtacacttttgcgctcctacatctttcatagcctagacctaatttctagtttctggcctcatctccgtttctaggtcctgctccacagaggtgtgatcaggagggccatgcaccattacaaaattgacatgacttagatcttaaaagcagtaccacttgcccctcctccaaactgtttgtttttttatttttttgttttttttccttaaggctgctcaagaaagtagcaaataatatagcctaaataatatatgatttgttgaggacttttttggaggagaggaaagggatgtgattatttaaaactgcacaagtgggaaacaatttccaaatgcttttcagaaaatatcttgtaattagattctcttttaaaactactaggactttgaagtaaaataatgtctgctgctgagaacactgttgaattgcagttaactcctactagtgatcaaaatgacccagtcaaatctccagctgcttatgtaattctgaataaattctccattttttaagaaggatacaccaaagaaataaagttcagtttgtagtggctcacgcctgtaatcccagcactttgggaggctgaggctggcagatcacgaggtcaggagatcgagaccagcctggctaacaccatgaaaccctgtctctactaaaaatacaaaaaattagccgggcgtggtggcacgcgcctgtagtcccagctactcgggaggctgaggctggagaatctcttgaatgtgggaggtggcggttgcagtgagctgagactgcaccactgcattccagcatggacaacagagcaagactccgtctcaaaaaaaaattttttttcagttaaaagatacccactaaaacaactctgtcttggcaaaaattgcaacacttcaataagggagaatatttggcatgctccattcattactctgttgtggtgtaccttacgagagacaaccaaataagatagaacaaaatctatgttgagaacttactgttctacttaacacaggagtggagtacatactgttaccaagaactgccacagagccctaagactatagttctataaatgttaaattacaaaatgatacaaatcgttttcatgattccaggaagatggcagcctgtgtctgtattctctattccttctccttcctaagtccctggtgtggctacttttcctagaaaataactaagtgtactcttggaggctagaaagaacctggaatcatctgagattttaagtcctaaaaatgaagatataattctggcctaaaacttactggacagtggtcagaaccccttctaggctaacttctcctacataacttggaacaaatgtcacagattcccggataaccacaagcaaggagagaaaattctcctacctgtttactaagagagcccaagtgtccctttacactgtagtgttgggctaagtacaatccatccctgggctaagtacaatccatccctgattgcaccaaacttaaaaaaaaatctctttttctaagcctaaatttcactaaaagcactctggagctaaacactcccatttaattatttattgttgtttaattaccattttcttagagactccaaaacctgagcagtacaggtgttgacagatcccatgtccaataatatgaatgcccattaatatgaacaataaggatcaacaaaccattttatgagacagtggcttaaaagaagaaaacttagatgatcaacaagagtagtagaggtaaaaataacagaggacacacaaaaaaatggggaaaaatgtactataatctcttataaatatgaaattagaatgtgtaaaaacagtgtctagaactaaaagaaagaactcttgaattttaaagttcagttgagaaaatgaaaacgtcactgaagaaaagtaattttgtgttttagaaaatcaagtgaagaaaacagaataaaaatgaaccctgataggtatcaagtacagattaaacatttgtaagttggtgaataatgggataaaaacaaatgaagatgtgatcaaagaaataataaacaaaagctctcctcatctgaagttacactcagattaaaagagctcacttgttaaataatttaaatggcacgtatttaaagataatctgatgatttttgaactctaaagttttgttgttgttttgtttgagacagggtctggctaggtcacccaggctggagtgcagtggcaccatctcgactcactgcaacctccacccccaggctcaagccatcctcccacctcagcctcccaagtacctcggactacaggtatgtaccaacacacccagataatttttttttattttttgtagaaatagggtttcactatgttgcccaggctggtctcaaactcctgacttcaagtgatccgccctcctcggcctcccaaagtgctgggataacaggtgtgggctaccatgactgtccgaactctaacattgaactggaaatattaccagtttcaacaagggaagagaaaagcagatattttcaaataaaaaagaaccaaattattatcaaattcttaactgtaacatcagaagttagaacacaatagaccaaccattgtagattatggaagaaaataactgttaaaaataggcagctggacttgaaatcctgcctaaatatgggaaatggcagacaggagtcaggactaacttgcagcacccactcggatggagagaacagcatgtggagactcacattgtaaacttttgctccaagaactgccataggaacataccagaaaaactgaaagaattcacagatcctttgaaagaagcaccttgttactgcaaactctgtgagacagttgaaaaaatgtcttgaaaagtgtgaaaggggaaaatctgcctccaaacacacatcctccttggggaacctgaaaatccagaccacgggagaaggatttaaacttatctagagctgaaacaaatttagacagccaagcaaaatacaaaagtagaagaagcaggccaggtatggtggcccatgcctgtaatcccagcactttgggagacgaaggtgggtggatcactcgaggccaaaagttcaagaccagcctggccaacatggcaaaaccccgcctctactaaaaatacaaaacctagccagccatggtggcacatgcctataatcccagctggctgggaggctgaggtgcgaggatcacctgagcccaggaggcagaggttgcagtgagccacgatcacgccactgcacaccaggctgtctgttaagactctgtcaaaaaaaaaaaggaagaagaagcagcagcaggaagagccctgtaggcagtctcaggggagccatttctgactttatctcacaggggtctgtgggagggctgcaagtggaactggggaaggaccacagggagaaagaaacttccagctgaacttctgtaataattttgaccaagcatgaattttcctgggcagaatcgggggagggggagaataggaagtgtggacataaacacagaaactgcggcaggcagggaggggtgaagcctgaaatccctgcttgctttctcagctcttagtgggtaggcttgtagcctggtacaagatctcagtactgctcacaggctccctgtatataaactcagtgctattggaggggcgtggtaagagttagactagccttactggctgcatgggagctgagtgaggcccgtcactgccagcttttccccacttccctggtgacctgtataatgtacgagaggcagccataatccccctaagaacataactccattggcctgagaaccacaatcccatcccccacagaagccatagcaagtcctgcccaaggagagtctgagctcagacacacctaacccggcctccacttgatgatttttctccacctgccctggtagccaaagacaaaagacataatctcttgggagctccatggccccactcatcacctgagaatcctgagtacttatccaggcaaccttaaagcaagcttgtatacccctatactatgcagttgatctctcctgaaagtgccacctcctggctagaggccaaccaactcaagccattacagcaactcataaaagaacaaacccactccaaagaagaagaaaacaacagctaattccactgcctgtagcatcctagctaaccagaggtcctgagtctgtccatgtgacaacttcactgctaacacaactagcattgagaaaaccagaacaataaacaaaattacaaccaaggacactcacggagtccacttcacccctctgctacctccactggagtagctgctggtatccacagctgagagaactgaaaatggatcacatcacaggactctttgcagacactccccagtaccagcccagagccaagtagctccactgggtggctagacccagaagagaaataacaatcacagcagtcaggctgtcaggaagccccattcctagaggaaggggaagaacaccacatcaagagagcaccctgtgggacaaaagaatctgaatagcagctctttagccccagatcattcctctgacatattctacccaaatgagaagaaaccaaaaagacaactctgctaatatgacaaaacaaggaccattaacacccccaaagatcacattagctcatcagcaatggatccaaatcaagaagaaatctctcaattgccaggaaaataattcagaaggtcacctaacacataaggactcacataaacttaaggaaaaggggtggaaagagatattccatgcaaacagacaccaaaagcgagcaggagtagctattcttacataaggtaaaacagactttgaagcaacaaaagttttaaaaaacaaagagggacattatgtaatgataaaaggactagtccaacaggaaaatatcacaatccaaaatatatatgcagaagttcccaaatttataaagcaattactactagacctaagaaatgagacagacagcaacacaatattagtggaggacttcaatactccactgacagcactagacaggtcatcaagttagaaagtcaacaaagaaacaatgaacttaaactatatcctataataaatggacttaacagatatttgcagaacattttctatccaacaactgcagaatatacattctatccatcatcacatggaacattttccaagatagaccatatatgataggccacaaaacaaagctcaataaatttaacaaaactgaaattatatcaagtgctctctcataccacagtgcaataaaattggaacaaaaggaaccttcaaaaccatggaaatacatggaaatgaaataatctactcctgaataatcattgggtcaacaatgaaatcaaaatggaaatttaaaaattcttcgaactgaacaataatagtgacacatcctatcaaacctctgggatacagcaaaagtggtgctaaaaggaaagttcatagcattaaatgcctacatcaaagagtctgaaagagcacatatagacaatctaaggtcacacttcaaggaactagagaaagaagaacaagccaaacccaaacccagcagaagaaaagaaataaccaagatcagagtagaactaattgatattgaaacaacaacaacaaaaatacaaaagataaatgacatgaaaagctggttcttggaaaagataaacaaatcaatagatcattagtgagtgtattagtcccttttcatgctgctgataaagacatacccgagaatgggtaatttattaaaaaataaaaaaaaaggtttaattgactcacagtttcatctgactggggaggcctaacaatcatggcagaaggtgacatacacgtcatacatggcagcagacatgagagaaagagaatcaagtgaaaggggtttccccttatgtaaccaccaggtctcgtgagacttatacactaccatgagaacagtatgagagaaactgcccccattattcaattatcacctactgggtccctcccacaacatgtggaaattatggaagctacaattcaagatgagatttgggtggggacacagccaaatcatatcagcgagattaaccaagaaaagagagaatatccaaataagctcaattagaaatgaaatgggagatattacaatagatatcacagaaatagaaaagatcattcaagactacttgaacacctatatgctcacaaagtagaaaaacctagaggagatagataaattcctggaaatatacaaccatcctagattaaaccaggaagcaatagaaactctgagcagatcaataacaagcagtgagattaaaatgataataacaaatcgcaaacaaaagatgttccaggaccagaggaattcaccgctgaattctatcagacattcaaggaaaaactggtaccaatcctattaacattattccaaaagataaacagggaatcctccctaaatcattctatgaagccagtatcaccctaataccaaaaccagaaaagggtatttgaaacaaaagaaaacaaaaaaccaatatcccttatgaacatagatgcaaaaatcctcaacaaaatactagttaactgaatccaaaagcacatcaaaaaggtaatccaccatgatcaagtgggtttcataccagggatgcagggatggttcaacatacacaaataaatgtgatacatcatataaacagaattaaaaacatcatctcaatagacacagaaaaagcatttgacaaaatccagtatccctttatggttaaaatcctcagtaaaattggcatagaagggacatatcttaaggtaataaaatccatctaagacaaacccacagccaatattatactgaatggggaaaaagtgagagcattccccctgagacctgggataacacaaggatgcccactctcaccaattctattcaacatagtactagaaatcctagccagagcaatcagacaaggcacagaaataaagggtatccaactcagtaaagaagaagtcaaactgtcactggtcaccaatgatatgatcatatacctagaaaagtataaagactgatccaaaaagctcctagaactgaaaaaatgaattcagcaaaggatcaagtgacaaaatcaatatatacaaatcagtagcactgctatacaccaacagtgaccaagctgagaatcaaatcaagaactcaactccttttacaacagctgcaaaaaaaaaaaaaaaaagggaaaaagaaatacttaggaatacatctaaccaaagaggtgaaagatctctacaaggaaaactacaaaacactgctgaaagaaatcatagatgacacaaacaactggaaatacatcacatgctcatgaatgggtagtatcaatattgtaaaaatgacaaatctacaaattcaccaaactagaaaaaacaatcctaaaatttatatggagtcaaaaaagagcctgcatagccagagcaagactactccaaaagaataaatctggaagcatcacattacttaacttcaaactatactataaatctgtagtcaccaaaacagcttggtacaggtattaaaaataggcacacaggccaatggaacagagtagagaacccagaaataaagccaaatacatgccggcttgatcttcaacaaagcaaacaaaaatataatgtggggaaaagatatcctattcaacaaatagtgctgggataattggcaagccacatgtagaagaatgaaactggatcctcatctctcaccttatacaaaaatcaacccaagacgaatcaaagacttaaatctaacacctgaaaccatcaaaattctagaagataatactggaaaaacccttccagaaattggcttaggcaaagaattcatgaacaagaacccaaaagcaactgcaacaaaaacagagataaatagataagactcaaactaaaaagtttctgcacagcaaaagaaataatcagcagagtaaacagacaacccacagagtgggagaaaatcatcacaaactatgcatctaactatataaacaaaggactaatatccagaatctacaaggaactcaaacaaatcagcaggaaaaaacaaacagtcccatcaaaaagtgggctaaggacatgaatagacaattctcaaaagaagatacacaaatcaccaacaaacatatgaaaaatgctcaacatcactaatgatcagggaaatataaaccaaaatcacaatgcaatatcaccttactcccagaagaatggccataattaaaaaattaaaacataatagatgttggcatggatgtggtgacaaagggaacacttttacactgctggtggaaactgctagtacagctactatggaaaacagtgtggaaagtccttaaagaactaaaagtagatctaccgtttgatccagcaatcccacttctgggtatctaccccgtgaaaaagaagtcattatatgaaaaagacatttgcacatgcatgtttatagcagcacaactggcaattgcaaaaatatggaaccagcccaaatgcccatcaatcaacaagtggataaagaaaacgtggggtgtgtttatgtgtgtgtgtgtgtatacatatatatatatacacacacacacatatatacacaatggaatactactcagccataaaaaggaatgaaataatggaattcacagcaacctggatggagttggagaccattaccttgagtgaagtaactcagaaatggaaaccaaacattgtatgttctcacttacaaatgggagctaagctatgaagatacaaaggcataagaatgatacaatggactttggggactccagggtaaggggtggggattgaaagataaaagactatgcattgggtacagtgtacactgtttggatgataggtgcaccaaaatctcacaaatcaccactaaagaacttatccatgtaagcaaacacctatttcccaaaaagctattgaaataatacataaaataatagtaattttaaaaataagcagaagaccattagtcagaggctgtctctgcactatgagttgctacatgatgaaccataacctaatttggtatgtaaacaaaccaaaatgtaacttaggagtataacagccaagtttcagctaatcacaagcagccaggtttcagtcaattataggcagccagcttttcacaacatgcccaaataaggcaaaagccttatcacactatgcccaaataatataaatacctcattgtagccaatcagatggtttctcgactttgcttccatgttgaaccaataaaagctcactgctcatgctgctgggcagagctctctgaacctcttctggttctgagtgctgcctgattcctgaattggtctttgttcaattaagctacattaaatttaaattgtcttaagtttttcttgtaataaaactatgaatcaagaatcctattaccaagcaagatatcactcacatgtaagaaaataagtatgacaattatagacatgtaagggttcatttacattatttaaaaattactctaaaaagcattttaagtaactcaaaccacttcacacatactatgaaaaccttagaacagtatactttcatttcctcctatcatttttgtgctgttgttgccatatattttaagtgtacatgttagaaatcacacaatacattttattatttttactgtacacagaagattttaatctcctttaagaagattaaaaacaatgagacaaatttctcttacatttatgcacctatttatcattgtggaacctttcattttttggtagagcaaactttccatctgatatcatttttgccttttgcctggataacttcctttaatctttctatgagaaagatgtgtttacagtgaattctgtctgtgtttgtctgaaaagcttttaccctaccttcacttatgaaatataatttaaatgcaaataaaattataacttgatagttttttcttttagtgttttaaagatatcatttcatcacttcagactcacagagtttataagaaaaagtctggttttattcttttatacatagtactctggtaagtaatataccttttttctctggctgcttttaggattcttctttacatcactgattttcaataattttattttaaatatgactcaatgtggctcctttaagtttattttgcatacagtttattcaacttattggatctgtgggcttagagtttccatcaaatgttgaaaattttcaaacattattttctcaactaatttttctactttcttccctccctttcaggatgtcagttacacatagcttagtggctgagttggtcactgctcactgatgctctgttctattttttttcaatccttcttctttctgtacttcattttagtttctattgctagatcctcaagttcactaatcttttctgcttcagtcctatctctgttattaatctcatctagtacacttttcatttcagctatcatattcattatctccagaagttccacttgagtcatttttttcttacacttctctcctcatgctcatgtatccctttatgtgcttgagcattttataacactgttttatatatacataatataacagctattttgtaaacagctttgctgctaaatctattgtctctgtttctactgatttatttatttttctccaggttatggcttctttacacacaaaataattttttactgtttggtgaacattgtgaattttacattgttaggtgccagattttgttatattctttataaccaggacatagttaattaatatgcagatcagtttcattactttgaggcttcctttaaactttgttaggataattccagaacaatcttttttcaaggccacattatccccattattaaggagagactcttctgagtactcttccagtgccttgtatcttacaatttaggtctcttcttttcactgttgggaatataaaacattccccactctgtgggagctctgagaaccgctgagtattgcttttcagtgggtccttccccagcctcactgtgtgcagttcccacctctccaataccctgagctacaaatcctagcaaattcaagctacctgaaatctaaactctgtctcctcatcaagaactctctccctgctttgtagtctataaaccaccttcaaacacataggtgggtaattgtaaggctcacctcatttgtttctcttatctcagaatttacagacatgtatcgcctaatggccaacaactgaaaacatctgttttatatactgtgtccatttttctagttctttacagtggaaaggatattcccaaaataacaaatgcctcttgatgagagactgatcgttttcggaaaatatcaatataaagaaaaaaggcaccaaggactgtgtctcaagcctgtaatcctagcactttaagaggctgaagtgggaagatcacttgaggccaggagttcgagaccagcctgggcaacataacaagacttggtctctagaaaaaaacatagccaagtatagtggtgcacacctgtagtccaaactacttagaactacttagaaggctgaggtggaaggattgcttgagcccaggagtccaaggctgcagtgagctatgattgcaccatcacaatccagcctgggtgacagactgagatactgtctctaaaataataataataattacatgagcaagtgctaaatttaaaaaaaaaaaaagagagaaaatgcaagttacaaaagttgtgaatttcttacaagtaatatattttaagggttccattgtgtataaaaaaattacctatgtgatcttggactagttatttagactttttagccctaaaatcatctcaattcaaattttcctcaaactgaagaaattttcttcccccaattcacaatcctctacttcctcatcttcaatgttcctacattacactattgtaaatatcccctatttgatattttggtttctagttttaaactattcaaatccatctttcactctaccactagattattctatttaaaacacaaaacatgtcttattcatgtttgaattcctaataattagactggattgttaagacaaatctctctaagaagatctcttttaagatgaaaccaggctaacaattagagccagccatgtagagattaagaaccaggcagagggatcaaataatgcaaagaagaatacaagagtaagcttagtgcgtgtggcaggcagaattttaagatggctctaagattcctactctctgatttacacaccctgtatattaatcctcccctcacatgtcagctcaatctgtgaataatatgcaacatcactcttgtgattatgttatgttacctggccaaagaagttatgtagatgtaatcaagctgggttagctcaagttaatcaaaagggagagtatcctggctgagccagacctgatcaggtaaggatcaggtctgctcacctgaggtcagaaaaattcatctgctggctttaagaaagttagcagtcatgcactgagacagccatgtggctagaatctgagaccagcctcaagttgaaagcaactctcctccaatagtctacaagacaatagaggcctcagttctacaacctcagaagtgaatttaaccaaaaacacatgagcctggcagagaacaactgaacttcagaggagaccacagtcttaaaagacaacttgattgcagccttgtgagaccatgtacagaggacctgttattagtccattctcacaatgctatcaagaaatacccaagaatcgataatttataaaggaaagaggtttaattgcctcacagttccccattgctagggaggcctcaggaaacttacaatcatggtggaaggcaaaggagaagctggcactttcttcacagggcggcaggacagagtgagtgcaagcagggaaatgccagatgcttaaaaagccatcagatctcatgagaactcactcactatcatgagaacagcataggggaaaccgccgccataatctaattacctccacctggtcccaatcttcactcatggggattatggggattaaaattcaaggtgagatctggatggggacacagaggcaaattatatcattccacccctggcccctcccaaatctcatgtcttttcacacttcaaaaccaatcatgccttcccaacagtaccctaaagtcttaactcatttcagcactaattgaaaagtccacagtccaaagtctcatctgagacaaggcaagtcccttccacctataagcctgtaaaatcgaaagcaagttagttacttcctagatacaatgagggcacacacattgggtaaatatagccattccaaatgggagaaaaaggagctacaggccccatgcaagtctgaaatccaatggggcaatcaaatcttaaagttccaaaataatctccttttgactccacgtctcacatctgggtcacactgatgcaagaggtggtctcccatggccttaggcagctccacccctgtggctctgcagggtacagcccccatactggctgcttccacaggctggtgttgagtgtctgccggttttccaggtgcacagtgcaagctgtaagtggatctatgattccgaggtttggaggatggtgaccctcttcttgcagctccactaggcactgccccagtgggaactctgtgtggaggcttcaaccccacattttccttccctactgacctagcagagggtcttcataagggctctgcccctgtagcaaacttctgcatggacatccaggcatttccctacatcctctgaaatctatgcagagattctcaaacctcaattcttgacttctgtgcacccataggctcaacactatgtggaagacaccaaggcttggggcttgcaccctctgaagcaatggaccaagctgtacctttgccccttttagccatggctggagctgaagcagctgcgatgcaaggcaccatgttccaaggctgcacagagcaggagggccctgagcccaccctacaaaaccatacttcctcccaggcctctggacctgtgatgggagggccttctatgaacgtctctgatatgccctggagacttcctccccattgtgttagtgactgacattcagctcctcactacgtatgcaaatttctgcatcaggcttgaatttctccccagcaaatggtttttcttttctattgcattgtcaggctgcaaatttttcaaacttttatgctctacttcctcttgaacactttgctgcttagaaatttcttccatcagataccctaaatcatctttctcaagttcaaagttccacagatctctagggcaggagcaaaatgctgccagtctctttgctaaagcatagcaagagtgacctttactctagttctcaacaaattcctcatctccatctgagaccacctcagcctggatttcattgtccatatcactatgagcattttgatcaaagccattcaataagtctctaggaagttccaaactttcccacattttccagtcttctgagccctccaaactgttccaacctctgccaaagttccaaagttgcgtccaaattttcaagtatccttgtagcagtgccccactctcagtaccaatttaggacccagttaagctatgcctgaactcctgacacacagaaactgagataacaaatgggtgttttttaaatcatgaagtgtgtagtaatctgttacacagcaatagaaaactcatggaatatgtttaagaggcaagaacaacaaaagccagtacaactggggtatggtgggcattttaagataaaaaatgggataaattgttaggagattaggttggcgagatagatgagagtcaaattctgtgaaaatttgttgttaaaagtgggaagttttttataattttgcttgttaagtatataagaaagtcatcactgagatttaagcatgggaagaacctgattggcaatttttaaagaacattctggatgctgtgagtaaaatggattgtaggaggggaataacagaagaaggaatgagactagttagaaggctgttacaataatccggtgagaattgaagaaggctgggatagtggcaaaagaagttagatgtggtcagatagcggtcatattttttaaagtggagttaacaggaattattaatggatcaggttgagggtaagaaaaagagatgaggcccagcgcagtggctcatgcctgtaatcccagcactttgggaggctgaggtgggaggatcacttgaggtcaggagttcaagaccagcctgggcaacatggtgaaatcctgtctctactaaaaatacaaaaattagctgggcatggtggtgcatgcctgtggtcccagctactctggaggctgaagcaggagaattgcttaaacccaggaggcagaggttgcagcaagctgagatcgcaccactgcactccagcctgggtgacagagcaagattctgtcaaaaaaaaaaaaaaaaggaaaagaaaaagaaatgaatcagggatgactttaagtttttgacttgacgaactaagctgatggtgggttgtcgtttattaagcaggggaagtctatgggaggaaccagttggaatgacgggatggggaaaagcatgtgttctacttcggataagttgttttaactgcctactcatcacctgaatggtgatatcaggttagcagatggttatacatgtctcaaactgcaggcacaattcagaactagaagtaacagagtcattggcatgtaggcagtatgtaaagcaaaagtactggatgtattactttgggcaagtgtgttaattgaaaatacaaggttttctgtgcctaatccctggaaaatacaactgacatatttgaggtacagcagaggaagaggagtttgcaaaggagacttaaaaagagcagtcaaggagggaagaataaggaaaaatagtataaagtcatttaaacaaacagaagaatgtatttcaagaaagagaaaacaatcacactttatcaaataatgctgaaaggaaaaaaataaaatacattaggtcagagaagtgatcattggattcataatcatggatatttaaatggtagacttaacaaaagaactgttggagtactggttgtgatggactgcccattaaagcagagacaggacaaaatctaagtgtaaaaaaaccagaaacaataatgacagtagatatctctttcaaaatatgtcactgtgaaagggttcagagattgaagctattgtgttgtgacagctggggtcaagagattttgttttgtatggttggcggtaagatgggatatatcacagcatgtttttagaaagtacattggtatccagcatactattgcaataaaattaaagctgaccttatctgattctacctaactgaattttaatgctaaataaagccaaaactttagccagttcaggatagtcatcatatacatgatggcaaaatgaatgttaaaaaataaacaactacattgagagaagataccaggcatccagagttattcataagttaaatgactggttcctacacactggtctttcaacaaatattttttggactttttttttttttttttgagatggaatctcgctctgtcacccaggctggagtgcagtggcgcgatctcagctcactgcaagctctgcctcccgggttcacgccattctcctgcctcagcctcccgagtagctaggactacagatgcgtgccaacatgcctggctagtttttgtatttttagtagagacatggtttcactattttggccaggctggtctcgaacttctgacctcatgatctgcccacctcagcctcccaaagtgctgggattacaggcgtgagccaccatgcccagcccttttttggacatttttattcaaagttgtgagtaccaataattttctataaaagcattagaattgtcagactatgagatgggcacggtggctcacacctgtaatcccagcactttgggaggctgaggtgggcagatcactgtgtgtggtcaggagttcgagaccagcctggccaacatggtgaaaccctgcctctattaaaaatacaaaaattagctaggcacagtggtaggtacctgtaatcccagctactcaggagtctgaggcagaagaatcgcttgaacccgggaggtggaggttgcagtaagctgagatcatgccactacactccagcctgggtgacagagtgagacttcatctaaaaaaaaaaaaaaagaattgtcagactatggatggacttaccctctattttccaaccatctgtaatatttctatatggagtttcaacaaaaagtaatgacattaaacatgatactgtaaaagataaataaaacctcagctgaccaaagcatcataaatgtaatatcttaaaataataagagcataattatattaagacctacagaattatccatgtctagtgaaacataaagtaacaattttaagactaaaattgtaaagagttaatggttttcaacaaacacataccaaaaattaataattaatttttaatccatagaattttagaccataaaaagatcttacatgttattttgctcaacctattcctagtgccaaacttctttcttcagcatctctgggaaatctatgcttcagcttgaaaatgtccactaagaagctcatgctttctcaaggcaagtacagtggaacagctttcatatattaagctaaaacctgcctctcccaaacttccactcattaatcttagttttgtccttggaatgcatacttagaaagctctgaaattaaaggaacagggtctttacaaagcaaactgtttgctttcaaacttttgttactaggaatatctcaaagtgggggggaaatagtgcttctgtgcttaacaaatgagctctgtttataatcaaaaaagtaaggtttacataaattatttattatcaggaaatccctaaattcagaagtagcctatagaagttgacgttttaacaaattactaaaatcagcttttgttttgttatctgatgtggtcaaagtgttatgcatggctagatacaaatatagcaaaacttcaaactcacttcctcttttcttctaatttaatatttactgattaaatcaaattttaatatgcacttgcttctgcagtagaacagatatctcataaagacaaaactcccactgaacgtagtggtagtcatcagtgctcacagtctaatgtgcactgcaaaaacatgtagagaaaaatccattaaactacattggctattgattcttttctcctgagaagttccagccagaattcattgctatcactgtcttatgcatggtggtgcctcactaatgaaagattcagatttttttaaagggtctacctggcctaaataagatatgccacttaaaattagattcataataaaccaaacaccgcatgttctcacttacaaataggagctgaacaatgagaatacacggacacagggaggggaacaacactcactggggcctgtcgggggagggttgggggagacagagcatcatgataaagagctaatgcatgcagggcttaatacccaggtgatgggttgataggtacagcaaaccaccatggcatatgtttacctatgtaacaaacctgcacatcctgcacatgtatcccagaacttaaaataaaataaaacttttttaaaagatggtaacaatagacactggggactactagagcgcggagggtggaaggggagcaagcatttaaaaactacctactgggcactatgctcactacctgggtggagggatcacttgtaccccaaaactcagcaaagcacaacatacccatgtaacaaacctgcacatgtaccccttgaatctaaaataaaagttgaaataaaaaataaattaaaaagagaaattttttttaagtagattcataaatttcacaatttataaattaatacatatatggttcgttgttcatctcatgataaaatcacttggaaaaactccaaatgtcattaggaagatacctataagatgatgtagagtcattttatggagtctacgatatattgttaagtgaaaaacaaaagcttcatatcattcctactcgatttcaaggtgtactataaagctacaataatcaagacagtgtggtattggtgaaagaatagacaaacatattagtggaacagaataaaatccaaaaataaacacataccaatacgctcaagagatctttgacaaagtagcaaagcaagtcaatgtagatagcgtttcaacaaatggtgctggaacaactgaacatccacatgtaaaaaaaaaaattagacacaggtcttacacttttcacaaattaattcaaaatggatcataagcctaaatgtaaaatgaaaagctataaaacttctagaagataacaggaaaaaaatctagatagtgttgggtttggcaataacattttaggtgcaacactgaaaacatgatatataaaataaaaattgataaattagacttcatttaaacttaaattgaaaaattctgctctgtgaaagatactcttaagagaatgaaaggacaagccacagacttggagaagatcttggcaaaacacatatctgataaaggactggtattcaaaatatacaaagaacacttaaaatacaacataagaaaacaaataacccaatttttaaaatgggcaaaagatcttaacagctacttcaccaaagaagatatacagatgccaaataattgcatgaaaagatgcgaataccatatgtcactagagaactgcaaactaaaacaacaatgacataccactacgcatctaccagaatgactaacatataaaacactgacaacaccaaatgctggtgaggatgtggagcaacaggaactctcattcattactgtggaagtgcaaaatggtacagccactttagaaaacagtttggaagtttcttacaagctaagcacaatcctaccatgtggtctagtcatcacactggatttatttcatttgagaatttatccaaatgaaaataaacccacagaaaaatctgcacaggaatgtttatagcagctttattcataattacccaaacttggaagcaactaaaatgtctttcagtcagtggaacagataaacaaactgtggtatatccatgcaatgaaaaattattcagtggtgaaatgaaataagctttcaaagcatgaaaagacataaagaaaccttaaatttatattactaagtaaaataatccagtctgaaaaggctacttactgtataatttcaactatatgacattctgaaaaggcaaaactatggagacaatgaaaagatcagtggttgccaaagttctgggggataaagcaagggatgaataaggagaccacaaaaggtttttagggtagtgaaactattctatatgttactgtaactgtggctacatgacattatggatttgtcaagagccacagaactgcacaacacaaagagtaaaaccctatataaacaatgaactttagttaataataatgtatcaatatcagttgaacaattttaacaaatataccacattaatgtaagatgttaataacaggagaaatgggagaggtagcaggtatatgggaactctgtactttctgctaaacttttctgtaaacctaaatttactctaaaaagtaaagtctattaatttttttaaatctataagcaaaaatgtatgcatacatagcatgcttttgattaagaaaaacggggcagaaaacataggaaggataaaccagaaaaacgttagattacctatatggggtgggtagaaagagcagaaggtataggaaagaggtaggatttctctgagtatacctgtttatatagttttgatgacatattaatattttatataataaaaacaaaactaaatcaacaagaatgttgtggaaagtccttataatttgctaaaaacaaaaacatataaacctaattatatatcaaatagataactatatagaataaaataaaaacaaattaatccaagaacgttttgaatacaatactgtttccaccctcagtggaaatattctaaggaccaaaataaccgcaaataaaccttgaatttcacttggtaaatttggtggcattgctggtattgtacagcaatttaagtgtgtgtgtgtccgtgtgtgcatgtgtgttgcacaagcacatgtacatgtgttaaaaatgagtaaataggcggttacactgacactattgggaactgggattttcaccatgaaagaaaggaaatacaaatatggattgaggaacagacagaatttgtggctgaagagaataaatccatgacttaagaaaaaaaaatgctttctaccattacctactaaaaggttcccgaagcaataacactctacagcaaacaataagttcctttgctatatatttaagcctcgggtttatgaatctaacattgcgtcttatctgtagttgggacatgctgtttcattcttggaaaatttctttttcctcttttttacctgcttaatgcttactcattcttaatgtttcagctaaatatgactatttctggaatataataaattaccatcgatttctctccttaaggcctatgatgacttcacactacttaatagatatccagatatacacactctgcccatggttttctttatcagattgtgctggactatcttatctagcttgttttcttcctactgctgttctgtgtgtgtgtgtgggtgtgcacgcacgtgcgcaagcacatgtgcgtgctctttattagctctaacagattttcttatttttcaaatttattcattcacttattttttcattcattcagattcattcaatgacacaggcagtgtgccagtgagtctcccaagttccattctatacttgggaacatttcattgcccccctgccacccacttcacacagacacatacgtgtgtgtgcatgtgtgcacatgtgcacacacactgctgaaattctacttctgtaaattcttcaattaatggaagagaagtcaccatttttccatgtgttttttctttctaaaattgtgccatccatgaatctaccattcaaataacagtgattcttttcataaataattacttacttaatttatgttttgctcagctctatctcttcagtgctgactttcttaagctataaaatcctggagagtaaaaatatatgccttttcatcccctttgcccttagtccagcacctgagaagccgttaagaaataccaacaataataatgcattatgcacagtggttgcacaataaatattgacagaatgaaaacaatacccttaataaatgtgaaagaacagagtcttcttgtattgctgttttaaatatcccgtaacttctggtcaaatctccttacttgctaaacgatacaaaaattaagtaatttgtaagacttgctcaagattttatacttcaggatagagtgtatattcatcaatgcaagtaactaaaatgtagaagagtaaaatgaattttgataaagttattccattttaatttcaacacacaggtgctggcactgataaatgtaacctgaaggtttaattcagagaaatctttgccttcaagcatatttaaaataagctgtttgcattttcctgcatataattattctaaccctgaaagcaccttttaaatatggattacaaatccagctgccttaaaatgaaagtaaaaggttttcctttctcagtctattttgtaagttggaaattaatgtaacagaactattttgagcttagagagttaaaccttctgactaaattcatgcttaattttttaatgtatttgtgagtttaccaaggtttgcacagaagacaacttttaaaatatcaaaaaaattaacaatgcttcatttttttaacattgtaatttttaaaattagtcatctctcctcctagagggatacttcacaaaagaggcatcccttgatcaggcagggtttactcagccaagtgcttggaatgaacccagaggaaccaaaagccctgatatttctggtatttatttgcaagaaacagtagtctccccatacccataggggtgagttccaagacccccagtgaatgcctgaaactgaggatagtacccaatccaactgccatcaataggaacatgcttcttttcatgtattctactcacaaactgaaagcctttgccatattgactaaggatttattacacactgtggctgtaccttttgcagtttgaggtgcaacaacaaagcgagcacgaattttttttccttctttacaatttcatgaatggaagtctcatccctaccatagatcttagcaacctcagcacataatattttttttctttattgagaactttcaccttttcacttaaagcactttacagcttctccttagcatatcccaattgccagcatcattacttttgtagtggtaccacaggtaactgaaaccacgaaagtgaaaccctggataaaggggaactactgtattcccattctaattgctaggatcctgttcctaactggaaactaactttagaatatgctagagaatttatgttctgcaattcaataaaacatgtgattgcccttgacagtctcaggtcattgacttgaagcagaaagttttgcttaatgactacagagcagtcttccaatccccacctgctgaactggtgcttatctcttacttgtaatatcttgtaaggaatgcaagaaacctacaaactctactattctgattatttctacaaaggtgacctttggtgagtacgtggtctaagtcccaagaaacaacacattatagtttaactttgttaccacacttcaataattgtttctcaacctggtatatagaaattctaaccaggctcctgatccattttgcctatttcatatcttagaatctcttggttgtgccaccacttcctgacaccagttgagacactttggggttgcaagtgggtttgcactttggggttgcaaaatccaactcaaactagcttaatcataaactggaatgtattatctcttggaatccagggaaatgctaaacaatagtatatagatgagcctcaataaaaatgaaccaacaacagatatgctgctgctgctttttttaaatcttgtatttttttatttttatgggtacatagtaggtgtatatatttatgaggtacatgagatacttttatacaagcatacaatgtgtaataatcacatcagggtaaacgaggtatccaccacttcaaacattcatcatttctttgtgctacaaacattccaattgtattccctcagttattcacaaatgtacaacatattattgccgactacagacaccctgttgtgctattaaatactagatcttattcattgtatctaaccatattcttatactcattaatcatttccccatccccgcccccaacactaccctttcccagcctctggtcaccatcattttactctctgtccccataagttcaattgttttgatttttagatcccacaaatgagtgagaacatgcaaagtttgtctttctgtgcctggcttatttgactttatataacgtcctctagttccatccatgttgttgcaaatgataggatctcactttttatgtctgcatagaactccatcatgtatatgtgccacattttctttatccattcatctgttgatggacacttaggttgcttccaaatcttggctattatgaatagtgctgctgtaaacatgggagtgcaggtatctctttgatatactgatttcctttcttttgagtttatatctagcagtgggattgctggatcatatggtagttctatttttagttttttgaggaacctccatattgtcttccatagtggctgtactaatttacattcccaccaatggtgtatgagttttcccttttctccacatccttgcctgcatttgttattgcttgtctttttaataaaagccattttaactggggtgagaggatatctcattgcggatttatttgcatttatctgatgatcaatgatgttgagcaccttttcatatacctgttggccatttgtatgtcttcttttgagaaatgtctattcagatcttttgcccatttttaaatcagattgttgtatctttttcctgttgagttgtttgagttccttatacactctagttattaatcccttgttataggggttgtctgcaaatattgtctcccattctgtgggtcatctatttactttgttgattgcttactttcctatgcagaaggttttgtttgattgccttttttttatttgagacagcgtcttgctctatcgctcaggctggagtgtagtggtacaattatggctcactgcagcctcaacttcccaagctcaagcaatcctcccacttcagcctcccaagtagctgggaccataggcatgcaccaccaaacccagctaattttttttttttttttgtagaggcagagtttccctatgttgcctaggctagaagctttttaacttgatgtgattacatttgtccatttttgctttggttgcctgtgctttggggttattactcaagaaatcttcacctagaacaatgttctagagagtttccccaatgttttcttttagtagtttcatagtttcaggtcttagatttaagtctttaatccactttcatttgatttttgcacatggtgaaagacagggtctaatttcattcttctgcatacagatatccagttttcccagcaccatttttgcaatttagatttcattctctttcattataaattttgtttctccacaaggcaagaaacataaccatcaaacatctaagttttatatcttaaagtttctttggccattaaaggaaacattgactctctttctcttgattccagttttaaatttcctgaaaataattctgattggcctgacttgaattagatcaatctgaaatattccattgttgagatggcataaagtggccaactgtcctggtttgcctgaaactaaagggtttcctgggatacaaatgcattgactctgatactactgttgattatttgtaatagtaaatgaaacatcatgtctaatgtattctgtgtgcttcaaatctttttaaaagaaactgaattaactaactggcatccattgctcttctcaaaaatgtttttatattttgactgaaacccaccatgtgttatggttatctcctttctttacgtttcagtatccctgaaacatattatcctgtttcacgcctcgtatctttacatatggtatttccacccctccctccttattcatgtgtcataatcctcttcatttaaactcagctcagacactgcttttgtgaagtcattgtgaatcctgttctcctcccctgggagagttagtcattccctgttttgttctctactcccaggatatatttctgtacttgtctcataattctgttttataatgatttatttacaaatatatctcatcactatcctataaggtatatgaggccacatctttatattcccagtgcctagcgcaaagcctggcataatggcagtatccccataaacgtttgataaatcgaaaaatctaaaataggaatattttaaatttggtttggggcatcaggtatcatgtacctattatttctatgatcagtctctgaataatagccagtatatctggcatatttgttaacatttaaattacaaatgatagcgtatcaagaataatgtgattactaaaaccagtaacgtgatttgggcctttaaagaagttaatttcaagcttgactttgctgtaggcccaaagtttataacttgttcctaaatagaagttaaatgataccaaaatagatgtataaataagaacagaaagtatgaacataatcagccctgttctctgacaggtgggttggaggctgaggatgcatcaaacagtaaggaaagtcctctgtgggctaacgtgggagggataatttggcttcctctctccacaggcagatggaggccttttccccctgcatagtttctgagaatgcaatgaggaaagatgattgggatgctcatgtggaacaagcatactatttggcttacattaaaaaatagaatgaaatgagtatccctagggagaactaacttacccaagacacttcaacatttctagactcatttctctgaaacagtctagaaatagaaatatatacacatattagactacatctagaaatgtatttgtatatgtatttctagacacacacatacatacacatacattacataatatatgcatacacatacatatacacacacacacacacaaactctctaatgaaaactgtgccaatttcaaaagtgaagctaaattatatttcagttatgctcccttgcatcacaaaatgaggctctccagcttaatattggcattcccaagccaggtcaagaaagtaggaactgataagctgtctggtataatagttctctagctaaatctctagaaaggtgctgcatctgacatttcttcaaattagaggaaatttcataagacttggtagggaaaaatatgtcagatgacagatatgtatatcttctttcacttttgcccaaaacgtcattaaaatgatagaaatatatttgtaaaggcataaagacataaagacaagcagaacaagaaaggaaactacagtaacaaaattctggatgctataaagtagttacatgacaaatgactaagcagacttgagaactggatccaaagctagccatagaaaaaactaaaaatcaacctggtaagactacagaggactcatgaattccataccagatatgtctgaaagaataggtgaataaaaaggcaaaaatagcaactatgtgaaagaatattttaaagcagttagattcccatatgcctttctcactctatagcctggtgactatccgtccctcaatcttgcaaaacactgaagatttcttctcttagaagagtaaaacagttctctaaactaatcacagtttagggtatggtaagataatgaaaataggtgattgagaaaacaggtatactggatgttgacattcctgtgtgccctctttccttaaacagccctaagaacttcccattaggagcttaaaagagggatttcctaggatgttccggtcaaaaggaaagatctaaagatgctgttgtcaagacttctccaactaaacggaccaatggaatcaacctaaagcaaagcttatagtgacaatggcatctagaagacaatatggtcattgttttaatttctctagggaatttattctcaacactagaatttcacatccagtctatgaagcaagagtgaggacagaataaagacatttgcatgaaattactgggagatgtgctgcataaaacaagaaaaggcatggcatacagaaatcaagatatccaacaaaggaaagaggcaataaaaatccccaaatgatggagaagaattgcaaggttgatacctatcagaaggagtagaaggtgaccagtccggatttaaatgaatggaaaggctcaggtgagattcttcagagacatgaagcatatagaatacctgatacacataaacatgttaagaaaagatgaatctggaattgtgttgactatatatacatagaaaatcaatcacaattaggaaagacaataattaatcctaggggaaataaaacattgtaatggaaaggaagaggaatcagggtttagcctatggatcagtaacattataaataatgtctgtcgacaaacataacaagtaaatagagaagactaatctaacccaaattttgcaattaatgtgttaaagagatagtcatggaaaacatgtgtgtgcttgtgtggggtactgttatagtaagcggtaggaaagagaggaatgccatattccatagtgggatgtcaatagataatgtctaaaactgaaacattaaaaaggagcaaaacaaatagattagagacataaagataaatacccagataactagataaaagagatgaaggtgttgggaggaagagaagaagatggttggggtactgctttttaaaataataataaataatatataaatatttgacaattcaagtaaaatcctctaaaacttatataatcttgactttatgatattatataatttacctaaattgaatgcatcaattctcacccataattactttttgtaagctcaaacattaagaatttggcaatgtcttataactcgcttctgtgttagggacctatggcagaaaaactctgaaattacccccaattatccctgtttctcatgcctttgtgtaatcccctccccttgagtggaagcagaacctctggtttgtttctagctaatagaatatgacaaagacaatggcatgttaattccatagttatgtcacataagattgtgacttccattttgcaaacataccctctgttgattctctccctttctggctttgatgaagtaagctaccatatggaaaggccatgtggtaaggaactaagggaggcttacaaactgaggctctcggtcaaggaattgaaagcattcagcaaggaactggggtcctccattgacaaaccacaaggaactgaattctgccaacagccatgtgagcttggaaccagatccttccccagtcgagccacagacgaggtcccattcctgggtgacaccttgattctagtcttgtgagagaacatgaaacacaggacccaagccatgcttgaatacctgacacacgaaactgtgagataataaatattttgcataaggcactaaatttgtggtaaaatggccacacagcaatagatgaataaaggatctaaccaaaagagaccatgatttgagcacctctccaactcaggtgttacaaaacaaagattgttgagttctgcttgtcagaggtatgaattctgactgattgcccaagcctccagtttgtttgcatcatccagctacttaagctgacactgctacacctaaggttcagcacggcaacctcagatgacttcattctgggctacgtcatccagaagtcataaaattatctcccaaatattaaagaatttaaacaaattactatctttagcagtgccaatcaaatgtcacccaagaggtaaagtaatattcacttcagtattttagagggaaaagtcataagaggtaacacataatagaaatcttctatttaataaaatgttaagagtagatgggaaaaatcaagtttttcaccctctaaaaagcatacattctaattacaacacattaaatatttaacaaatcctgagttctaggtaaatggaaaggaaatttcctttgcttttaatttagaataaaaggtgatatgtgggtggtgaaatggtgcagcttacagtgcctacattattgtacagaaagaaagggcagcagggagctagaattatagaagcaggaaaaaaatggtatgacaaccaggtaggcagcaatagccatttgactctctacctaccagctctcataggcttcgctgtcttagagttattataactatattgctaaaggaaaaaaaaagtgtggttatttgttacttagctgtccttatcacactgactcagaaatcaggtgtatgtgtgggagaattttcaaaagaaaatccacatacagctgtgaatcactcacctgaagaacaatgagccaaatgggcaatcactgagacaaactgtcacttatcaaaactctataagcaatgcggaggttaacctgggggtctgaatctgtcagtgccaagtttcttccagctgtcacaatcagacaagctgcctccatcataaaataatgcaagccaaattcaactgagtgggactcaaagaaacatctgaaattcaacaacagcagccttgccatctagactattttgtgacaaagttgatgacaaggggttggaaatgacagaatacatcagtatggaagtctctctttaatgacccgatgtcatgaatgaagcatgaaggacaagtgactaaacacatatcattcttatttaataccatattgaggactaaggctcacattatcctctacaggtactgcttggatcctgtattagtttcttttgctgctgtaacaaattaccacaaatttagtggcttaaaacaatacaaatgcattctctttcagctctggaggccagaaataaaaagtcagtttcactgggctaaagtcaaggtgccacaagggctgcctcctctagaggatctgggaataatctgtttcttgactcttccagctactagtggctatgctatgggtattcctcattggctctggctcatggccccttcctcccatcttcaaagccaacagtttagtatcttctatcattgcatttccttattctttctgtagtctattccccctctacctccctcttataaggacagttgtgattacatttagggtccacccagataacccagaattatttccatatctcaaaatcctaattcacatcacatctgcaaaggctcttttgctataaaaggtaacattcacagtttccaggaattccaacctggatatttttgggagctattattcagcataccacaggtcctgtctcataaatgttttaattggaagctgttcgtctgtggtaaagagtttattactcatatacaaagccatctaaaatacaataaatgtaaattaattagagattgaaaatcaatagtattttgactcctaaacactttattaattgttctgggaaatttttgagccatttctcttggtaaacataatgtaaaaaaactaaagagcagattttagtgggtcaatattatcttggcaatctcatgaatactgctgtgtgtgtgtgcacgcacacatgcacacataagcacacgcaagcttgtgagggtcaggagattggataaaggtatactaaaagtgaacacttaaagaattctaatgatacctgcatgctgtactcatggaatgattcacactataacaactatgggtgctggaatgtacttcagtaagcatcaggcaattttaattcaaaagactctgagcagattttgaagcagttgctctgacacctgagggtgtaaccatgtttgaaggtgtgtgggatgttgagaggagaaggaactaacttttattaaatggctactatgtttcaggtacagagttacaggttttacaaattttaatgttaattaaggctcacgacaacagatgctgcaggtattaaaagaagataataatacccagagaggattaggtaacttttccaagtttgccagctagcaagtggtatagctagacccacattttttgaaatctaaatatccataatggggttttagcatgttagagcagatataggagaggtcaagagtcaagaaaacacaatggttctttcagaagagctctggggaaaaaaggaatgagacaaggggaacaacattatcacacactgcaccagctgactatagtggtaggtcataatgactgcaaaacagtgtgctgggccccatttagtgatgacatcacaatacataactctaagcaaataatgtttctacttctgattcctatttcactgctttgaccctccatcacttacctgggcacagagtattcatggtatcacttctccccataaaatgggtttgacaaccaagcccaatttcttacttcatcctcagatgtagccttatacctttaaatgaacagagattaattgcatagattttccataatggggctcattcattttccgtattatagtatctactttctaaagctgattttactgagatctaattttccagctcatgccactatagaaatgactgttaaaaacttgatccaacaggaatctgagtcattgctacaatgggaaaacatctgtaccataaagaagacaagattgtcatttcattagaattcctcttgactttaaaccattaatctttgtcaataatgggatattcatttgcagctcactaactggaataaaactgaaagtgataccatcaagatatacataattctttgataaaaccacagctttagggtccatgcctccaaggataattaaagaaatagctgttggtgttctgagtctgcttgagtaacctatagtttatgggataaaagagatagattaagacagggcgaatccaggccaagacttcactgagatctcaagtctatgtattgtgaacatatgttttgtgggggaaatgaattaggtaagacatgtcatgaaacgaaggactgagagtcaatgtggttttttctttataataccttcagtagcaaaaattcctttccttatttataggcatcctttcatactttgcctttatcatagagaagaatatatctctggtcctttttagtcaatatctatgaacagctgaaaatacaatgaaagtaagaattgcttcccaaagttcctgtttgcatttccgtttatttacatatgttcctttagacctatatagacccaaaacaacctgagataaatgccactcataactgtatccctcaggggagcatataattaacaaaagcccatatatttgagcttaactgattaatcattttccctcaactctttccattataattcagtttgctttgtgttaattcctttttttaaataatctctcaactcctcctatcacccaggctgaaaaacccaggaatcaccaaagaccctctccctcaactcctgcagccaaagcccagtccaacagaatctatccaacttccttatttcacttttccagctctgattggatttgtatctataataaatcaaaaagaggtcaactaagaacaaaactaacatcattagaataaaatcaccttataaactggaatgcaaggtgctaatgttattacttttcattctgataaaatcaccttataaactggaatgcaccatgctaatgttattacttttatcttttttttagtttgtactgcacatcacagttttaatttttttaacttttaagttcatggttcatatgcaagtttgttatataggtaaatttgtgtgatgtgggtttattgtacagattattttgtcacccaggtactaagtctagtactcattagttatttttcctgatcctctccacccttccagcctccaccctctgataggtcccagtgtatgttgtttccctctatgacttaaacaaaatgacaaaaaagagcaaacaaccacatttaaaagtgggcaaagaacgtgaacactttcctaaagaagatatacctgtggccaacaagcatatgaaaaaaagctcaatatcaatgatcattagagaaatgcaaatcaaaaccacaatgagataccatctcgcaccaatcagaatggctattattaaaaagtcaaaaaaatagatgctgtcaaggttgcagagaaaagggaacatttatacacagttggtgggaatgtaaaattagttcaaccattgtggaagacagtgtggaaattcctcaaagatctaaagacagaaatacaattcaacccagtaatcccattactgcatatatactgagaggaatataaatcattctgtcataaagacatgcacacatgtgttcattacagcactattcacaaaagcaaagacatggaatcaaactaaatgcccatcaatgatagactggataaagaaaatatgctacctatacaccatggaatactatccagtcataaaaaataatgagatcatgtcctttgcagggacatggctggagctggaggccattatccttagcaaactaatgcaagaacagaaaaccaaacattgcctgttcgcacttacaagtgggagctgaatgatgagaatgcatggacacacagaggggaacaacatattatttttatctttacttgaaaagtatgtcttgatttcctccatataaaattcaagaccttggggatgcagacaaaataggttgtttcatgtggggtttatgataggctgaataatagccctttcaggatggctacatcctaataaccagaacctgtgaatattttaccataaacacacatcacaaatggacctatgaagctacaattaaggttcctgagagtgagagattattatggattatctggatagacccaatgtaatcacaagagtccttaaagaaggaaaaaagggtcagagtcagacaaggtaatgagaagagggcaagggccccaatagtctcaaccccttataacatacattcaaatacaaaataccatctaaatctcatcagcttaaaagtcccaaaccttatcatctaaaggatctatgggtgaggctctggatataatctatcctggagaaaaatacctctccatctgtggatctgtgaagctagaaaataagttatcagatcaaaaagtacaatggtggcacaggcataagataatcaatatagacattctcattgggagaaaatagaaggggaaaaaggggtcactattcccatgacattttgcaatccaactgggaaaattctatcatgtttcaaaacccaggaataatcctctgtggctggagggtccatcctctgggcccgtggctctgccatgacctcagagttatccttcttttcatgaagggtaatgtgtctaaacctgagttattttattagcctgttttctaactggagaattttggaagtcaaacaaacttctatcattttgttctttctctgtctctttcagtccaagctggcagtgtttctgctgatacaacattctcaaaaactttgtgggtctcccacacatgttacagggagtaaatccatcaaacaagaggctcttccacaaatatatgcaggataatcccatttttattcctggctcctattgagatctgtgaggggatccatgagtcatatacttaatcttttcaaacacttttctgtgtgattaaaatactgaccttatctaaaatcgttccaaggcacaagcaaaagactgctcagccaaacctttggcattctctccagagcatactttcttgtaatcaaatcttctaactttagcagtttttgaaagctgaatagactgagaatttcctaaattatcaagtcctagttcctttttgtttaacagttcttcccttaatctatgtctttcctctcacattttactataagaaacaagaaaccaagccacattttcaacagtttgcttggatttccaagcaaatttcctcggctaaatctccacgctcatggcttagaaattctatttcccacatgactgcagaacaaaattctgctgagtcttctgccaccaaataacaaagaacccttaattccatctgggccattatgaggagttcctttagtattcctatttctatagtttatttataatagctttaatattctctaagacaatttaatttttctctattatgttcctcacttccttctgagcccttactagcagagtccttagtatctatatttccactagcaatctgttcacagaaatctaggcttttctatcatgctcctcaacattcttccagcctcttcccactggaaatcacaaccacatttttaggtatttgttagcgcataacctcacttccaaatctatgttagcttcctacttctgctccaataaattctcactaacttagtggcttgaaacaatgcacatttatcttctttttctggaggttagaaatctaaaatagattttgaaatgtactgacatttatgagtcttacatgactaaaattaaagtgtcataatcttcattccttatggatactttagggaaggatccattccttgcctttcccagcttcaaaaggccgcccgcattccatggctcatggctacatcacttggatctccgcttctgtcatcacatctctttctctccctctgcttctgtcatggcattgctttttatgacactacccctcatgccttcttctcataagaacccttgtgatttgtctggacccacagaagtaatccaggataatctcaagaacattaacttaatcacctgtgaagccctttttgctatgtagtcatacctcattttattgtgctttgctttattgctctttgcacatattgcctttttacagattgaagttttgtcacaaccctgcatggagcaagcctatcagcaccatttttccaacagcatgtgctcacctcatggcttggtgtcacattttgataattctcacaatatttcaagttttttattattattatattttttgtggtgatttgtgatcagtgacctttgatgttactactgtaatcacttgaggcaccatgatccactatcacatagaatggtgaatttaatcaataaatgttgtatgtgttctgactgctccaccaaccagcctttgccctgtcttgttctttctccttgggcctcctagttcctgagacacaataatattgaaattagactgataaataaccctataatggcttctactgttccagtgaaaagaagagtcatacatctcattttaaatcaaaaactacaggcccagtgcagtggttctacctgtaatcccagcactttgggaagccaaggcagacagatcacttgagctcaggagttcgagaccagcctggccaacatagtgaaatcccatctctattaaaaatacaaaaaaaaaaaaaaattagctgggcatggtggcaggttcctgtaatcccagctactcgggaggctaaggcaggagaatagcttgaacctgggaggcgggggttgcaataagcagagattgcaccactgaacttcagactaggcaacagagcaagagtccatctaaaaataaaaaataataaataaataaataaaaagctacaaatgattaagcttggtgtcaggcctcgagcccaagctaagccatcatatcccctgtaacctgcacgtacacatccagatggccagttcctgccttaactgatgacattccaccataaaagaagtgaaaatggcctgttcctgccttaactgatgacattgtcttgtgaaattccttctcctggctcatcctgactcaaaagctcccctactgagcaccttgtgacccccaactcctgcccaccagagaacaattcccctttgactgtaattttcctttacctacccaaatcttataaaacggccccacccctatctcccttcgctgactcttttcggactcagcccgcctgcacccaggtgattaaaagctttattgctcacacaaagccagtttggtggtctcttcacacggatgcgcatgaaatttggtgccgtgactcggatcaggggacccttggagatcccttgggagatcaatcccctgtcctcctgctctttgctccgtgaaaaagatccacctatgacctcgggtcctcagacccatcagcccaaggaacatctcaccaattttaaatcgggtaagcagcctcttcttactctcttctccaacctctctcactatccctcaaccactttctcttttcaatcttggcaccacccttcaatctctcccttctcttaatttcaattgctttcattttctggtagaaacaaagaagacacattttatccgtggacccaaaactcaggcatcagtcacagacttgggaagccagccttcccttcatgtttaatcattgcagggacgcctctccatttacccacgtttcagaggtgtctgaccacgcagggatgcctgcctcggtccttcacccttagcagcaagtcccgcttttctgggggaggggcaaaaaccacaaccccttctctccctgtctctaccccttctctgcttttctggggtgcaagaaccccccgatcccttatttccgtgccccgacctcttatctctgtgccccgatcccttatttccatgccctgacctcttatctctgcaccccaattccttatttccatgccctgacctcttatctctgcgccccgatcccttatttccacaccccgacctcttatctctgcaccccaaccccttattttggcgccccgacacctttcccacttttctggagggtaagaacctccgaacctcttccctccatgtccctactctctcttttctctgggcttgcctccttcactatgggcaaccttccaccctccattactccttcttctcccttagcctgtgttctcaagaacttaaaacctcttcaactcacacctgacctaaaacctaaatgccttattttcttctgcaatgccgcttgaccccaatacaaactcaacagtgattccaaatagccagaaaatggcactttcaatttttccatcctacgagatctaaataattcttgtcgtaaaatgggcaaacggtctgaggtgcctgacatccaggcattctttcacacatcagtcccttcctagtctctgttcccaatgcaaatcgtcccaaatcttccttctttccctcccgcctgtcccctcagtcccaaccccaagcgtcgctgagtctttctaatcttccttttctacagacccatctgacctctcccctcctcgccaggccgagctaggtcccaattcttcctcagcctctgcttctccaccctataatccttttatcacctcccttcctcacacctggtccagcttacagtttcattccgtgactagccctcacccacctgcccagcaatttactcttaaaaaggtggctggagctaaaggcatagtcaaagttaatgctcctttttctttatcccaaatcagatagcatttaggctctttttcatcaaatataaaaactcagcccagttcatggctcgtttggcagcaaccctgagatgctttacagccctggaccctaaaaggtcaaaaggctgtcttattctcaatatacatcttattacccaatctgctcccaacattaaataaaactccaaaaattaaattccggccctcaaaccccacaacaggacttaattaacctctccttcaaggtgtacaataatagggtagaggcagccaagtagcaacatatttctgagttacaattccttgcctccactgtgagacaaaccccagccacatctccagcatacaagaacttccaaacgcctaaaccgcagtggccaggtgttcctccaggcccgcctcccccaggagcttgctacaagtgccagaaatctggccaccaggccaaggaatgcccacagcccgggattcctcctaagccgcgtcccatctgtgtgggaccccactgaaaattggactgttcaactcacctggcagccactcccagagcccctggaactctggcccaaggctctctgactgactccttcccagatcttctcggcttagtggctgaagactgacactgcccgatcgccttggaagccccctagaccatcacggacgccgagctttaagtaactctcacagtggaaggtaagtccgtccccttcttaatcaatacggaggctacccactccacattaccttcttttcaaggcctgtttcccttgcctccaaactgttgtgggtagtgacggccaggcttctaaacctcttaaaactccccaactctggtgccaacttagacaatactcttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccatgttagccaggatggtctcgatctgacctcgtgatccgcccgcctctgcttcccaaagtgctgggattacaggcgtgagccaccgcgcccagccgacaatactcttttaagcactcctttttagttatccccacctgcccagttcccttattaggccgagacatttaactaaattatctgcttccctgactattcctggactacagctgtatctcattgccacccttcttcccaatccaaagcctcctttgcgtcctcctcttgtatccccccaccttaacccacaagtataagatacctctactccctccttggcgactgatcatgcacccctcaccatctcactaaaacctaatcactcttaccccgctcaatgccgatatcccatcccacagcatgctttaaaaggattaaagcctgttatcactggcctgttacagcatgggcttttaaagcctataaactctccttacaattcccctattttacctgtcctagaaccagacaagccttacaagttagttcaggatctgcgccttatcaaccaaattgttttgcctatccaccccatggtgccaaacccatatactctcctatcttcaatacctccctcaacaacccattattctgttctggatctcaaacatgctttctttactatgcctttgcacccttcatcccagcctttcttcgctttcacttagactgaccctgacacccatcaggctcagcaaattacctgggctgtactgccacaaggcttcacagacagcccccattacttcagtcaagaccaagtttcatcctcatctgttaccaatcttggcataattcttataaaaacacacacgtgctctccctgctgattgtgtccgactaatctcccaaacctcaatcccttacaaaacaacaactcctttccttcctaggcatggttagtgcagtcagaattcttacagaagagccaggactgcaccctgtagcctttctgtccaaacaacttgaccttactgttttagcctagccctcatgtctgcgtgcagcggctgccgctgctttaatacttttagaggcccttaaaatcacaaactatgctcaactcactctctacagttctcataacttctaaaatctattttcttcctcacacctgacacatatactttctgtttcccggctccttcagctgtactcactctttgttgagtctcccacaattaccattgttcctggcccagacttcaatccagcctcccacattattcctgataccacacctgacccccatgactgtatctctctgatccacctgacattcactccattttcccatattctttcatgttcctcaccctgaacacacttggtttattgacggcagttccaccaggcctaatcgccactcaccagcaaaggcaggctatgctatagtatcttccacatctattattgaggctactgctctgcccccctccactacctctcagcaagccgaactcattgccttaagccctcactcttgcaaaagcactaaaagtcaatatttatactgactctaaatatgccttccatattctgcaccaccatgcgagaggtttcctcactacacaagggtcctctatcattaatgcctctttaataaaaacgcttctcaaagctgctttacttccaaaggaagctagagtcattcactgcaaaggccatcaaagggcatcagatcccatcgctcaggacaatgctcatactgataagatagctaaaaaagcagctagcattccaacttatacccctcactttcagtttttctccttctcatctggccactcccacctactcccccgctgaaacttccacttatcaatctcttcccacacaaggcaaatggttcttagaccaaggaacatatctccttccagcctcacaggcccattctattctgtcgtcatttcataacctcttccatgtaggttacaagccactagcccatctcttagaacctctcatttcctttccatcatagaaatctatcctcaaggaaagcacttctcagtgttctatctgctattctactacccttcagggattgttcaggcctcctccctttcccatacatcaagctcggggatttgcccctgcccaggactggcaaattgactttactcacatgccccgagtcagaaaactaaaatatctcttagtctgtgtagacactttcactggatgggtagaggcctttcctacggggtctaagaaggccaccgcagtcatttctttccttctgtcagacataattcctcagtttagccttcccacctctatacagtccaatagcagaccagcctttattagtcaaatcagccaagcagtttttcaggctcttggtattcagttaaacctttatttcccttacagtcctcagtcttcaggaaaggtagaacggactaatggtcttttaaaaacacacctcaccaatctcagccaccaacttaaaaaggactggacaatacttttacctctttcttttctcagaattcaggcctatcctcggaatgctgcaaggtacagcccattggagctcctgtatggacgctcctttttattaggccccagtctcattccagacaccagaccaacttggactgtgccccaaaaaacttgtcacccctactatcttctgtctagtcatactcctattcaccgttctcaactactcatacatgccctgctcttgtttacactgccggtttacactgtttctccaagtcatcacagccaatatctcctggtgctatcccaaactgccactcttaactcttaaagtaaataaataatctttgctggcagggctatgctgaacctccttaggcactctctaattagatgtcctgggtcctcccaattcttagacctttaatacctgcttttctctttctcttattccgttcagtttttcaattcatacaaaactatatccaggccatcaccaataattctaaatgacaaatgtttcttctaacaaccccacaatatcaccccttaccacaaaatcttccttcagcttaatatctcccactctaggttcccacgccgcccctaatcccactcgaagcagccctgagaaacatcgcccgttatctctccataccaccccccaaaattttcgtcgtcccaacactttatcactatttcattttatttttcttaatataagaagacaggaacgtcaggcctctgagcccaagctaagccatcatatcccctgtgacctgcacatacacatccagatggccggttcctgccttaactgatgacattctaccacaaaagaagtgaaaatggcctgttcctgccttaactgatgacattgtcttgtgaaattccttctcctggctcatcctgcctcaaaagctcccctactgagcaccttgtgacctcccactcctgcctgccagagaacaacccccctttgactgtaattttcctttacctatccaaatcttataaaacggccccacccctatctcccttcgctgactctcttttcggactcagcctgcctgcacccaggtgattaaaagctttattgctcacacaaagcctgtttggtggtctcttcacactgatgcgcatgaaacttggtgaagtatgtatgtcaaaagctgagataggctaaaacctaggcctcatgtgccaaacagttagtaaatgcattatgtaagaaatacatttcaagttgtgaatgcaaaggaaaagttcttgaaggaaattaaaagtgcgactccagtggacacataaatgataagaaagggaaacagcctgaatgctgatatggcaaaagttttagtgctctggaaagatcaaaccagccacaacatttacttaagccaaatgctaatccagaacaaggccctaactctcttcaattctatgaaggctgagagaggcaaagaaactgcagaagaaaattttgaagctagcaggggttcatgaggtttaaggaaagaagccatttccatgacacaaaagtgcaagaagcagcaagtgctgatggagaagctgtagcaagttatccagaagatccagctaaattgataaaggtgactacactaaacaacagattctcaatgtagatgaaacagccttctattggaagaagattccatttaggactctcataaccagagaggagaagtcaacgtctggcttcaaagcttcaaagaacaggctcactgttttgttaggttgtaatgcagctggtaactttaagttgaagccaatgctcatttgccattctgaaaacactaaagcttttaagaacgatgttaaatgtactctgcctgtgctctataataaaataataaagcctggatgacagtacatttgtttacagcacagtttactgaccattttaagcccactgttgagacctactgcttaaaaaaagattcctttcaaattattattgctcatcgacaatgcacctaattacccaagagctctgactggaggtgtacaaggagactaatgttttcatggttggtaacacaacatccattctgcagccaatggatcaagcagtaattttgactttcaagtcttatgtaagaaatacagggtgggaccaagatggccaactagccaacaagaagcagccaccgtcagaggctcccatcaaaaagaaccataatagcatgtgaatcctgcactggcaactgaggtatccaggttctctcatcagaactgactaggcagctggtgtgacctacagagagaaaggaagcgcagtggtgcagggggcccacctgagagccacacagggcaggtgggtccccacccccccgccaagggaggtgatgagtgagtgtgccatccagcctgggaaaccatgctttttccacagactgtgcaacctcctgatcagaagatctcactcatgaaatcacaacaccagggcctaggatcccaaccacagagccctgcagattctcaaaagcctctcagctagactctgcttaagcctgctgagttcccggtggggaggggcgactagcaccacagttgcggctgcctgttgtttaagccatttgagctctttgggggaggggcagcagccagcactgggactgatagctgcctaacacactaagctccctgggcaggggaagggtggcagccatctctatagctccaggctacacttttcccctgctggagccaggaaggcttggttccgagaggggtcccccgcagcacaacacaccggctgtggcagactgtggccagagtgcctcttcaggcctgacactgacccatccctcctcactgggaggggcctccctgcaggaactccaactccaggcaggggctcaggcacaaagctctgatctccctggccggagccactaggggtaggggtgaccacagtctctgaggaccagcagacttagcctttcctcctgctagttctgagaaatctgggcagcccagatgagtgggtttcccctcagcaaagcactccccctccaccaagggatagtcaaagagcttcattaaacgggtcctgctccctgtaccacccaactaggtgagaccatcaaacaggggttgtcagacatcctatacaggagtgatcatactggcatcagatcggtgctcctcgaggtcagagttcccagaggaaggaggaagcacccatctttgctgttttccagcctccttgagtgactggctccaggcacaggagcgagccagatgaatagtgcctgaagtgaatgcccagcaaaccacaacagccctacagaagaggggcctgaccattgaaagaaaaacaaacagaaagcaacaacaacagcatcagcaaaaagtgtctccccaaaaaaacccatcaaggataggcagcctcaaatatcaaaactagacaaattcatgaagatgagaaaggatcaacaaaaaaaaaaacactgaaagcccaaaaggccagagtgcctcttctcctccaaatgattgcaatgccgctccagcaagggtgcagaactgggcagaggatgagatggacaaattgacagaagtaggcttcagaaggtgggtaatatcaaattctgctagctaaaggatcatgttctaacccaatgcaaagaagctaagaaccttgaaaaaaggttacaggagctgctaactagaataaccagtttagagaggaacataaataacctgatggagctgaaaaacacagcggaagaacttcgtgaagcatacagaagtatcaatagccgaatcaaccaagaggaagaaagtatatctgagtttgaagaccaccttgctgaaataaggcatgcagacaagattagaggaaaaagaatgaaaaggaatgaacaaaacctccaagaaatataggattatgtaaaaagaccgaacctacaattgactggagtacctgaaacagacagagaaaattgaaccaagctgcaaaacacacttcaggatgttatctaggagaatgttgccaacctagcaagataggccaacattaaaattcaggaaatacagtgaacaccactaagatactccatgagacaatcaaccccaagacacataatcattagattctccaaggtcgaaaggaaggaaaaaaatgttaagggcagccagagagaaagaccaggtcacccacaaagggaagcccatcagactaacagcagacctctcagcagaaacggtacaagccagaagagagtgagggccaatattcaacagtcttagaaaaattattttcaactcagaatttcatatccagccaaactaagcttcataagcaaagaagaaataaaatcctttccagacaagcaaatactgagggatttcatcaccaccatgcctgccttacaagagcccctgagggaagcactaaatatgaaaaggaacaactggtaccagccattgcaaagacacatcaaaatataaagaccaatgacactatgaagaaactgcatcaactagtgtgcaaaataccaaggtagtatcatgatgacaggatcaaaatcacatataacaatattaaccttaaatgtaaatgggctaaatgccccagttaaaagacacagactggcaaattggataaagagtcaagacccatcagtgtgctgtatttaggagacccaactcatggtcaaagacatacataggctcaaaatgaagagatggaggcaagtttaccaagcaaatgaaaagcaaaaagaaagcaggggttgcaatcctagtctctgacaaaacagactttaaaccaacaaagataaaaaaagacaagggcattacataatggtaaagggatcaattcaacaagaagagctaactatcctaaatatgtatgcacccaatacaggagcacccaaattcataaaacaagttcttagagacctacaaagagacttagactcccacacaataataaaaagggacttctaacaccctactgtcaatattggacacatcaatgagacagaaaattaacaaggatattcaggacttaaactcagctctggatcaagtggacctaaaagagatctacagaaccctccacaccaaatcaacagaatatacattcttctcagtgcatggcatttattctcaaattgaccacaaaattggaagtaaaacacttctcagtaaatgcaaaataactgaaatcataacagcctctcagaccacagtgcaatcaaattagaactcaggattaagaaactcactcaaaaccacacaattacatggaaattgaacaacctgctcctgaaggactcctgggtaaataatgaaattaaggcagaaatcaagttatttgaaaccaataagaacaaagagacaatgtgccagaatctctgggacacagctaaagcagtgttaagagggtagcactaaatccccatatcagaaagctagaaagatctcaaatcgacaccctaacctcacaattaaaagagctagagaagcaagagcaaactaatccaaaagctagcagaagacaagaaataactaagatcagagcagaactgaaggggatagagacacaaaaaaccctcaaaaaaatcaataaatccagcagctggttttttgaaaaaattaacaaaataggtagactgctagctagactaataaagaagaaaaaagaatcaaatagacacaataaaaaacgataaaggggatattaccacttatcccacagaaatacaaactaccatcagagaatactataaacacctctatgcaaataaactagaaaatctagaagaaatggataaattcctggacacatacatcatcccaaaactaaaccaggaagaagtcgaatccataaatagaccaataacaagttctgaaattgaggcagtaattaatagtctaccaaccaagaaaagcccaggaccagaaggaatcacagccaaattctaccagccaaattctacaaagaggagctggtgccattccttctgaatatgatccaaacagtgaaaagcaggtactcttccctaactaattttatgaggccatcatcatcctgataccaaaactgggcagagacacaacaaaaaaaagaaaatttcaggccaatatccctgatgaatattgatgcaaaaatcctcaataaaatactggcaaaccgaatccagcagcacattggaaaacttatccaccacaatcaagttgacttcatccctgggatgcaaggctagttcaacatacacaaatcaatacatgtactccatcacacagacagaaccaatgacaataaccacacgattatctcaatagatgcagaaaaggcctttgataaaattcaacatgtcttcatattaaaaactctcaataaactagatattgatggaacatatctcaaaataatcagagctatttatgacaaacccacagccaatatcatattgaatgggcaaaagctggaagcattccctttgaaaactggtgcaagacaaggatgccctcactcaccactccctttcaacataatattggaaattctggccagggcaatcaggcaagagaaagaagtaaagcatattcgaatagaaagagaggaagtcatattgtccctttttgcagatgacatgattctacatttagaaaacccagcatctcagccccaaaactccttaaactgataagcaactttggcaaagtctcaagatacaaaatcaatgtgcaaaaatcacaagcattcctatacaccaacaatagacaagcagaggaccaaatcacaaatgaactcccattcacaattgctataaagagaataaaatacctaggaatacagctaacaagggatgtgaaggacctcttcaaggagaactacaaaccactgctcaaggaaatcagagaggacacaaacaaatggaaaaacattccatcctcatggataggaaaaatcaatgttgtgaaaatggccattctgcccaaagtaatttatagattcaatgctattcccatcaagctaccattgacaatcttcacagaattagaaaaaactattttaaatttcatatggaaccaaacaagagcccatatagccaggacaatcctaatcaaaaagaacaaagcaggaggcatcacactacctgacttcaaactatactacaaggctacagtaaccaaaacagcatggtactggtaccaaaacagacatatagaccagtggaacagaacggagaactcagaaataacaccacacatctacaaccatctgatctttgacaaacctgacaaaaacaaacaataggaaaagaatttcctattcaataaaaggtgctgggaaaactggctagccatatgcagaaaactgaaactggaccccttccttataccttttacagaaattaactcattaaagacttaaatgtaaaacccaaaaccataaaaaccctagacgaaaacttaggcaataccattcaggacataggcatgggcaaagacttcatgatgaaaacaccaaaagcaattccaacaaaagccaaaattgacaaatgagatctaattaaagagcttctgcacagcaaaagaaactatcatcagagtgaacaggcaacctacagaatgggagaaagtttttgccatctacccatttgacaaaggtctaatatccagaatctacaaggaacttaaacaaatttacaagaaaaaaaaatccccatcaaaaagcgggcaaaggatatgaacagacacttctcaaaagaaaacatttatgtggccaatgaacacatgaaaaaaagctcaacatcactgatcattagagaaatgcaaatcgaaactacagtgagatactgtctcatgccagtcagaatggtaattattaaaaagtcaagaaacaatagatgcttgggaggctgtggagaaataggaacacttttacactgttggtgggaatgtaaattagtccaaccattgtggacgacagtatggcaattcgtcaaggatctagaaccagaaataccatttgacccagcaaccccattactgggtatatatccaaagaattgttccattataaagacacatgcacacatattatcactgcagcactatttacaacagcaaagacatggaaccaacccaaatgcccatcaatgatagactggataaagaaaatgcggtaaatatacacgatggaatactatgcaaccataaaaagaaatgagaccttgtcctttgcagggacttggatgaagctggaagccatcctaactaactaactaacaggaacagaaaactaacacaggaagagaaaaccaaacaccgcatgttttcactcataagtgggagctaaacaatgagaacacatttagcggacaacagcatagtgtaaatacaacttttatatgcacttggcaatcaaaaaattcatgtgagttgctctactgcagtattcgctttattgcagtggtctataactgaatctgtagtacctccaagatatgcctgtgtaaagcaacatattcacagttctgtgtattacaatatgaacatctctgacatgaaaatatgcataaatttctcacattttataagaagtttttattcatctttctatttgaaagacgctttttccgagtataaaattctagatcaacagctaatttttggcaccttaaagacagtccattgtctttctgggtcacaaagctagtggtaagaagtccaccatcaccctcatctttgttcctctgtaagtaatgaagttttggagtaatgaagtagtttgtaagtaatgaagtcttgaagtttgccattttttttcttctggcaatttaaattttatagttgaggttcttagagtgaacttttcatttcagtaattgtacttttgaactccagaatttctatttgatttttttaatcatttctctctattgatattctctatttgatgcaaaattgttgtcctaccttcctttatttaatcatagtttcctttagttctttgaacatatctacaatggctactttctagtcattttctgttagtctgatttctgaccactgtctgcctactgtacttacaaagtatgggtcatattttcttgtttcttttcacgccttgtaaatttctgttggtaactggacattttaggtaatacatcatggcaactctgggtaaacccacccctgctctaagcttgttattatttgttttttgtttaatgactagctggactattttagtgatgttcactgtcatcctcatctttgattctctgtaagtaatgagtatttttccctttttgcatataagtttgtcactgtatcactagatttcagtaaactgaatatgacacaaatatgactattttccacctgcagtgttaaatctttggtgctgctcctcaaggagttgtagctttgtgcatgtatgctcacatatggtcactagtatgacagtggttttggcaggactctttttgtcactttctctgaccacgtccaactgttaagctatactaagtgccagctgatttatgtactgctttcaacaatactgtggtgcttaaattgttctatagactaatccatcaaattcgggttcctttgaaggagtagttcctacattgtttgagatttgctctgttgaggagctctgaccacagatgggctcccacaagctgtctctttccaagggtctctgcttttccctccaggcaaaatctcaagtcaagtcaagttgagtcaaggctctggaactagggtggcagacaattgcacactctctctaaatgacaccctcactttaagagctgagtgctcattgggggccagagagggtagaagatgaacagtagcctccaacttttttggctagtttcatccagagtacaacactcactttacagactaaggcaaggacaatcagaacccctatatctcagcagtgccaaacccaaggtaaagactgcatctcatgagtggggagctgtgcagaagagaactctacttcagaacttagcctcatcaataggtagctgtggcaagatgagaaaagctgatatccttccataggattactctctgtctgggagctgagaatagagagagccttgtgttttgggctgcactagtttggaataaagtttccatctcactaagctgggaaaggggataggagggaaagggtctcagttccccatagagtcttgctgttcttaccacaatacagattttctggaataaacgtttcttcatctacttattatttaaatgtccgtaagactatttccagagacattaaatggtatgttgttgggtatttttgtttttgtttttgttttgtttcttttgtttgtttgcttgtttttgagatagagtttccctctttttgcctaggctggagtgcaatgttgttatctccgctcactgcaacctccacctcccaggctcaagtgattctcctgcctcagcctccctcccaaatagctgggattacaggaatgcaccaccacacctggctaattttgttttatgtttatttgtttgtttttgagaaaatgtctcactctgtcacccagactggagtgcagtggcacgatctcggctcaccgcaacctccgcctcccaggctcaagcgattctcctgcctcagccttccaagtagctgggattagaagcgcacgccaccacacccagataatttttgtatttttagtagagacggggtttcaccacgttggccaggcttgtctcaaactcctgacctcaaatgatccactcgcctctgcctcccaaagcgctgggattataggcgtgaaccaccgtgccgtgtgtgtgtgtgtgtgtgtgtgtgtgtgtgtgtgtgtgtgtgtgttttaattatcttcaccagtttttctggagaaagagtctgctgagcttctcatgctattatgccagaagtccctcccagtcaattaacaaaagtggcaaggtaattcaatgagaatactagagtctttttcaaaaaatggttctagacaatgaatatgggaaaaatgaaactcaacctttccttataccatatgcaaaataatttggaatgaattacagcctaaaatatgagtcaaactattaaacttctagaagaaaacacaggaagaattatttgtaattttgggataggcaaagatatcttagctaagacacaaaaaacatgaatcatacacacataaaaactgtaaaactgggcttcatcaaaaatttttaaagtttgtcctttaaaagatactgtttgaaaaattaaaaggcaagccaaagactacgagaataactttaaaaccagaaatctgatgaagaacttgtttttgagatatataaagaattcgttcaactgaataataatatagacaatccaatttaaaaatgggcaaaagtttgaacagatacttcatcaaagaagatatgaaaaatggcaggtaaataaatgatgttctataatattggtagtctttaaggaaatgcaaattaaaaacataggattgcactatttacctattaaaatggctaaaacttaaaagactgatgatatatatagcaagggtacagagcaactgtaatacttatacattactgattggaacttaatacggtacagccactttggaaagcagtttggcaatttctccaaaagttaaacacagacataacatacagtgcagtaatcccactcttacatgtttacccaagagaaataaaaacacaaagacttacatgcaaagattcataactttattaattacagccaaaatctggaaacaacccaaaagtctatcaacaggcaaatggaaaaacatgttgtagtatagccttacaataaaatactactcagcaacaaaaggaatgaaaatatcagtgaaagaagccaggcacaaaagactgtatgattctatttgtatgaaattctagaaaaaaaaattatagtgatagaaaacaaatgtgtggttgcctcagggtgggactgttgtgtggaaattggccaaaggggcatgagagatctttggaagaatgatgaaaatattttatatctttattatggttttagttacattactatacatttttcaaactcacccaaatgaatcctgaatgaattttattgtatgtaaattatatctctaatttttttaaaaaggtcaatagaagcaatgtattaaatagtttaatagtagagaaagatcagaaagatcaagacagagacactgtcttcatgtatattaacgtactggatatcagagattctgaaattatgttagatatcaagtgaaaatattcttttgtcaatcattttcattcagttataagaccaacatttatcttaagccagatttgtgaaaattcaatgtaaaaataattatcatactatttcacaagagtgttattgttccttgctcattaaaaaaaaaaagagcaagagcttgttgagatgtcatagctaacaaagctataataaactgggatttttttcagcaaatgtttgcttccctttcctctttgggtcagggtatactttccactcccactgcctttatgcttggccatgcgacttgccttggccaatggaatatgagcatgcaggatatctgcagaattttaaatgtgtttgcctggcttagcttgcacttgaactcctataatcaacatacaattacaacataggcaaccagtgcctcgttaggctggatcaaagcgtgaagcttaaggggcaaacctgaacttacctcaaagcctgaaactgaactacagcataaagcagagccacttatgagtgagaaaattaaaagcttgccatgatacgacaataaatttggtggaggtttgttacagcattattatggcaagagttgactcatgcaaagctaacatttgaggagaaattacaatgttctaggcactgagctacaaactttacatatattacccatttaattatcacaatgactctgtaagagaaaacattttacattgtctttctaaaatacatgatgaaactgaagcacaaataggataattgcattatccaaagtctcagagctagtaagtaaccaagtagggtttaaacccaggatgttataattctaatactcacccaatgcactaattatcaagatcaaattgaatttttaaattctattcttctagttggggtgttaaataatggttaacactcttcaatctccataaacccttttcttctcttccacctaacctgcccatcttcatacctgtatctaaacaaccatctgtttactgtaccccaactattgggttgtcagtagctagaaaagtacgctgccttgactccattacaaggttagctgatggactttccatatagctttgcaaaattgtgcttattcatgttgattccattttgcattccccacaatagctgttccaaaccttaatcaccaagataagccctaatttcaatatcactcctcactctcagaggctctgcctccaatttctcagcgaatgaatattccatgaggcattacatttctcaacttttttcctctctgccttatacctatctttacctctctttactccttgctcttgtgtctcaaatgactaattctacccccatattcttgtctttcttccttcccataccttgttctacagatttaacatcttcctttttttctctctactagaaaacctacatactcatttctcccacatctttttttgctcttgttgcccaggctggagtgcaatggcatgatctcagctcactgcaatctccacctcccgggttcaagcaactctcctgcctcagcacccccgagtagctgggattacaggcatgcgccaccacgcatggctaatttttgtatttttagtagaaatggggtttcatcatgttggtcaggctggtctcaaacacctgatctcaggtgatccgcccgcctcagcctcccaaagtgctgggattacaagcatgagccaccatgcccagccctatttctcccacatcttaagccaactttcccacaaacctgatgcctccacaaaccaccaactcatctttctccctgctttcactgttaaacttcttgacaaagtaggtgctgtatcagctatctttactttttcacctccaagtcactccttaatacattacaggataagttccccttctgtgaactttaccaaaattattctctcaaaggacactgacagtttccaaattgcccaagtcagtgatctcctctcagttatcatcttaaccaagcctttctctagttttaaatgacactgttgactacatacatcaactccatccctccagacccaccctgcacctcattgttcctccttctatgttctctattatggttactggtaccattcagtcacccagcctagaagtcttaaggtcaatctagtctttttctctctcacatcatagcctcttaacatctccaatattatttttattactattttgctcttataatctctcagttggactattcaaaaagtcttctaagatggaagttgatagcaataaacacctacatcaagaaacgtagaaagatttcaaataatcagtctaatgatgcacctaaaggaattagaaaagcaagaataagccaaatcccaaagttagcagaaggaaagaagtaataaaaatcagagcagaaataaatgaaatagagaccacaaaaataaaaaagatcaacgaaatgaaaagttggcttttcaaaaagataaaattggtaaaccactagctagactaaccaagaaaaaaagagaagtccaaataaataaaatcagaaattaagaaatggaacatcacaaccaataccttagaaatacaaaatatcatcagagactattattaacagctatacataaacaaactggaaaacccagaggaagtggataaattcctggacatatacagcctaccaagaataaatcaggaagatacagaaaacctgaacagaccaataataagtaatgaaactgaatctgtaataaaaagcctcccaacaaggaaaggcttggaccagatggcttcactgccaaattctaccaaacatataaagaagaactagtactaattctcctcaaactattccaaaaaaataaagaggagggagttctccctaactcattctatgaggctagaattaccctgatactaaagccagacaaggacatataccaaaaaaaaaaaaaaaaagaatatccctgaaggacatagacacaagaatcttcaacaaaatactagcaaactgaatatcatagcacatcaaaaagataacacatacaccatgatctagttgcatttatcccaggttgcaaggatgtttcaacatatgcatatgaataaacataatatatcacatcaacagaatgaaggacaaaaatgatatgatcattgatagatacagaaaaagcatttgataaaattcaacaatgcttcatgataaaaattctcaacaagctagcatagaaggtagatatctcagcataataaaggccatatatgataaacccacagctaacatcatactgatggggaaagcatttcctctaagaactagaacaagacaaagatttccactttcaacactctatgcaacatagtactggaagtcctagccagagcaatcgggcaagagaatgaaagaaaaggcgtccaaactggaaaagaagtaaaattgtccctctttgcagacaatttgatcttatatttagaaaaatcaaaagaaaccaccacaaaaaaaaactcttcaaactgataaattcagtaaagttgcaggacgcaaaatcagcacacaaaaatcaccagtatttttatacaccaaaaatgacatagctgaaaaagaaaccaagaaggcaatcttatttacagtagctacaaaccaaataactaaaaataaatttaaccaaggaggtgaaagacatctagaaggaaaactacaaaacactgataaaagaaactgaagagggcataaacaaagagaaagacatcccatgttcacagatcagaggaattttatggcaaagaattcaaaagcacagacaacaaaaacaaaaatagacaaatggaattacattaaactaaaaagcttctgcacagcaaaggaaacaatcaacagagtggagagacaacctattgaatgaaagaaagtatttgcaaactattcatccaacaagggactaatatccagcatataaggaactcaaatgattcaacaataaaaaatctaataatcccattaaaaataggcaaaggaaatgaatagacacttctcacaagaagacatacaaatggccaccagggatatggaaaatgtcaacatcactaatcatcagggaaatgtatattaaaaccacaatgagatatcatcttaccccagttagaatgactattattaaaaagacaacagatgctggtgagaatgcagagaaagggaacttttatatgctgttgataaaaatgtaaattagtacagctgctatggaaaacagtatggagatttttcaaaaaactaaaaatagaactaccatgagattcagcaatcacactgctggttatttatcatcaaaggaaggaaaatcagtatatcaaagggatacctgcaccttcgtgtttattacagcactattcacaacagcaaagacatggaatcaacttaagtgcccatcaacggatgaatggataaagaaaatgtggtatatatacacagtgaaatacttgttgtccataaacaatgagatcctgtcatttgcagtaacatggatggaactagaaatccttatgttaagtgaaataagctagacatacaaagacaaacataatatcacattttctcactcatatgtaggaggtaggaaatgcaaacttaatcaagtaatggctttcctctccttcccacttcttttccccatgcttaaaacccttcagtgggtattccataattatccattgcctagaggataaggacaaaatgtattattgggaataaaaggtgttttttggccacctctacagcatcaactcctgatcacctccccataccatgtcttttgcatccttgaaatttttccaccttgttcccttcaacatcactttttcctatttcccccctacctgtataatacctttcagtttctttctcaagttcttagatcctcgggtctttgttttttcttctcttttagttctagcaattcaattgccctgggcaatcttgtcccttctgatcaacctcattgtgtccaattaccaactattcatcaatagtttattaattttaatctacagcctccaacttctatcctaagccatagtcccatagacattctagtattgtcaataattacagctcatttattgaaaaactgctacatgccagcaattgcattagatgtgtgctagaacacatatctattaaataaacatgttctcatttaatcattacagaatgctgtaaagcaggcacaactgttccttctttgggatgaacacagacatggaatttatataatgttcccagtatcatataggtagaaagtactgaagcaggaatttaagctcagattggcaaaagaccatttcactaagatattcactactttttaccaaactccttcaaatgcacatattcttcagtacttattttattatttccaaacccaaatcactcctccatctgttattcccacattcactcatagcattactattaccaggaacaatacagaagtcttccaagtcacatttaactcctccatctaacttctccatatttgttgggtcactaagccacattctatgtctgaaaaagctcttgaatctccctctttttattgtagtatttcagtagctgtctcacagttctccagtttctgcccctgtaattatcttccatttctttgagagtttgctttctaaataaatctgactgacttctagataagatgactgaatatgcacaattctcttctctacttcctaatattccaattaaaatgatcagtgaaaccattaaaaactagagtaaccagtactacaaagaataacattctcacatcacagaattgaagaacttttgtaagtttaggccaacagaactttattgaaggaaggattggcccaaaccaagactcactagttaagaagtaacttgtctggaaagtaaataaagaaaaccaacagaatcccacaaatatgctcacatttggagatgtgaggctggaggtgaaagcagactgtgaagcaagtaggtgattccatattatattgtggcttagagttcaggtggacatttgataccaactcactgtgtcctttaagctgtaagggcatatactaatactaagtactctgtggaatattaagtcctctagtggaaggccatcttccactagacttaggcaaaggttaggaattacttccctcactccattcagggagggtattcacatacactatcatctttctccaaaatctctcccctaatctcccatctcctaactttcacaacctccatgtctttaagggatgcaaatgctgtctgactaattctaccctaactttataaattctaaaccactgtggccttcaaccccactttgaagtatggcatctagtatcttggggcttcaaaagaaacttccattttaatatccttttacattaatactctggataatgtttctatctgtgatttgatggggagggttttttttggggggggcggggccaaaaaaaaagtactcaaagctaaaaaaaaactccatccaagatcctttgtctttaaataccatttgaagttagactagtggattcaaatcctgactccagggactaactgtataagctttgggaacaatctaagcatcttaagtttcagttttataatcatatatgaataatgacaggccttcgtagaattttgtaaaaattaaataacatgttctaaacaaaactaaaaatatttctagcggcccataatgtcccagatgaaaactgccccttccacgtctctttgaccatgtcatctccatgtcatctctatgtcatctccgcctcactcatgccaatcactgttccacctcaagcgttctgctgccacttcttttttctccccctggaatattcattcctcagatagttgatggctaactgttccacctgcttcaggtctttgctcaaacacaaccttctccatccttctctgagcattccatgtaagcctaagccccttgttttacttctgcccttccctctatcccttccctgccttgatttgctccatagcacttatcatctttatcatactacatattttcacatttttactttaccttctgtctcctcccacttaatgtgggatccactaagaacattacctggcacataagaactagtcggtagccaggaacagtggctcacacctgcaatccagcacttttggagacagaggcaagagaatcacttgagcccaagtgttcaagaccagcctgggtaacacagtgagaccccatctctacgaaaaaagaaattaattagctggccatggtggcacacacttacaattccagctacttgggaagctgagggggaggatcacttgagcccaggaagttgaaactagagtgatccatgatcacacaactgtactccagcctggttaacagagggagaccgtgtctcaaaaacaaaaacaaaaacaaaaaacaaaaaacaaaaaaactagtcaataaatacaggctactgttgtaataataaatattataatgcagcacctctgtgaaatattccaggaatcagacctgactgcagcattgttcctggcttacacacagcatgtcaggcaaaagtgtatgtcagacaagaaaaaggatctgctcatatgaaagcatagggtaaaatcacaaggatcaatgagggtaagttaaatagtatcccataacatcaagttaaattaaaaattaggagaaatggggccagcaagatggccaaataggaacagctccagtctgcagctcccagtgagatcaatgcagaaggcgggtgatttctgcatttccaacccaggtacctggcttatctcactggaaatggttagacagagggtgcagcccatggagggcaagctgaagctgggtggggcatcccctcacccgggaagtgcaaggggttgggaaattccttcccctagccaagagaagccgtgagggactatgccatgaggaacagtgcactccggcccagatactacacttttcccactgtttttacaacccacagaccaggagattccctctagtgcctatgccaccagggccctgggtttcaagcacaaaagtaggtggcaatttgggcagacacctaactaggtcaggagatcgagaccaatctggcaaaatggtgaaatgccatttctactgaaaatacaaaaattagctgggtgtggtggcgcgtacatgtaatcccagctactcgggaggctgaggcaggagaatcacttgaaccaggcagtctgaggttgcagtgagccaagatcacaccacagcactccagcctggcaacagagctaggctccgtcaaacacacacacacacacacacacacacacacacacacacatcaggaaacaacagatgctggagaggatatggagaaataggaaagctttacactgttgatgggagttcgaccattgtggaagacagtgtggcaattcctcaaggatctagaactagaaataccatttgacccagcaatcccattactgggtatatacccaaaggattataaatcatgctactataaagacacattcacatgtatgtttactgcagcattattcacaatagcaaagacttggaaccaacccaaatgcccatcaatgataggctggataaagaaaatgtggcacatatataccatggaatactatgcggccataaaaaaggatgagttcatgtcctttgcagcgacatggatgaagctggaaaccatcattctcagcaaactaacacaggaacagaaaaccaaacaccgcatgttctcactcataagtggaagttgaacaatgagaacatatggacacagggaggggaacatcacacactggggcctgtcgaggtggggggcaaggggagggatagcattaggagaaatacctaatgtagatgagagattgatgggtgcagcaaactaccatgacacaggtatacccatgtaacaaacctgcacattctgcacgtttcccagaacttaaagtataatgaaaataaataaataaataaagctaaatttaaaaaaaagaataagatcatgtcctttgcagggatatggatggacctagaggccattatccttagcaaagtaacacaggaagagaaaaccaaataccatatgttctcacttataagtgggaactaagtgatgagaacacatggacacatacagcggaacaatacacactggagcctattggagggtggaaggtggtaggaaggagaggatcaggaaaaaaaaaactaatgggtactaagcttaatacctcggtgataaaataatatgtacaaacccccatgacataagtttagctatgtaacaaacctgcacatgtacccctgaacttaaaagaaaaaaaaaaacagtggaggcaattgcaaagacaataaatgatgtatttgattacattaaaaattgaaatatcaaaacattcccagaaaaattaaaaagaaagaaaaccaaagcagagtattcacacacaaaaaatataattttttaaaaaatctagattttataatttgacttaagaaacaacataacaaagactggtatggaagatgcaaaatttttaaatctaagtatgtcactgtttattaaagtagtaaaaataagagtaagtgaaatatacattaaaatgcacactagaatttggctgggtgcagtgaatcacgcctgtaatcccagcactttgggaggccaaggcaggcagatcatgaggtcaggagttcgagaccagcctgaccaacacggtgaaaccccgtctctactaaaaatacaaaaaaaaaattagccaggcgtggtggtgcacaactgtaatcccagctactcaggaggctgaggcaggagaatctcttgaacccgggaggcagaggttgcagtgagccaagatcgcaccactgccatccagcctgggtgacagagggagactctgtctcaaaaaaaaaaaaaaaaaaaatgcacactagaatttaagtttttattctctggttgcttttatttcaattactaatgttagaagctattttttagcaaatcctcacaactttgtacttttccaggcaatggccatcaatatcttcctttctctaaactggccaagaaatcttgataacaaattattttgacctcatgatattatatcagctacctctaagtgctttctctagtttatagcctagcaggcagaaactctgccttaattattcacatagtatctgatttaagtaacctattatatgcatatacttaattataataaattgtatcagggtctctcaacaaaatgaacttctattattgtaagcctacagatatagggaaagacttttgtctcaagcacgacaaaatctagaggttcacctaaaatagagattaaagaaaaagacctttcagttcctatggctattgtttcattaattttagcatacatgtaatttaccaataatctaatgtagtctattttttaaatgatttttaagtataactttgtctccattatgaatatatttttacaagttacttctaaaactaagtctatttctaaaaccacattttggaatggcaagtcatcttttctctcagaatgaaatctacaacataacgttaatcttttaaggatagagaggaagagaggattaataaagcaaatcttattccagtacaaataggaatctgtatgtggctggagaggtacctttatgctgaataattttcaagttatatgtaactttattctgcggttttctattcctgtgggactgtgagagcaggtgaaatatttgtcaccaaccataaaaaattatgaactaaagtaataacactacaataactaagctcgtctctaacagatgtattctgtggaaatttcccaagacaacagccttagaaaatggagtagtgttaatttcaactaaagttctccatattgaactatgtcttacaggtctaaagttctgatgcatctttaaataatgggttttgaaaaaagcttcatacatcttgataactttctcggctttaattgtgttgattctaacaatcctaatgagaaaaattaatgcctaaagccaatggtgataccagaaagatattaaaatacagctggcactctttatccatgggttccacgtctgcagacaagaagggtcaactaaggaacttgagcatccatggatttcagtatcctttgggttcctgcaaccaaccccctgcagatactgaaagatgactatatctggaacatacagattaaatgagatattgggaataacaaaagagggagaaatgaaggggaaaggtttcaagtgaattaattcttacttaaaaaattcatactaatagattaatttctcctttttgagagtcaatcacatgataagtcaatgtaatatttttcaatatacactaaatagtatagaatttggtgaggcacaaattccctgaactggatcaacagaagtttcttatttaaagtacaagaccatcattaaaagtttcacttacaactgtaaaccccaagaaagaacagatgctctgaagcattcttcacactgtccttaagtccctatgtccacctcttcctctgcattcagattaacttctgaaggaaatcctgaaatcaagcaaatataacactacagctacaggcattctttttttactctgcttagttcctctttcttcagtactaaaattaaagctatacaactgccttagcagcctgaataaatgttctatctttgaaggattagaaacctgcaaatggaaaaggcgttacaaacaaaacagtaacttaaaaagatacttcaggccaggtgcggtggctcatgcctgtaatcccagcactttgggaggctgaggcaggcagatcacctgaggtcagaagtttgagactagcctgactaacatggtgaaaccctgtctctattaaaaatacaaaaattagctgggcgtggtggcacatgcctgtaatcccagctactcaggaggctgaggcaggagaattgcttgaacccgggagatggaggttgcagtgagccaagattgcgccactgcactccagcctaggtgacagagtgagactctgtctcaaaaaaaaaaaaaaaaaaaaaaaaaatcagtagtatctttaggagcccaagaagccatcctaacgaaaaaaacacaaatgcttattaaggggatcctgatgaaaagactcaggatgttcaaagtcttaaatttgttttaaaaaccttcaaagtataaatagctattctaatatctaattcaataaacaaagagaataaggaaacataacataactgatcactgtaattgtgcataagtgcacatgcataaagaaccaatgattaaagacagaagtaacagtgatgttaagaaacattgatgttgcaacataacaaactaatgagaagcataagaacagtaaacattgggcaaatttgtctcaagctcatcttcatcagatttcagcttacagtatcctatctactcggaagtccttaatagtatataaaaatatctctaagcacttcaaaaaacaacattaagaagagcaaaatatggtggttttattcatgtggcttctcatttattgaaaattcagggtctccatgcttgcaatttgcaaacaactacaaacagcagcctcaattttctatcttatcacttgggaaaaagcactaaaatcatttttaatggtttattttgtaagcacaaattgtaagcatcagattgtgaaagtatcttgatgctataaacaaacagtaaaattacaatttacaatttaattaagaaaacaaaaaatataacctgtcattttattatttttaaaaatctaattgatttaaattaaatgccatgtttcatttgtcatataagaaaatataaattcacctttcatattaataattatacttcaattatattttatgatacaatatttaactactgatctaaaatatatattttcttatttttaaaatacattccataaataaaagacaatgattttctaaatatttaatggtgttcaaaaaaacagaaagaaccacattaataggagttcatgagccatatacggttggaaaaatatgctcttagataagcctgattattcccactctaccagtaataacaaaaagactcagttatgtaagtaatttgtgtccaagtttacataactggtgagcagcaacactagggtttaaaccagggccgtgtaactctcagcttattctatgaaatcatgatatcaatgaacaaatgaatgaattttatttccccaaggtttctgaataagaagctatttccacacactgttaggtggcttcattgtgccatcaataataacacagatacaattaaggaaataattcagtgtaacaaatattttctctagtccctatccaagtgtttagtactcaaaaatgaaatgctcatgtattagcaatctggctatcaaccaattcaaattaaaattccatttaccaatgtcatcaattacttcctaatgtcaactcttttgcagttttcattgcttgtggcctcagcagtcagtcattttccctcaaatattctcatttagttcctgttatgttacattaccctgaattttttctacctcttcattcccttgcttctatacaatcattgtaatgacataagtacaaatattaacaaaagtatatcagtgcaacaaaaaatatgacagagtaagtaacattaactaggacagagagaggtataaacttctagatcccaaaattctcactaagggatggatggctgtaaatgactgtattggaaagtcacatcagttcagacctcaggaggcagtattgtcccatctgggcatagtcttacatacagaagcaatccagcctgcatctgagacaggtgtatttttttctaacttcaagttgtataacatgtaacatgactgcaagagtactatacataacacattcaagcagttttttaaatccttaatcctcaccctcagactctctctagtctgataaagcctagtccctataaattactaaattcagtgtcatggaactggaactacaaatccctgggagtcatgctatataatctattctaatttctttcatataccccatattccctatattcttcacactcccaaaaatgggacccttcaaaggctcaggtctgaacccctttctcctccttcaatatatcaagcttatacctttgtgtttataattccacaatcaaatctcttgccctaaaagctttcccaagctcctttttcaaacctccccctgctaggcatcaccaccttggaattttgcagtcacctcaaggttaacatgtttgaaactaaacttatcctctttctaacacagccagtttcccttcttgttttctgagttgcagaagagagtgatccctggtttcctctcttctccctctctcctgcaacctatagccaccaagtcttgtaaattcagccttcataagtttccttcctgaccaccccaatcctcatctcagccctttttcccagagaaatgcaactgtttcctaactgatttctacacaaactgtctcttcctctccctctgctcaaactatatttcacacttcacttcctgttaaaaaatctttaatggatccccattgcctataaaatatctttcatactatttatccaattatttaaaattcttgttggatccctgtctctataacctcttctctctcttctcctatacatcagtcatccaatccagtcaaattgctccaaataaaacatgcagtcccacttacgtgatgttggttggaaatttctcacgcctagaatgctctcctttctctcctacacttaactaagccctacctttcaaaattggattgctatctcaaatctctcttattaaacacatgtgaaaaatgaaccattttctcataatccttgccaaaaaacaacatctaaactcctaaagaatccatccaaaagaaacacatgagtacacctaaaatctgaaagtcaggagaagaagaataatgtatgaatgcaaatttctttttccttctatattgaagcacttttggcctcatgtgttcactttctattcttaaaggtagagacttaattctattttctacagctcttaaaggctgataatgcagttattatgattgcgactagctagctcatcttgttagagaaagtatcatggtactgggttaagtttaaatatccatatggaatagaaaacttcatttatttgggtgccacaaattgcaaccctgacccttcccagaagtctattaatatctaccatgaacaccaagataatgtttgtggccagatgaaagtaaaaacagcctaaagtgaacacccaactgattttatttccttaaaatggatttgaaatagaatattttattattagttactttgaatattattgatatttacaaaaacatacttcaagtaaatctgcctaaaattggcttgagaactatctgaagagatttttttttttagattttcagaaaaatattcctcatggaatatctttccaattttgcagcataaaaaaatagaaaacattattttgtttcttatcaaactaatttttcaattttcattcatttaacaaataatactgagtatatacttatgccagaatttttctagacaccagtaatacagcaataaactaagtagataaagctgctgctctcaagtttacattctagtggaaggagatagaaaataaacaagcaaatatataatacgttgaatcgtggtaagttctctgaagaaagataaaacagggtaatggaaatagagaacactaagaaggaaaacagagaagactttattgacaaggtgatatctggacagatattttaaggattatagctattcataaaatatggaataccagcatagccaaaattcaggtaatactgtgatgtagtaacctaatgtttcctagttacattacttaaatattctgtcctactgaattaacaaatcctgggagtaaaatatttgtaaaagcctaggctgcaaccaccctcaatcatctgatatagacactatagttttctaagctccctccatcagcaaaatattcgttactcaaagctgatttgtactgaccctgtgggacacaagcccatttcaaggctgctggctatagcttgaaaagaaccactgagatgtaactgaacatttctgttcaagtagggctggccctacccctacctcctataagctttgacctggatacataatccggggctaattaatcaatacatccatctctttgacaactgagattggctcagcagtcaaaatgtgatcaaacttagaaatcttgcttgaatttggggaaagaagcgcttttggccaggattattaagcaaagaacacaatgaaccttgggctacttatatcccttgccaccatatgggaaaagctggcctgagaacaaaaccagtgtagaggaaaatccagctgaccaatggggaaaggcagattccagattacattgtttgagtactaggatccataaaagcctagatttttcatttatatgcgctaacacattccttttctgcataaatcagtttgaattggttttgaagagatacatggaaaatcagaaaataagatatggcagaaattttctcttcccattttcaacactgaactggtatattctaaatatggatatatgggtgttacctctttgatggaagtaaacaaggttttatcaccggacctaaagtctgaacacaaggccatttcaaaggaataaaatctaattttccttaagggagtcaatataaacaaaagaaggtccagggctatattggtgaccatcagaagctagtgcttcagaaagagtgtctcagggtttaaagattctggcatatgaaaaatattactttgagggaaaatccagtacacaaaataaaaggaattctaaagcaaatcaaatgaaagcaaatatagttcactgtcagaaaagataaagaaaaaaacgaaaaatagtacaaccagatatatagttgtataatccaagttttagctaggattcttaaaagtaattgctgacttgtccaccagacagtacaaataatcaataacattctatctcacagttgaattttgtaatcacaaaaagaacaagatctcaaattctctctcaagcatattagaattactgattttatttctttaaatatgtaaatttgtgagtgaggcacttataatttataactttttatgtgagtgaatgcatcaaaaattatgtgtaagtgttcaagataaccactctaaacagaagtaaaagacccgctatatatataataagcaaatgcttagaggtcactataatattcctaggaaaaaagtaaaacttgaaattgcattgcataaaggtctaattgttgctatataaacatatttcacaattttacctaggaagattttaattaataaattcatgtttatactactacctataactataggaaaagcttgtataaatgagaactacaaaaatcaacatgtatatggagaaaaattatttaaattataaaagatattgtatagccaattctacttagctttttaacaaacctgttttctctacttcttgggcacttagctaaaccatatttcctagtcttgcagtttgggacagccatgtgattgtatgactgagtactagtcagtggaagataagtggaaatgatgtctactgtttccaggcccatcccctttaacctcctacctcacctgtatcttccatcatctttacccataccaccttttgacagataagccaagtgaccttgaaaggttgtgctcaaaagggcagagtcaatagatgggagaaatctgaactccccctttgaggagagccacctgctgatccagaatacctgttttagactttaaattgttaagaaataaacttccattatatttgattcattatataatttttattttttaaaatagctagtattaccttaactaatatagcttatgattatatcactaatatgtgatcattgatattcatgattcattttatttttccactaattttaagtttttaatatccctagaactcagtacaaatgcattaacttcaaattataaaatattttaatattcataagtagtctacatcttcagtaaaactattttttgaaatttatttctttgcttaatcccagattctaaactttctttaacatttaattaacataattaaacttattcatggctttagtaatcaattagatctttctttaaaaagatttaattggccaaaagatttaattgtaattcttttttgaaatcaggataatgtaacctcttattaaaataaacaaaaaataaataaaaatcagtatgatacatcagttttgccatattcctataaagcatctcgaaagtaacaaaatgcttcaagaaaactaccataaaataacattaaaatatttaaaagaagaatggtcccgccagcatagctcttattcagtaagaatgaatgtgcagtccttctgaagaaacagatgaaaacaaaaaagaactaccccaggcaagactgaactaaaaatttttctcaatttccagtcaaactgtgttcacttttctaacatctacccatccacccacccattcattcttcttttgttcattgattcaaaaattgcatattggtattatgtggcaggccccataccaggattctgtgatatcacaaagatgaaatatatagataatgccctcaaggggttcacagtctaatatattcaagaacaagaaacaatcagaatttataactacttactacaattacaaccaccataagtactattacaggacattgggactctatattataaaaggcactgggagaaagcctaatacaaattggaatgaaggttcaaaaatgagctaagattagaagtaatgttttgatggaggaggaaaagtaaaaataatgaaattggtttggggcagaggagagtgtgagaactcaggtatagttatacatgctgaaagactggtgaaagagagtttggtaaatttatagaattataaataatggggaaaatgatgagagatgacaacacagccctaaataggagcaagttcatgacatgccttcattttccctattccataatcagatgattgttattatcacactttttcctgtgcctttcacctcatattcaaacaggacagaatcacttttcattttcactgattaaaatatagctatttctttttttaacacacttttataagagagctactatctgtcaggcaacatcccagactctcagatatactgttcttcctaactttctacaacaccttatactatcatttactggactgcttgcttggtaatacactttaccaccctgtatttcaattatttggtaatatatctgttttacctgccaaactccaagctccataaaacatggaaatgcctcagtcgttttttttgtctgccataaaacagtagctagtacgtaatataggtataacgaatgtttactgagtggatgaactaaagcaatgaagaaaaatggattagctttaaaataagagactatcattttagttttctcattacgcaataagattttttaaatatacaaaatatcataatgtgtattttatgtttatatttttatgttttgtaggatattgatactatttattggtaagtaataatattttattattgcagtaccccttcacaatatacccttatatatacaacttataattctgatagtttctgaaaacacattactattggaatgctgctaaaaatatgactagaattcattttttcatccatataaaaatgtttattgagtagttactatttgtaggacactatgtgaattgcttagcttttatatttcattgccattaaatacaataatgtaagaggtaaaatatgtcaaattaacttccctttgtacttagtcatagtcataccctgaggcaaaggaacaatgtcattcaacctcctttcataaataatatactttgaaacaatgactgattcattgttaaactgcatgattatatagtataaagattataaattcagttgaagttcaggtgttttttattatgagatactgtacttttaaattctggaatttccaattaatgtttttaatagatctcatttctcttctgagagtctccatctgttcaaagaaaaagaaaaagtctgagctggagtaagtaaggaggtttctatataaagaaagacttgaactacacctcataagatgaacaagatttaaacaaacagcaaagatgagagaatgaaacaatgagcaaacacaccatgcaagaaatgcctatgatatttttagacaaataacaaaggaataagctatactggtggcaggaaggagaacagaaagaaatatcattggataaggaggggtagtaacagaatcggaagatcttgacattcttgaactccaagaagaggaaggggccacgataatttagttaaaataaggctcaatattgtatcactgctctgtatacttcaatgtgtttttgtagtggctggtaacagtctttccttttcatatttagtgcttccttcagaagctcttgtaaggcaggtctggtggtaacaaactccctcagcatttgcttgtctgaaaaggatcttatttctcttttgcctatgaggacagagtcaaatctacacatatcaataccagccttaaatgtaaataagctaaataccacaattaaaagacacaaagtagggtgggcacggtggctcacacctgtaatactagcactttgggaggccaaggtgggtggatcacctgaggtcaggagttcgagatcaacctggccaacatagtgaaaccccatctcttctaaaaatacaaaaaatcagccgggcatggtgctgggcacctgtaatcccagcaactcaggaggttgaggcaggagaattgattgaacccaggaggcagaggttacagtgagccaagatcacaccattgcactccagcctgggcaacaagagcaaaactccatctcaaaaataaaataaaataaaataaaagacacaaagtggcaagctagataaagaaccaagatccattggtatgctgtttgcaagagactcatctcacatgtaatgacacacataggctcaaaataaagggacagagaaaaatctaccatgctaatggaaaacaaaccaaaaaaagcaagggttgctattcttatttcagacaaaacagactttaaactaacaaagatcaaaaaagacaaaagagggcattacataatcataaagggttcaattaagaagatctaactatcctaaatatatatgcacccaacacaggaggaagcagattcttaaatcaagttcttagagactttcaaaaagacttagacttccagagaataacagtgggaaactttaatactccactgacaatatgagaaagatcactgagacagtaaattaacaaaggtattcaggacctgaactcagcaatggatcacatgaacccagcagatatttacagaactctcccccagaatatacattcttctcattgccacatggcacatactctaaaattgatcacataatttaaagtaaaacacaccttggcaaatgcaaaagaactgaaaatcataacaaacagtctctcagaccacagtgcaattaaattggaaatcaagactaagaaattcactcaaagccatacaactacatgcaaactgaataacctgctcctgaatgacttttgtgtaaataatgaaattaaggcagcaatcaataagttatttggaattaatgagaacaaagatacaacataccagaatctctgggacacagctcaggcactgttaagaaggaaatttatagcactaaatgcccacgtcaaaaagttagaaagagctcaagttaacaacctaacatcacaactaaaagaactatacaaccaagagcaaacaaatcccaaagctagtagagtacaaaacataaccaaaatcagagctgaatttaaggagattgagacacgacaaaaaaaatccaaaagattaacaaatccaggagctgctttttaaaaaaaaaaattaataacatagaacaaatagctaagctaataaagaagaaaagagggaagattcaaataaacacaatcagaaataacaatggggatattaccccgaccccatagaaatgcaaacaaccatcaaagaatattatgaacacctctatgcacataaactagaaaatctagaagaaatgaataaattcctggacacatataccctcccaagactgaaccaggaagaaattgattctctgagcaaaccaaacctctgaaattgaagcaataataaacagcctaccaaccagaaaaagcccaggaccagaaagattcacgactaaattctaccagatgtacaaagaagaaccagtaccattcctactgaaactattccaaaaaattgaaaaggagggactcctccctaactcattctatgaggccaacatcatcctgataccaaaacctggcaaagataccacaaaaaaagaaaaattcacaccaatatccttcaggaaaatggatgcaaaaatcctcaaaaaaaaaaaaaaaaaaactgacaagctgaatctggcagcaaatgaaaaaccctatccaccataatcaagcaggctctatccctgagatccaaggctggttcaacatacacaagtcaataaatgtgattcatcacattaacagaactaaagacaaaaatcacataattatcacaatagatgcagaaaaggcttttgataaaattcaacatccattcatgttaaaaactctcaataaacagactttaaaccaacaaagatcaaagaagggcattacataatggtaaagggatcatacctcaaaataataaggacataccttataatgtccttattttgaggacatacctcaaaataataagagccatatatgacaaacccacagccaacatcatactgaacgagcaaaagctgggggtgttcccactgaaaactggaacaagacaaggaagccctctctcaccacttctattcaacatagtactgaaagtcctggccagggcaaccaggcaagagaaggaaataaagagcatttgaataggaagagaggaagtaaaaccatccctgtttgcagatgacatgatccatatctagaaaaccacatagtcttagcccaaaagcttcttaagctgataaacaacttcagcaaagtctcaagatacaaaaccaatgtgcaaaaataactagcattcctacaacaggcaagtggagagtcaaatcaggaacatactcccattcacaatagccacaaaaagaataaaattcctaggaatacagctaactagggaggtaaaagatttctacaagaactacaaaacactgcacaaagaaatcagagatgacacaaacaaaaataaattccatgctaatggataggaagaatcaatatcgtgaaaatggtcacactgcccaaatcaatttagattcaatactattcctattaaactaacattgagactcttcaagaactagaaaaaaactactttaaaatgaatatggaaccaaaaaagaaccaaaatatccaaggcaattctaagcaaaaagaacaaagctggaggcatcatgctacccaatttcaaactatactatggggctacagcaaccaaaacagcatagtactggtacagaaacagatacacagaccaatggaacagtatagagaattcagaaataagaccacacaccagaaataagaccacacacctacaactatgtgatctttgacaaacctgacaaaaaacaagcaatggggaaaggattccctattcaataaatggtgcttgaataactggctagcaatatgcagaaaactgaaactgtaccccttcctcataccatatacaaaaattaactcaagatggattaaagacttaaatgtaatacccaaaactataaaaaaaatcctggaagacaacctaagtaataccattcaggacacaggaatgggcaaagatttcatgacaaagatgccaaaagcaactacaacaaaagcaaaaattgacaaatgggatctaattaaactaaagacttctgcacagccaaagaaactatcaacagagtaaacagaaaacctacatattgggagaaaatttttggaaactatgcatccaacaaaggtctaatagccagcatctttaaggaacttaaacaaatttacaagaaaaaaacgaccacataaaaaagtgggcaaagaacattaacaggcacttcaaaagaagacatacatgcagccaacaagcatatgaaaaaaatgtgcaacatcactgatcattagagaaacacaaaccaaaaccacaatgagatgccatctcacccaaatggctattaaaatgtaaaaaacataacagacgctggcaaggttatggaaaaaaaagcaatgtttatacactgttggtgggagtgtaaattagttcaaccattatagaagacagtacggtgattcctcaaagatctaaagacagaaataccattcaacacagcaatcccattactgggtatatacccaatggaataaaaatcattctattataaagacgaatgcacacatatgttcattacagcactattcacaatagcaaagagatggaatcaacctaaatgcctatcagtgatggactgaataaagaatatgtggtgcatatatatatactggaatactatgccaccataaaaaagaatgagatcatgccctttccaggaacatggatgaatctgaggccattatctttagcaagctaatgcaggaacagaaaaccaaataccacatattctcacttgtaagtgggagctaagtgatgagaacacacagacaaatagagaacagcacacactggggtctactgaagggttgtgggtgggagaagggagagtattgggaaaaacaaccaatgggtactagactaatagctgagttatgaaataatctatacaacaaacccccatggcacaagtttatctatgtaacaaacctgcacatgtaaccctgaacttaaaatagacgtaaaaaaagtaaggctctcattgatttttgaccgtgaagtcatgaaatacaaactccatttcagaaagtctcatctggcagtataatataggtgtgggttagaattaagagagactgattgcaaagaaaggaacaaaaacattggtttgacaccttctgtgtgtccaacacactgctaaatactttttacacaaagtatacttcaataggaaacagtgagagactaagacaaaatgggaaggttagctataattatggggtaacctttcagtgatacagagaaaaatacatataaatgattcaacaaataaaatagaaatgacaggctaccattcgtttagtgtgtaatctgtggtgagcactgtgttaggtactccatacttatcacctctatcctcacaacaatcctgcaaggtactattattcttattgctaccatttttcatattaaaaaaatctaaacatcagggaaatatttaccagggaaataatacctgcaagatactattactattactattgttaccatttttcagatgagaaatctaaagatcagtgaaatatctacctatggagtagaactggaattcaaacacaagtcttttgaactcaaattcctgttctctaccctataatgtcacatacaatacaaaaatatgttattgaagaaattagtgtaattctttaatgcaaggactctttaatgtaagttagtgaggatgataattactatgacagtaaaaacactttaatgtttgagaaaggggcaccaggctaggtaaaactaggattagagattcaagggcaaaaggaaatctttcaaagctggaatggatttatttcagtaacaaagaatagattataggaaaagatataacatgtcaatttttgtctcatttattctgagggcaggcaattttcactttaatgatcccgcttctcactagttcattttctttgttcattttaaagtctttatttcctgtcggatttattcccttgactaagcattctttctccaaattaagactttgcttctcattattaatgatttgatagcacagactggcagctatcacctaaatggaactgttaggaaactgtaaacaaacacaacttttcagctttaaaaagcatagatggcagatgcaagaattctggcaaagccatgtgaaaataacatcagttttaaaaatctaagcctgagattgaagcaggccacactgtatcttttacttacgattattgattctgattctatcatagagaatcccaattcttcagctgttagaggctgaatgaattccaatattctttagttgtggcccaaatggtctcctgataaaatatgttgaagcatgagcaatttcagcaattttttctgggttactagtctactattccatcagaattaatttgctcttcaaggtgaaaagcatttcctcggacacagagttaagtgattattgcaactgccatgtctctttaagctcaggctctcgcctgatttcctttggcattaggcagcaaaatggatttttttaaatactggcaagctgtccaaggtcttcactcaaaaagagagccaagaactcccaaatgtaaaccttgaaatagaattacaaattaggtacactatgacaaatgaacaaggtaaatgtgaaaagtgactaaaagttaacttcatcattatccagaatgtgaggttaaaagaaaggtgaattattactacattttcaggaaaacattacaattagctcataagtgtaaagtacagattctcaggaaaattctaacagctgagttcttctactagaaagtttaattcaagttagagattataaagagattagaaagaacaaaagtatcaaaacaaaaactggccaataatatatctgaagagtatataaaaatggtaacctcacaaatgtcataaagttcaaaacataaaaattaaaatattttagaaaggaagtttactgcccttaatagaatgctcataatatagatgcatattttaacatcaaacacattttaagcacatgcacaatgaaatactgtgcatcagtgaagtccataaaaatgtgcaagaatcattaacaattagaaaaaaacaggatgtcatcaaccaccaaatatacattcttatcacctgcacagggaacatactcaaagattgatgacatgctcagccataaagcgagtctcaataaattcaaaaaaatcaaaaccataccaaccatatttttggaccacagtggaataaaaatagaaatcaatgccataaacatatctcaaaaccatccctcaaatcttttcaatttcatgaaaactaaacaacttgctactgaatgagttttgggtacgcaatgaaattaaggcagatatcaaaaaaatctttgaaataaactaaaacagacgtaacataccaaaatctctgagatgcagcagaagcaatgttaagaggaaagtctatagtgctaaatgcctacctcaaaaaatttttaaagatctcaaattaataatctaacatcacacccagaggaactagaaaaacaagaacaaatcagaagaaaagaaataaataaaataaaataaaatcagtgcagaagtgaatgaaattaagacccaaaaattcatacaaaaaaatctataaaaccaaaagttggcatgaaaggataaataagatcaataggctggcagctacattaacaaagaaagaagagacaatatccaaataagcacaatcagaaatggcaaaggtgacattaaaaccaatcccaccgaaatacaaaaaaaaccctcagagactatgatgaacaccatatatatacaaactagaaaatctagaggaagtagataaattcctggaaatacaccatatcccagggttaaatcaggaagacattgaaaccctgaatagaccaataatgaattccgaaatggaatcagtaataaaaagcctaacaaccaaaaaaaaaaaaaaaaaaccctggaccagaaggatttacagctgaattctaccagacatacaaagaagagctggtattaattctgctgaaactattccaaaaaattgaggagaatgaactcctccctaactcatgaagccgccatcatcctaatatcaaaacctggcaaagacacacacacacacacacaaaagaaaactacaggccaatatacctgatgaacagagaagcaaatatcctcagcaaacaaactaaaagcagtagtgcatcaaaaacttacgacgatgaaggaggctttctccctgggatacagggttgattaaacatatacaaaccaataaatgggatttaccacataagcagatttaaaagcaaaatcaatatgatcatctcaatagatgcaataaagataccttcaataaaatccaacatcccttcatgataaaaaccttcaacaaattaggcatcaaagaaacacaactcaaaataataaaagccatctatgacaaactcacagccaacattataataaatgggcaaaaactagaagcattttccttaaggactagaacaagacaagtatggctactctcaccactcatatataacatagtactgaaagtcctagctggagccatcatgcaagaggaataaataaaaggcatccaaatggaaaacaaaaattcaaactatctgtcttcactaatgatacgattctatgcctagaaaaccctaaactccaacaaaaagctgttgaaacttataaatgacttcagcacattttcagaacataaaatctatatatgaagatcattataatttctatacatcaataacattcaatctgagaaccacagtaagaatgcaatcccatttacaataaacacacaaaaaacgaaataccaaggaatacagctaaccagggaggtgaaagatctctacaatgagaactacaaaacccactgttcaaagaaatcagagatgatacaaagaaatggaaaaacatgccatgttcatgggctggaagaatcaatatcaataaaatgtccacactacccaaagcaatctacagattgaatgtattcttattaaagtaccaatatcatttttcacacaattagaaaaaaactattctaaaattcacatggaatcaaaaacaagctcgaatagccaaagtaatcctaaaagaatgaagccagaggcatcacatttcccaacttccaactatactatacagctacaataacaaatacttcatggtactggtacaaaaacagaaacatagaacaaaggaacagaatagagaactcagaaataaagccacacaactacaaccatctaatcttccacaaaaataaacaatggggaaaggacaagctattcaataaatagtgctgggatacctggctagccatacgcagaatgaaactggacccttacctttcatcatacacaacaattaagaaaagatagattaaagatttagatgtaagacctcaaactctaagaatcttagaatgaaacctagaaaacaccattctggacataggtctgggcaaagatttcatgataaagacttcaagagcaattgcaacaaaaacaaaaattgacttaaaaccttctgcacagaaaaagaaactataaacacagtaaacagacaacttacagaatggtagaaaatattcacaatccatgcatctgacaaaggtctaatatccagaatctataaggaacttaaaaagtcaacaagcaaaaaacaaccccattaaaaaatgggtaaaggacatgaaaagaagatatacatgcagttaataagtatgtgaaaaaaatcctcaacattactaatcattagagaagtgcaaatcaaaaccattgaatgcaatctcacacctgtcacaatgactattattaaaaagttaaaaaaaaaacagatgttggtgaggttgtgtagaaaagggatcgcttaaacactatttgtgggaatgtcagttaattcagctactatagaaatagtttggagacttctcaatgaacttaaaacagaactaccatttgacccagcaatcccattactgggtgtatgaccacaggaacacaaatcattctaccattaagacacatccacgtatgctcattgcagcacttttcacaacagcaaagacatggaatcaatctagatatccatcaacggtggactagataaagaaaacgtggcacatatacaccatgggatactatgcagccataaaaaagaataaaactgtgtcctttgcagcaacatggatgcaggtggaggccattatcctaagcaaattaacacaggaacagataaccaaataccacttgttcttactcgtaagtgtgagttaaacactgaatacacatggaaacacacatggacacaaagaggggaactacagacaatggggcttacttgcgggtgtagcacgggaggagagtaaggatcaaaaagctacatattgggtactatgctcattacctgggagaataaatcatttgtacaccaaatcccagtgacacacagtttacccatgtaacaaacctgcatatgtacctcactgaacctaaaataaaagctggaaaaaaaaaaacaaaatagccccatctcaataatacagaaagaataacaaggattaattcaaaaatgtttatcacataaatatttaggaattcaaaaattaataatgtaatcagacatatttcctatattcatatactatatacttccttcgtatatgttatcaggaattaaacatggtatttgtaatacaggatatccttctcatcagtgagagtgatgtactattacctaagaaaaatataatttgacttaagatcctagcgatatattgtgaagtcaataatatagtttacaggggtattttatttcatcctcaaagaaactggcgaggtattcattatttgaaaaatcacccaacaggggaagttcttctcagatcataaatattccatgttagaatttttctcatatgcctacaccgaaatacaggttatcaaacagatgtttttatgcccatgacctgttctatcaattcaataaatgtttgctaagcatgtgagtgaggaactatgctaaggacaaatacatgcacacacacagattaatattttccctgtcttcaaggagcttataggcaaagtcaaaaaagatgattcatgcataattaatacaaagcagcataatgatgcaaatagttagatctaaatagaaggatcaaaaatagttttcaataagtagagatggtagggataatatatatagacaaaacatgaacgtggacaataagaaagacagacgtgtttgagagtaatccattttatttatttatttagagacagagtttcactcttgtcatccaggctggagtgcagtggagctatcttggctcactgcaacctccacctcccgggttcaagtgattctcctgcctcagcctcctgagtagctgggatgacaggtgcacaccaccaggcccagctagtttttgtatttttagtaaagatggagtttcaccatgttggccaggctggtctctaactcccgacctcaggtgatcctccagtctcagcctcccaaagtgctgagattacaggcatgcaccaccgtgcctggccaagaataatccattttactaaaatatatttatctaagacattactagcagataaagctggaaaaatatgatgaagctagaaatgaagggtcttgaatgcctgagttaaacgtttctatttaacatttgcagtgaggaccagggctagttttgagtaggaaaatgacatgaccagaatggcacttaaggcatactgacttggcagcattgctcagaataaatatgagcagatgaagaggagagactagaagtgggtggacagggtaggaggctcttgaaataactcaggtgaggggaaatgatggtctgaacccacaaactggcaggaatgatgaaaaggtgagaggtcaatctggaagacagtaatgaaagacagaatgatctacttgtaagacattggacatacattcagatccaagatttaccttttgggcaactgactttactcctgattcccacgttgaggataataaaacctacctcatgggattgttgtcaggaataaaggagataatgatttttaacatgtttacacaatgcctagcatgtagtgaaaatttagtacttaataaatgctagcttctagtgttacaattattttgagatattatagtttggtcactgtttactgatttttttagtagctacatctcactgctggttcacgtagcagttgtagtcatctatataccctaaaacttttgtgtgaactactctctgacattaaatctcccccaccttgtatttataccattgatttttaaggaatctaaatataagattttatactaactcccactgaattctatgtttttaccttgagccaagatttcagcctattgagataatttttcatataagttcaattatttgtcatatttgctattcctccctaacttctacaaagctgattagaatacatatggctttttccaagtaaaatattgactcagaccaatccaagaacaaaatatttcactttcactagagaaatcccctctacgttgacattttgtgactatttagaacgtctggacaaaattggacaaagtctgtgaaacataaaaatcaagatctcttcagcaacataaaagagaacaaaatagctcttttctatggctgacagaaagccagagtaaaatttttttaaccgatgcagaaactaaggcttggaaatatcaagcaacttccaaaggtcaccctgctagtaaattgcagaacagagttgtacaaccaaatctgtaggactcacaatctcatgctcttaactgctagactaagttatctccctaagaaagatggttgagattcccatcatgattgctgggaaaaacctccactttggtctctggaattcatctccaaataattaaatgcattttgcaatgataatggttcatttgcaagaacatatacacttttatatgcagtctttgcctttttatgcatttattcagtcaatgaactttcactgagagaccactacattcaaggcaccgtgtgaggcaggatgtgactacagagatcaatctaataatgaacctactgtcaaaggggtatataagaagtaatgcaaaacatatacacctacaaggcaaggcagaaagagatgtatcaagaatggtaaaaagcaagtgtgctagaagttcagaaaaatgactcttttattctactagccattttctcaaggacttcctagattccctaaggttacaaaaagttcttcctgaggtgagggtaggaacaaaaacttacccttctgattctggatttttccattaatgtacctacagtacatacgtgtggttaatggtattgttttcaatatataaatgcaggtcaacatgatcctagttctacattccctaattcttgcaaaacctgttaggagatttccaaccttagttgaatcaccttgagtcaccacatccaaaaggtctgttcaactacataagaaatagattgttcaggttagaatgttcttttgaacattgtataccactgcttaagatttagcaccactataaaaaattatacatgctaaagaatcagttatgttcctataataagcctctatttacatttcaaaaaatttgcctcccaagattctctaaatctgatggaaattgggtaagatagccacgaagctctctccaaattctgaaattgatgcattcctgataataagctctagaaattgggttagaatgtgtttgaaggtaaactttgtttcagaaacaccatttggtttttaggcaatctaatctgactctactgatctttaaaacttgatgaattttagaactaaattaagtatattttccaaaagtagggacctcactcccagagagtattctcaagaatagcttggcattaaaaaaaactgaaaatccttcaaggtaaatcttgaaatcttaaaatactaaaataaaatacctcacacttcagaaggctgacatgtaattaaatattttgcattggaaaagaaagtaaaataacagaaaagaggcatagttgctgaacaaaattgcacaaaacctgccaatgcaacccctttcaaaccaaaagctttagatgctgcttgtgtcaagagaaaaaaatacataacacgtttcatcccttaagcttcttatttacttcttaaagacatacgctgatgaggtaatgttctattacaaatgtttaaaaaaaaaacaaaaaaacttttcctggtacctggattctgaaatctgctctaatgatctttatcatcaaatttctctatggcatgctgtgttcacatttaagaattgtatagattgtttatacacatggaggaaaaaacatgaatataaggcttgggaaaacataaagagaatagaaaattttttcagatgatttcacattctttcgaaaacctaaatttcatgagttggtaaagaatgttaggatatttatatttcttcaaaatttacattctagattatataatgtcctaattcaacttagaaaatggtttcagatgcatattataagagtatataaaacagactgacttttgaattaaaatgtatgcaagacaaaatgcaattttaacttgagctagcctttatattacatgcaaaacctccaattgaatacattcaatcataataagaatttaatttttaacttatattagtaaaagtgttcaaactaccatattatagctaatattttaatagaaacaaaaatctccgattcaaaaataaaagttcttacataagatggctggttttgtatttgaaattactgaatcagagtgccctctattggaagaaaagagacaacaaaagctaaactgaactaagaatataggtaaaatacttccaaaactcaagccacatcattaatatgtaaaacacattaattaaaaatatggatgctacaaaacatatttccttacatttttatttctccaaaataacttttggaattacttgtcatatcacaatcagcaagttggatgtttcatatcctatgaaattaaattttaactgaacccaaatgctcatcatttaaccagtaatataaataacagacatacagaaatgttttccacatttaatagtccaatataacatagaaatgttataattgaggactgtggtttgactgcagtttggattttccttgatgataaactgaaagcctccttgctatgaacctcatgtcggtgtccccgccaagtttatatgttgaaatcctaaaccccaatgtgatggtattaaggagggggtgttgggaggtcatcagatgataaccccttatgatgtgctagtgttcatataagaaaacatcaggagggctgggcgcagtggctcacacctgtaatcccagcactttgggaagccgaggcaggcagatcacaaggtcgggagatcgagaccatcgtggccaacatggtgaaaccccgtgtctactaaaatacaaaaaattagccaggtgtggtggcacgtgcctgtagtcccagctactcaggaggctgaggcaggggaatcgcttgaaccccggaggcggaggttgcagtgagccgagattgtaccactgcactccagcctgcgacagagcacgactccgtctcagaaaaaaaaaaaaaaaaaaaaaaacacatcaggagaacctgcttttttcccctctgttctttgccacatgaagatacaaccagaagacagccctctgcaaaccaggaagcaggccttcaccagctaccagctctgctggtaccttcatcttgggcttctcggactccagaactgtgagaaataaatgcttttttttttttccaagccacccaatctacgctaatttgttatagcacagataatccctaattcaagagacttttagaagctcttacactggggaattgcagaagtaggctggacattaagatttacgagatttgttccatctcaaaaaattctagttttgtggtgttttcaagacctcagttctgactcatcatctcagacctgaattacctcagaaagatcttggctgatttttggctccctagaccagtagtatggatgttagacctgagaagcttttccaagagcaatgctcagagctacccaaaattattttgatttagttggtctggactggtatctgagggcatcagtatttattttttagagcctctctaggtaaatctaatatacaactatggctgagaaccattgtttgagcctctccccagatcaagcaacatacaactaccacttttattttccaaaaatgtcactttcaggagaactctcctacacaagaatttattctcaggatcaattttaaacttctggctagcctcccaatctacttagctgcctttgttctctgacaatagagttgagtggcaaggggttatggctccagctccagaatgtctgtgttcttggctctgtaattaccgcatgaaactgggaaagtcataaaagctccctgtatggagaaataatactatccttttcaaagggttattgtgaggattaaatcagttaatacaagtaaagtgttccataaattgaggtattatcattacttacccaactttatttcctactactttccaaaacaaactctcatcataaatcattctcaaattatgcactaattctcatctctgtgcttttgcacttactgtttcttcaggctggaatcctttctcaatcatttgtcccaacaaaagtgaaaagcacagctcccctttcaccaggacacagcttagtctctccctacctccacaaagacttcaatgagtatctgtaaatattcactggtctctcccttttaaaaattcctttggccacaaggtagcatactatgagaaatgtggctgagaattaaaaacactggctcagagtttgaatcctcactctgccacttggcagctaagtcattttctaaatccatattgttaggattacttaataagcgacttaaatcacgtaaagcattagagtagcaaatagcaaaaactgagtaagtgtcagttcttatttattcagtgttttatatgttagccttcagttatagtctacacactgtgactgaagtctccttaggataggtgttttgaaacacttgaaatcaagaaccatatctattataaatcccacaactcaaaacatggtaagaaccatctgtattaggtgacctatattaggtgacctgtacttgactaaactttttgcaacatgtaagagtataattgaagcaatattctggaaaaaaaacttttttgatgaatagaaacaaatattcaacaaaacatggaatgaattcaaataaaacaggctacagaaaagggtcaaagtaatttgattactttttaaacattcgctaacaggtttctatcagattcatcttctgaaaggtcagttccaatgatgtcttttatctgcccaaaatcctttagatttttctcatttcttaaaaaaaaaaccaaaattcttagcctgacattcataattatccatgacctgacctcaaactacacttctactctctcatctttcccctttgtaaactctattcttccaaataaacagaattatttgctcttactcatatataccatctgcttttctccctccacataatctttaatattttatagggaaatattttcaaagaacactattgtaaaggtttgtcacaggaacgaagagtggtgttagaaaagcatgagttcagatttcaaaaccttaacgctcaatttatgagcattaatttctttcttgccactatcacaatacagtctttggcttacaaaaaaaattgaacatcttttccccaaactattatcactctctcaaagtcaaaagcctttgccgtaacttcctgaaagatagaagcttgaatcatggtctccaagcagcacatacagaccccagggcatataagatattcattgggtaaacgaaaaataattagagcttctgttttacacttattctctaccttcctcaatttgaatttcttttgttgtgtatgtctcataatttacatcaaatattactagaaatgcagtctatatatatataatttacaaataatcagggatatttgctcaaaatttgtttactaatggtacgtacaacaaaaaagtttggaaaccctggtctaaaaaattagggctttcagaatatctgtggttttacaagtagaaggccagaagctgccagtttacataaatctttgaggatggatctaaaaatataaacactatgtgttgtttatatagcacaaatatgttttaagttctaactaactttcaaggaaatattaaaatgtaactgattggtaacctggagacagcatacacctatttcagattttttaacagaggattttgtcccaacattaaagttactattataaattatttcattaatataaaaatttcatttggtaaaacttacaggtatttacttcagtacatatacaactgttcatagttattcataaagaatttttattggggccaataataggatgtttttacaaaagagagtgaagcacaaaaacaaaatgaaacaaaaaaagcaggccaaggaggtaggactagccatggaactagattagcaagtgctatcccaggaaacagtgtcacagcttactttaagtaactaaattaagtaaatgttctcataatggacagtcactatacttagcaagtttttttttagttttcacaaataatatgacatacttaacacagttcactctattactggcttttgaataaagtatgatatatctgtaacaaattaagttctaaaagtgactacagatttcttatcagaataatgtatttcctttaataccagtatatactataagtccttcctctacaggacaaaaagtaggtttaaatatcttaatattaaactgatttattctctatagtttttcttgcttttgtgttcatataaaaatccaaatgagtgagaatcacccatggcctgacctcaatctatccttctaatcttatctcccctctttcttctttgtaaactctcattcctaataaatagaaatacttgctcttactcaactatatcatctgtttttctgcctcacataacctttaatattttatatggcaatattttcaaagaacactatcataaaggcgttgtcacaggaactaactcatgcttaagattctgagcttatcaaagagaaacctcttgggatttgcataatattataaaaatatgcagactgaactttccacatttctctcctactatgacttcaggaggaagtgaggaaactatacgtgtggctctgctctgttagtctgagttcatagagaaaatggggaagacagtcgaaaggaaggtttttgtctttttttgggaaccaacatcattatgcccagtaaaactaaaggaacacaacaacaacaacaacaacaaataccaaaaatccatgtttttaagaaagagtctaaaagtagagagaccatgaagtgatctgtcaaagcactccttcccctacacatgcactgcgagtaaaaccccaaagaacgtcaggaaaagagcaataaggaaactgacatcttagagtggcggaatctgataatgcaccacatcccatacctcttaagtgtacacactgaactggcaaagacagacacattatcttcattcccccccgccttacttactacactctggcttccatttttcccaagttcttcctctgaaatcttgctcaaattatctaagtagtggtctgatattgtgtggcacaagtcttcaaacgaataatccttttcttgacagagttttatttcatccaagagttttgataattctccagtgacggtttcacctatgagaataattttttcagaagtttcaagaaaggctattgttaaaacttaatgttaagcaataaaaatatgactgctatggtgatagaactcaaaatataacaagattaagcagtcagacactattctgctgaaaacaaggtactcaaccataattagtacaacaatattaatgggcaaaagagattataattttgcctatttttattctttttcaaaatagaaataattattgtaaggttatgtatacatagtacataaaagcatctggaattacaattcccaaagcttcacttattataggatttaatttccataatatttcattggtattttacttcactgacagaattcattagcaaatttgaaacggtgctgagaaacttcttcctaggttcaataaacagaaatagtacaagttatttaaacaaataataacataggtaatcagtaccttaagaattatggtatatgatataaagtaaaaacacaaaagaaacaaacaatatgcatcatctgtcaaacatgaagattttgtagattacatgaaaatatgcacatttctaaacagtctcagaaagataccttatacctgtaatttattctgaaaaaaatgcccagcagttacaatccagattttaatatttttattctgacataaaaacatatttaacatcagctgactatagatgcatggatttatttctggactttattctgttttattggtatatatgtctgttttcatgcctgtaccatactgttttgattactgtagctcttcacaaggtttccaagaacacaaaatgtggaaaagatagtctcttcaataaatagtgttgggaaagtggatagccacatgcaaaagcatgaaatatgacccttatctcatcccctatgtaaaaatcaatgcaaacagtataaagactggaacattaagacctgaaaatatgaaactcctaaaagaaaacatagggaaaaaacttgatatttgtttggacaatgatttcttggatatgaacaaaagcaaaaatgaacacgcaggattggatcaaactaagaagcttctgcactgcaaataaaacaatcaacacactaaaaagataacttaaggaatgggagaaaatatttgcaaaccatagatctggtaaggggttaatgtgcaaaatacataaggaattcacataactcaatagcaaaaacacaaataacctaattttaaaatgggctaaggactcgaatagacatttcttcaaaaaaggcacataaatgacccaaggtatatgaaaaggtgctcaatatcactaataatcaggcaaatgtaaatgaaagccacaatggggtatcatctcccatctattagaatggctattctcaaaaagacaaaagataggaggtgtttctgaggatgtggagaaagggaaccctgtatgctgtccatgggaatgtaaaatgttaaaggctctatggaaaacagtatggagattcctcaaaaaattaaaaatagaattaccatatgattcagtaatcccaccttggggtgcttattcacaggaaatgaaaccagtatcttggagagatatctgcacccttctgttcattgcaacattcttcagaacagccaagacatgaaaacaactgaagtatacactgtcagatggatggataaataaaatgcaatgtgtgtatacatttatatacacactacacaaacaatggactattattcagccttaaaaaaggagatcctgccatttgtaacaacatggatgaacctagaggatattatcctaagtgagatgaaccaggtacagaaagacaaatactgcatgatctcacatgtggaatctaaaaaagtcaaagtcataaaacagagagtagaatggtgaatgccaggggctggggagtggaggagatgggaaagtgttgatcaaagggtacaaaggttcagttatgggggattaataaattctggagatttaaaatacagcatggtgactatagttaataatattctattgtatacctgaaacttgctaagagagttgatcttaagtgttctctccaaaataaaaaataaaaaatactatgtgagatgatggctatgttaattagcttgattttggcaattattccacaaagtatatatcaagttgcacactgtaaatatatacaatttttatttgccaagtatacctcaataaagctggggaaaaacacatttaagaaaaaaacacatttaagaaacatatactccagataaacttcattacagcagggatagttttctgctttgctcactactgtatctcagggctgagaagccctaatcagtaacaggagctcttataaatggatgaaatatagagtataggatataacctattagacttgaaattttcacaactgtacatacaagtctagtatagattccagggctttataattaggtactcacttttggtcttttgggaaggagactcaacaggagatgaaatgtgtgtttcttgtgttgcatcttcctgtacaggctcttcgaggactgtagatcttcccacgccttctaaatactctgtgtgtatacatttttgagattacatacttgaattcatttattttaaaatcaataaattttaagttttacttctggtaatcagtttttcatttattttttcatatcctaaatatatcctaagttttcaaaagaacttcaaaaaaccaaacatatcaaaagaacgccatgatgagctatttaattaaagttgtaattaaaaaaagacactggattatttgggagaaactcttgaacccctttcttctaaaacctaaacttaaaacattctttccttaaaaataaattcacctattgaagatacaataaactccttggtctccttattttccatctgaagattttaaactgtctgaaagatgctttgaatagatttaatccccaaaacaggaatgtcaaattcagatggataccacaaccagccaggtaacataaacgaatgaaatggaataagttcatttcaaaatggtgctgtaatcttgtaacataagcataatttgcatattaactttatttccacaaagaaataatgttcattgccattattcttgaagtaatgtcctatactcagcctatttttcatttttctagttttgatacagatataatattaggaatagcagcttaaacttaaatattgcttactatggacccagcattgttctaagtgttttgtataaattaactcatgtaatccttacaaaactatgacacatgcactaaattttaaagattacaagtaaaggaggagtattattaacttgtccatgttcattcagctaataggtggcaaagccaaataaatataagacaagaaaacatctcacttttctcttaaccataaagaaaacagcatctgaatgtagaaataaatgttaaccaatattcagcctcacagaccatgttgaaccagagaacaaatgaccaatctaaagttcatccctgaaataaaacttcttttagagaaaccaaaactccagagtttgagctaaaatcctagggttttttttgtttctttttggttgtttgtttgtttgagatggattctcgctctgtcgcccaggctggagtgcagtggtgcaatcttgactcactgcaacctccgcctcccaggttcaaataattctcctgcctcagccccccaagctagctgagactacagatatgtgccaccacacccggctcatttttttttgtatttttagtagagacagggtttcaccatgttcgccaggctggtctggaactcctgaccttgtaatccgcccacctcggcctcccaaagtgctgggattacaagcgtgagccaccgcaccctgccaaattctagatttttaaatgttaacagctaattcaatttttatggaaacacaatgtgggctcaaaatatgtgatatatacaaagcatgtgtgctatctgccaaagcgttcagcccacaagtggctagtttgtagcctctgtataaagattaaatgaacagatcccttttcatacagagcatttgcttatacttctttattcaagaacctttttcttaaaatctaataaagaaaatttgtattctcatgccaaacaagtatgtcctcataccattcaaataatttctaccagggaaatccaggaatgcaaagaacagagatgacgtgttcacattctgaaatttgccagtaattagagaacttcaaagatgtactgtatgccctaccacaaattaacatacctaattaatcttgaccatttaggagagcaaagatagttactcccatgtaacaacatttcatcttatataaaccaatgcagtatgtttttaaaaagtccatggttatgtcacaccccattttctagtgggtgacatttattttgcttttcccaaaagacatattacacacatgcttcagttttgtttttttgtttgtttgtttgttttgtttggtttgtttgagacggagtctcgctctgttgctcaggctggagtgcagtggcgcgatctcggctcactgcaacctctgccttctgggttcacgccattctcctgcctcagcctcccaagtagctgggactacaggcgcccaccaccgcgcccggctaagtttttgtatttttagtagagacggggtttcaccgtgttagccgggatggtctagatctcctgacctcgtgatccacccacctcagcctcccaaagtgctgggattacaggcatgagccatcgcgcctggcccatgcttcagtttttaaaagttcagtgagaggcagccgggcacggtagctcacgcctgtaatcccagcattttgggaggccaaggcgggtggcccacaaagtcaggagatcaagaccatcctggctaacatcgtgaaactccgtctctactaaaaataccaaagaaattagctgggcatggtggcgggtgcctgtagtcccagctactcgggaggctgaggcaggagaatggtgtgaaccggggaggcagagcttgcagtgagcccagagggcgccactgcactccagcctgggtgacagagtgagactccctctcaaaaagaaaaaaaaagttcagtgagaggctgggcgctgtggctcatgcgtgtaatcccagcactttaagaggccaaggtggctggatcacctgcgttcaggagttggagaccagactggccaacatggtaaaaccccctctctactaaaaatacaaaaagtagccagacatggcggcaagtgcctataatcccagctacttgggagactgaggcaggagaatcacttgaacccgggaggcggaggctgcagtgagccaagattgcaccactgcactccagcctaggcaataagagcaaaactctttctcaaaaaaaaaaaaaaaaaaaaattcagtgagagtcaaaagtccaacatgaaatacaaagtgcatagagggagaagactaataaaaaatagtatgtgccactcttattttttagcttttattcaatttaattttaattttaatttatataaaaggctatgatgggatttttctctgattcatctctgcatgcatttgacttgtaattaacttctttattgataagaaaattgtaggggcatgaacttccctgaaatattttggaaatagagaagagagcataatggccacatatagtgcatctattccttttactcctccttggcctttgttgactattgtatctacatgttccctgcctgacttggttttaattcatttatctccctgcaaaacaatgctgttcttcagcttcccaactgacacctaataaaacctatctcaccaccctcctctatcatacttgcagccaatccataacaagtgtaggagataatcactgctgaacagggtaggagctaaaggagagaaaaacatctggggtttttaagtaacatgctacatgtcaggcctaatcaccaaacaggaagagaaagcatttaagtctaattttgttataaaacttttagttcaagtggagaagtatgcaagctgcaaataacaaaagtcgtacctagacagttgtcaaactttcaatagagctaatgactgccactaacaacaaatgcacttaaatgacttttaccaaaaactaaggctggtaagactgagttattttataccattggattaggaaggaaataatctgtattcttttggctaaatacaatttttgttattattgataatctagcatttagatacaagctctgccacttaagatacatgaatttgaacaaatcaaatctctcagagcctcagtttcccttatgtgcaaaagtaaaataatatctgacttatgttacttcatagggtcatagaaaccaaagtagtagcaaatccctgaaaatgctgaaagtattattcaaatgtgaaataacacttaatcatcactactttatagccttattaacttccagctcataactacatatttactacataaatatgaattttaaaaatatttctattatcaaatgagtaaataaataccttaacttctttaaaatacttactgagtagttgaaaaacaaaaataaaacattaaaaggtattattatttagtttaaaagtctaccagaaaaaaataaaactagtaagtttgttcaaaagtaaacactaactcaaaatccaaaagaaaactgtaacagttttaatctcatcttaactttaaggcaaactcatccatcattcaatactgtttaccttgtaagagtgttgcaatctggagagatttctgagatggatgttctttcagaatgtccaagacagttctacctaagctatcctttatgttggcatcaattcctgaaagaaaaagaaaaactcactagatatacaccactgaagtatcctcaaaagatactatcactatctaactgctgtaatttcagacatatacagaccaagcattgaaagtgatttttaaaaaattaagttctacacacacacatacacacacacatgcgcacacacacacacactcacacaagattttagcaagaaagaaggcaggggcctgttgctaccaaagattaggaacattcttgatcatcaattaactcttaaagggcactgacccaatgtttaagattgtttttcaggaccctatgatatctttttttttttgagacggagtctcactctgttgcccaggctggagtgcagtggcgcgatctcggctcactgcaagctccgcttcccaggttcacgccattctcctgcctcagactcctgagtagctgggactacaggtgcccaccaccatgcccaactaatttttttttttttgtatttttagtagagacggggtttcactgtgttagcaaggatggtctcgatatcctgacctcgtgatctgcccaccttggcctcccaaagtgctgggattacaggcttgagccaccacgcccggctgaccctatggtatctttgggttataactatttaactcaacagcacactatcacactgaaaaatattattgatttagaatgtgaattcctaaagtataatggtcatgtgatttatattctctgtacaatatggtaaaaatatttagtaaattataatcatgtaccatgtaagtaacataagaacagtcttagaacacttgaatattcacaaagttgaaaaagcatgattattttgaattgttgtccacaaagaatttatccaaatacaaggtcaaatactctatgatatttatttatgcaagattgtatttgtcagtcacactaatcatccacctgacgagcaaacttactgaagtgtgtaactaaaacacctgttattattttagttgtggaaatatatattgtaagaaagaacttattttaacacagcaaatagctttcactgccctaaaaatattatgaattttccaaacacataattgcaaaaaaaaaaaaaaaagccagtttacaggatctggtcccaaatgttagttcattgtaagattattaaatacatgtttaaatttgcataggaatgtgtaaccagcacatattaatatttaggtggtttcctcaaatcatttgttatatcaccacactgcatgacaaagttaaatataaatgaaattttaactttgttaaattgtgtacaaatacaatcacaatacaacagtctgccaatgtttttcatttttttttacagaggaaaataaacacactatagtccataacatgaaaaattccatcagttgtttacaagcatgaatttgtacccatgccttttgatctttaaaacaaatctgaccttaattctagctctatttcatctcaatcagaatgcacatatgaaaataaataagccaactttattgttccttcaaagcactccctttaaaaggttccctttaaaataagtttctgtagcctactaacaatagctactcagttaatgaactaactagaaggacaatttaccttaaagagagggaactcaaatctctgtttaccgtagtccacaatataaaacacagaaaaactattatgttcttcaataaatcaagcaattgtgaaaatttctcaaggatcaattcctctctcttacagaaggcagaaatttcctttttcttttggtagttcatctctaaagtacttaagtgcataaaattgtaataacaaagaggtttgtacttaaaacatctattgcataaaagaagttgcacattgatatcaatgttatctaaatactgaaactcagttctacataatatgaatacatatctgcattttagagtaaaggcaagagggtgatttgtgaagaaaactgtgtcattttcctttgtctattcccaaaatagaaatgttatctgtcaggataagctccatgcagaatcacaatagttacctgtttctaacagaactcgtacaacatccacctttccaaacaaagctgcttcatgaagtgcactccccttttctgtctggaaaaaaaaaagtaagaaaaaagaaagcacggttgcatttggaatgcttacaggttgaaataaaatgctcacattttacatattcatacatatttgctgtaatctcagctctccctaacagaaaggtcatgtggaataaagaagagattctaaaagcaaaatccatcggcttggggattgtaaaatacctctgcttctaaatagaaatttgggccagatgcagctgaggcggatggatcacctgaggtcaggagttcgagaccagcctggccaacatggcaaaaccccgtctctactaaaatacaaaaattagccacaggtggtggtatgtgcctgtaatcccagctactcaggaagctgaggcaggagaatcgcttgaactcaggaagcagaggttgcagtgagccaagatcatgccactgcactccaacctgggtgacagagtgggactccatctcaaaaataaataaataaatagccatttgactttcttatgtgagtatttcaccttctcttagctttagctctccttaagtataaaataagagaagtaatgcccacctcacaaggcttttgtgactatgcaagaagctcatttaatcagcatgcatttattaaacaccaattataggccaagagtagctgatggatattctgaggtatggaaatatcatcctggccctcatatattcacattctatttgaagagacagatgtataaacacagatgctccttgacttccaatagggttacctcctgataaagccaccataaactgagtatcccttaaattgaaaatgcatttaggctgggcgcagtggctcatgcctgtaatcccagcactttgggagccaaggcaggtggattgcctaaggccaggagttcaggaccagtctgaccaacatggtgaaaccccatctctactaaaaatacaaaaaaattagccaggcgtggtggcatgcacctgtaatcccagctactcaggaggctgagacaggggaattgcttgaaccagaaaggtggaggttgcagtgagccgagatcgcaccactgcactccagcctgggtgacagagtgagaatccatcgcaaaaaaaaaaaaaaagaaaagaaaaagaaaagaaaatgcatttaaacacaggtaacctaccaccaaacatcatagcctagactagcctactttaaatatgctcagaacacttacattaacctagtgttgggcaaaatcatgtaacacaaagcctattttatgataaagcattgactatctcatatactgcatatcgctagcctgagaaaagatcaagattcaaaatttgaagcatatcaaaaatgcgacagtttcacaccattttaaagtcgagaaattgttaaattaaatcattgtaagttgggggctgtctgtaaatatttatgataaatgaaatctaaacaatttaatgtagccataaaaaagaataaaatcctgtcattcacagcaacatggatgagcctggagaatattatgttaagtgaaataagtcaggcacagaaagataaataccacatgttctcacatatgtgtgagctaaaaaagttggacccatagaagtagagagtaacattatggttatgagaggctgggcaggggagcagggagaggaggatagggagaggttggtgattgactgcgaaattacagctatataggaggaagaagttctagtattctttagtagggtgatgatagttaacaataattgattatatattttcaaatactggaagagaggattttttaatgttcccaacacaaataaatggcaaatgtttaaggtgatagatatgctaattaccctatcattatatactatatttcatgtatcaaaatatcactctgtacccctaaatatgtacaattatgacatgcaattaaaaataaaaataaatttaaaagccaaaaaaaatttaatgtggcttaagaaacccagatgatattttctccctgctttcctctccgtcccatcctttgcccatcacaaccctcttccaaacctcataccctatgctccaggcatactgaactttctttttttttttttttttttttgagacggagtctcgctctgtggcgcaggctggagtgcagtggcacgatctcagctcactgcaagctccgcctccagggttcacaccattcccctgtctcagcctcccgagaagctgggactacaggctcctgccaccacacccagctaatttttttgtatttttagtagagatggggtttcatcatgttagccaggatggtctcgatctcctgacctcatgatccacccgtcttggcctcccaaagtgctgggattacaggcgtgagccaccgcgcctggcccctgaacactttcataatcatttcatattgctttcttccacagggggtctccaaggctggtctctctgcctggcaggatctaactcctagcactcttaatctagccatctagatatacctaccactagttaattttcagcatgaataagaaccatgtggagaaactgtcttaaaaacatacttctgggccccatccccagagtttctgattcagtcgcctgagattaggccatagaatttccatttctaacaaattcccctgtgattctgtaggtctaaagagtatgctttaagaaccataaacatgtacgatatctcgaatcttagcttaaaataattgcatttataaagacatccctgacccctgaagtttagtgtttttcctggatgttccacatcaatctatattttccttatcacagcactcatataccacattataattttatgtaattgtctggttcccataataaactgtaagttcagcggaaatgtaggccacatctattttttcaccattgtatccccaatgcctagcaaagtactttgaaaatatagatgtttaggaatttttctgagggcaagaagtggagggagggaagaacacaggatgaaaaactaggacaatttgtgagtagtgcaggataagactgattctgccttcaggaagctcaaggaagattccaaagatgaagctttttgagctacacgaatgttagttgtctcttttttttttttttcattctttttcttcttctctcaagaatctaacaagtatcagtaggtcgtgtgtgtgtgtgtgtgtgtgtgtctgtgtgtctgtgtgtgttttcaattgaatagtgtcaaggtagcaattttgttgccctatactaaatgtgatctctaaagtgggattctaatctcaacctgaaatagaaatatcactataaaataacatacaatgtaaaaactcttttttttttctgtttttcttttttgagatggagtcttgctctctcgcccaggctggagtgctgtggcatgatctcagctcactgcaacctccgtctcccaggtgcaagcgattctcctgcctcagcttcccaagtagctgagattaaggcatgcgccaccacgcccagctaatttttgtatgtttagtagagaggggctttcaccatgttgaccaggctggtcttgaactcctgacctcaaatgatccgcccacgtcagcctcccaaagtgctgggatcacaggcatgagccactgcgcctggccaaaactctttaataaaagtctattatataattaacccaatctaaagtagataagtacattattaagcaggcttgaggaacactgaatatcaatgtgatctgactgtatcttcaagatggaatgactgaaatgcccttgaattataatctgactggcatgatatgtagatactgaaaaaaatggaaacaaaaaaataatttgtaaatatacagcacagttttgaaggaaatgagaaactggaaactgattcggctcttaagaaaatatttcaatgtggggcatgaacattttattttttcccttccttaaaaatattccttgaaataatctaattttgctcattctcatgctgtttttcaaccagatttctgattactaatttgattcccttacacttttcacaaaattttggacttgatttcagataaatccttcctgatatagcatacttcagttcattctgaaaacaaaccaaagaatattttaattcaggattgcgaggggaaagaaatagaattccccacagccttagggaaaggcgaggacagaaagtatgaaccccagggggttagctttggaacaggtatttgttccagggagtctgtcaaccaatgctagactagtgcctggactttaaccagccactcaaggtacgagtggcagtggggcagaagacagtctgaagtctaagcaagctgaaagtttaaatgagggacccctacaaaactctaaaacttctaaagaacatcctcagtgaaaattaaaacaacaacaacaacacattgcacagaaggggaaaggatgtctaactaggtcttagttgtagatagagtgaaaaaagtaaatccccctaagaatgcctaaccacaattctacactcacatggtaagtttaaggcaaaattgtacaatctctatgaactccagatcctcatccaaaatgtagaataaagtggtcctgggtttctagtaatacaggcagatataaatgcttagaaaaaagcagatataaatcccctctgtaaaagtacactttcaactcaggcctccaaatattccagcagatgaagctctaagaaatacaaattcaaaattataaattactgaatgtgaaaggaagcatcccaccatgaacaaggattagtaaataaaaatacaaaagaataaaactcacaaaaatttcacatattgaaatggtcaggtatagaatataatacatatgtgataaataagatgaaagaactagaacaaaagaataattatcaaaattgaccagatgtgaaaatgaatcaaatagcattctagaaatagaaaatataatatttaaaatcaatggcttaataacatataaatagctattgaaggggtattaaactggatgatagatttttttaagtacataattgatagggtttggctatgtccccatccaaatctcatcttgaattttagttcccataatcttcatgtgtcatgggagagaccggctgggaggtaatttactcatgggggcaattaccctcatgctgttctcatgatagtgagttctcacaagatctaatggttttataaggagcttttcctcctttggctcggcacttcctcttgcctgccaccatgtaagatgtgactttgctcctccttcaccttccaccatgattgtgaagcctccccagccatgtgaaactataagtcaattaaacctctttcctttataaattacaacctcaggtatgtctttattaggagacatactaataggagacttaattaggagaacagactaatacaataatgcaataaaaagaataagagatgaaggacagagcaaaattgcagaatataagcctacatcatttgtcttccccactggaacaccgaatattaacaactatctgcacacagaagagcattgtcacaagaaccaaaaatcaagtgaacaatcacagtatctggttttaacttcctactgctgaaatagacactgaggagggtggaagagaaagtcttgaatcacgggcgctgcccctctcccattccatggcagtggccatgctgtgcagatagaaaatctgtgcattttaggaagggagaaagcagtgactgaggaactttacattgaactcagtgctgctttgccagagtggacaataaagctgtgtggggttccgccagtgcccacacattgaggggacatttgcaccagcccagccagaagggaatcacccatggaatgtgagtctctcaacaagcctcaccactgcactgcaggctgaagtgctctgggatcctcagtaaacttgaaaggcagtctaggacacaaggactgcaattcctaggcaaatcctagtgctaggctaggcttagagccagtagacaagattggcgcatgacctagggagacagcggcagatatggctaacgaagtgcctatgccattcctccaccaacctcaggcagtgcaagtgcaattcacaacaacaaaagtaacttttcccttctatttaaggagaggagagtgaagagtaaagaggactttgtcttgcatcttagatgtcagctcagccatagtaggacagggcactgggcagagttgtgaagccctaaatcctggacatttctagatgtaccttgggccaaaagggaacccactgccttgaaggaaagaacccagtcctggcaggattcatcacctgctgactaaagagctcttggagcctaaataagcagcagcaataactgggagtacaccatgggccttgttgtctgagaaatgctggcttcaagggtcatccagcacagtcccagctgtggtggctacggtgaacaacttcttctgtttgaaaacagcagagggaaaagtaaaggggcctttgccttgcacctaaggtaccacttcggccacagtaggaaaaaacaagcaggcacacggggtctctgcgttcaggcctaggctcttggacaacatttctgaatctgtcctggaccagaggggagcctactgccctatagggtgagtctgaggcctggcaggactcaccataagctgacaaaagagcccttgggctttaagtaaacattggcagtgacctagaagaaccctcgtggaccagaagtggtggtggccacagggagagtctcctctgcctgtggaaaagggaagaaagagtaagaaggactttgtaatgaagtgtgagtgccaatttagctgcagtaaattagaacatcaggtaaactgctaaggtttttgactctaatccttggcttccagacagctactctggacatgcccagggtctgggggaactcactgccctgaagattaggatacagtgctgagctggcttcaggtctgacccaacacaatcccagtggtggtttccgaaggggtgtttgcatcaccacacccccaggtacaggtggctcagcacagaaagacagactctgtttctttgagagaaaggagaaagaagagtctctgcctagtaatacatagaattcttccacatcttatccaagaccaccaaggcaatacctctatgagtctgcaaaaaccacagtgttagtgggtttggggcccaagtcccttcaaatgcctggaaagtcttcctaagaaggacagatacaaacaggtccagactgtgaagactacagtcaatatctaactcttcaatgcccaaacatcaagaccatccaagaaaacatgacctcaccgaatgaattacataaggcaccagggacaagtcctggaaaaaaaatagatatatgatctttcagacagagaattcaaaatagctgttttgaggaaactcaaagaaattcaagataacacagagaaggaattcagaattctatcagataaatttaacaaagagattgaaataattaaaaagaatcaagcaaaagttctagagttgaaaattgcaattgatgtaatgaagaatgcattagagtctcttaagagcagaattagtcaagaagaaaaaattaacgagcttgaagacaggtattcgaagacacactgagagtctacagccataccgccccaaacgcacccaatctcatctgaaaacacactgagaagacaaaataaaaaaagaataaaaagcaatgaaacctgctttcaagatctagacaacagtctcaagagggcaaatctaaaagttactggccttaaagaggaggttgagaaatagttaggggtagaaggtttattcaaagtgataatattggagaacttcccaaacccagagaaagatattaacattcaaagacaggaaggttatagagcaccaagcagatgtaacccaaagaaggctacttcaaggcatttaagaatcaaactcccaaaggtcaaagataaataaataatcctaaaagcagtaagagaaaataaacaaataacatacaatggagctccaatatatctggcagcagacttttcaatggaaatcttacaggtcaggagagagtggcatgacatatttaaagtgctgaaggaagaaaacttttaccctaaaatggtatatctggcaaaaatatccttcaagcatgaaagagaaataaagaccttcccatacgagcaaaatctgagggatttcatcaacaccaggcctgtcttgcaagaaatgctaaagggagttcttcaatctgaaagaaaaggaaattaataagcaataagaaatcatttgaaggtgcaaaactcactggtaatagcccacagaaaatccagaataaccctgtaattacggtgtgaaaactacttttatcttaagtagaaacactaaacaatgaaccaaaaaataatgactacaatgaattttcaagacacagagaatgaaataagacataaagagaaacaacaaaaagttaaaaagttaggtggcaaagttaaactgtatagtttttattagttttctttttgtgtgtttgtttgtttatgcaatcagtgtcatcatcagtttaaagtaatgggttataaggtagtatttgcaagcctcatggtagcttcaaataaaaaaacatacaatgggtacgcaaaaaaattaaaaagcatgaaattaaagcctactgccagagaaaatcaccttcactaaaaggaagacaggaagaaaggaaaaaaggaagagcagaccgccaaaaaaagagagcgagagaaaaaaataacaaaatgacaggagtaagtccttacttatcaacaataacattaaatgtatatggagtaaactctccaatcaaaagacatagagtggctgaatagataaaaaacaaaacccaatgatctgatgcctacaggaagcacatgttacctataacgatacacacagattaaaaataagtggatgaaaaaagtattccatgtcaacagaaaccaaaaaaccacaagagtagctatacttatattaggcaaaataggttttaagataaaaattgtaggaaaagacaaagaaggtcattatataatgacaaaggggtcaattcagcaagaggatattacaattgtaaatatatatgcaccaaacactggagtacccagatatataaagcaaatattattagtgctaaagggaaagatagacctaaatacaataatagctggagacttcaactccccactttcagcattggatagatcttccagacagaaaatcaacagataaacattggtcttaatctgcactttagaaaaaatggaacattttatctgatggctgcaaaatacatattcttctcctcagcacatggatcattctcaaggacagaccacatgttaggtcacaaaacaaatttttaaacattttttaaaaatgaaaaaatatcaagcatcatccctgaccacaatggaataaaactagaaatcaataacaagagaaattttggaaactatgcaaacagacaaaaattaaacaatatgctcctgaataagtgggtcaatgaagaaatcagaaagaaaatttaaaaattccttgaaataagttcatggaaacacagcataccaaaacctatgggacacagcaaaagcagtactaagaagaaactttatagccatcaatgcctacatcaaaaaggaagaaaaacttaaaataaataatctaatgatgcatcttaaagaatttaaaaagcaagagcaagctgaatgcaaaattaagagaagaaaagaaataataaggatcagagcagacataaatgaatttgaaatgattaaaaaaagacaacagatcaacaaaacaagaagttgttttgaaaagaaaaacacaattgacaaacctttagccagactaacacaagagagaagacccaaataaatgaaatcagaaatgaaaaaggagacattacaactaatatcacagaaattcaaaggatcatgagtggctgatatgaacaactacataccaataaatggaaaaatctagaagaaatggataaattcctacatacatacaatctactaaaattgaaccattaacaattccaaagcccaaacagacgaataacaagtaacaagatcgaagccataataaaaagtctcccagtaaagaaaagtgcaggaccgatgactttgctgatgaattctaccaaacatttaaaaaactaataccaatcctattcaaactgttctgaaaaataggggaagatggaatacttacaaacccattctacaaggccagtattaatctgatactataccccaagacacaccaaaaaaagaaaactataggccaatatctctgattactattgatgtaaaaatcctcaacaaaactccaacaaaccaaattcaacaacaaattaggatttatccctgtgatgcaaggatggttcaacatatgcaaatcaatcaatgtgataccctgtatcaacagaatgaaggacaaaaaacattatcattttgactaatgctgaaaacatatttgatgcagtccaacatcccttcctgttttaaaaaaaaatagtcaaaacacctcaatgtaataaaatccatatatgacagactcacgactagtatcatactgaatgggggaaaactgaaagcctttcctctaagacctggaatacaacaagaacacccactttcaccactgttactcaaaatagaactggaagtcctagctagagcaattaaacaagagaaagacataaagggcatccaaattggaaaggaagaagtcaaattatccttgtttgcagataatacaatcttatatttggaaaaacctaaagactccactgaaaaactattagaactgataaacaaatgtagcaacgttgcaggatacaaaatcaacatacaaaaatcagcagcatttctatatgccaacagtaaacaatgtgaaaaagaaaattttaaaaatcccatttacagtagccacacataaaactaaatacctaggaattaaccaaataaatgaaaaatctctacaatgaaaactgtaaaatactgatgaaagaaattgaagatgacatcaaaaatggaaagatattccatgctcatgaattggaagaatcaatattgttaaaatgtccatactaaccaaagcaatctacagattcaatgcaatacctatcaacataccaatgacatttttcacagaaatggaaaaccaatcccaaaatttatacagaatcaccaaatacccagaatagccaaagcaaacctgagcaaaaagaataaaactgaaggaataacattacctgacttcaaattatactacaaatcagaatggtactggcataaaatcagacacatagaccaatggaacaaaatagaaaacctagaaacaaatctacacacctacagtgaactcattttcgacaaaagagccaagaacatacactggtgaaaagacagtcttcaataaatggtgctggtaaaactaaatatccatatgcagaacaatgaaactagactcctatctctcacaatatacaaaaatcaaatcaaaatggattaaacatttgaatctaaggcttcaaactctgaaactgctaccaaaaaactttgagaaaaatctccaggatattggtctcggcaaagatttcttgagtaataccccacaagtacaaacaaccaaagcaaaaatggacaaatgggatcatatcaagttaaaaagcttctgcacagcaaaagaaacaatcaacaaagtgaagagacaacccacggaataggagaaaatatttgcaaactactcatctgacaagagattaataaccagaatatataaggaacaaaaaaactttacaggaaaacatctaataatacaattaaaatattggcaaaacatttgaatagacatttctcaaaagaagacacataaatggcaaacaggtatatgaaaaggtgttcagcatcattgatcatcggagaaatgcaaatcaaaactgcaaagaaatgtcacctcaccccagttaaaatggcttttatccaaatgttaagcaataacaaatgctggtgaggatgtgaaaacaagggaatcctatatactgtaggtgggaatgtgaattagtacaaccactatgaagaacagtttggaggttcctcaagaaactaaaaatagagctaccaaatgatccagcaatcccactgctggatatctaccccaaagaaaggaaatcagtattttgaagagatatttacaatctcatgtttgttgtggcactgttcacaatagccaagatttggaagcaacctaagtgtccatcaacagatgaaaggataaagaaaatgtggtacacacacacacacacacacacacacacacattttcttggagtactatacagccacaaaaaagaataagattctgtcatttgcaacaacatggatggaactggagatcattatattaagtgaaataagccaggctcagaaagacagacatcacatgttctcagttatttgtgagatctaaaaatcaaaacaattgaactcacagagataaagaagggtggttaccagaggctgggaagggtagtgggggcacaggggttagagggaggtggggatggttaaagcgtacaaaaaatagaaagaatgaataagacctagtatttgatagcacaacaggggcactataatcaataataattcaattgtacatttaaaaataaataattgtaacacaaaagataaatgcttgaggggatggatactcaattttccatgatgtgattattgtacattgcatacatgtaccaaaatatctcatgaacccataaatatatatacctactatgtatccacaaaaattttacatttaaaattttttaaatgactacagaaacaaataagcaaagaaggtaaaaaagaaataagagatggaaaatatgaaagatagaataaaataagaggattcaacatatgtctaatcaattttagaggaagaagatagaggtaaataatagtcagtggctaagaactttacataattgataagacactaagttccaggaccagcaagcaagataaatgaaaagaatacatcctggacatatcacagtaaaactacaaaactactaagataataactttaagacactctgagggaaaaaattgcctaaaaagaaataataattagatcaatagcggacttcacaacaaaaataaataataaagtcagaagaaagtataataccttcatgtgacaagagaaaaaaaatctatcaacctagcattctacattcagtcaaactaccttctaaaaatgagagtaaaataaaaacattttcagacagactaaaaatgagtggttacttacaactcttactgaaagaacttctataggatataattcagaaaaggaactgagatgcaagaagtaatgataaataaagagaatggttaatatgaggctaaatctaaacaaatatttaaaaatatgatagtgtctacttttggcactgatttggcttcacagatactttgataaaggatgatgcacactgtagacacggaaaaggtcccactttatacacagggaatatattccaagcaccccagtggatgtctaaaaccaaagatagtactgaacccgaatgccatcaatcagaattcatttctgttcatgtcttccatccacaaattcaaggccttttccatcttaactaagcacttaccgtgcactatagctgtaacttctgtagtttgaggtgcaacagcaaaactagtacaaatttctttttctttcttctcaacttcagatagaggattcattcttaccatagatcttagcaacctctgtgtacaagtttttcttttctttagtaagtcaagaactttcaccttttcacttagaggaagcactttacagcttctctttggaatatgcaaattgtcagcatcactgctcttgtgctttggggccattattaagtaaaatatgggtgacttgaacccaagcagtgcaataccagaacagtcgatctgataatcaagagggctaccaataggcaagtagtgtctacagcacagagatgctggacaaagggatgattcatgtcccaggcaggacaaagtatgatggtgagagttttcatcatgctactcagaatggcatggaatttaaaacttataagttgtttatttctataattttccttttaatgttttcagaccatggttgactgcaggtatctgaaacagcagaaaactaaacatcagataaaggttgggtgggcggcaggggtagggggaactattatattctagacaatgaaaatacataatctccaccataaataaacaaatctctttctggaaaaagcagatggagcaaacctgggttccagtggcagcttggcttttagtatctctgaaaattcatatatcctatgagaaacatattaaaaacctaacagatacatccatgttgtgtgggaaaaattaaaaataaaatacaaattttaaaaacctaatatggttattgggaaggttaaataagataaacatacaacaaataagattttttaagtgttttattaaactataaagtaatgacaagtattatcaataatatttctattaaaaaagcaattagaaaacctattttaaaagtaacctcaattatgttaatattaattacatacatgtatatcctttacattattccaagataaaaatgctatgttaagtagaactaatgttttcatacaataagaagacacagaattcttcaataaaaacagaaaaggttagtagatgataaacatatttttagcctgtaaaaatgaatctgtttttacaaattcaaggttgctgtaattagcttctttggtaagagaacatgagaactgtcaaatggaatggattggtctcataattctaaggtaaacaatggtaccaagaactatttactgctatcacaatgttgtcacatagtgtacagaatgtaaatatgtcaaacccatggacttttcaaaatatagattaattttgtaataatttccttcttttcatcagagattagaaaaatttaagaatattttgccaaggtgtaaagtaagatttaaaaaaaaatcaagtgccttgtggcttatcacaccctagacagagtccgtgtctaattgtctaatattctcactcaaatgagcactattctgtacatctcagcattctgccccaaatctacaacccataaccggccagaccttgaaaaattctattcttgtgaaatatttagtccaaaacattttacaagaaagtaggaagtctacaaagaaacaacactgaacaaggtgaacccaaaggctcccatccctggagatttcagtcctgcttttcttatggatcaaaattctccattttatttaaattaatcatttaaaaaaaacaaaatttccaaaatcgataatcatgcagtttataacacagtgacatttcaaaacttatccagtaaccacacataaagcactcataacatctcagcaccttttaggggaaaaaaaaaagacaaacctctgaacacagtgatgaaaacagctgagcgaaaagtactgaaatgatatatatgttaacatcaataactgaattgttgatgaaagcaaaagaaattctctcattgattggaaatgcctgttaaagtcaagccttggtagcaccaaagctgagaaaaacaagataagtcgcaagcaaaagggagagaagatgacgttcatgtttacagccctgggtttcagcttcccttctttttggcgttatatatttctgtgacttccatggaagctcagttgtgcatttaaagggatgtttgttatattttatccaaaatttctagatgttttaaagtcgtttttaggttatctattctaccagagtgccaaaacagcagatggaaaagggatgcaaagatgtcagagcttagctgcactggtttccccttccaaatttagcactccaaccataattatcctgaagcctgcgaaagagaataatgagataaagaccgattcttgattaaaggagaaaataaagataacaattatgataagcaataatgattgtggtgacgatcagcagagaaaatagcacagatagcataaaactgtgagaagcaagacccacaactattgtaacaactggtaaataaagataaccttactggagatgaagaaaaaacaactagaatggcatttaactcagaaataaaattccctagtaccctgtttggtacttagccacgtgggcacctcttggaattaaaaaaaaaaaaaaaaaaaacaaaagataacaactcaacttagtgtttgacaacaaacatatgatgtctgaacaagttggaaggcagcagctcttttgcattatctagaccatatctagaggagtatgttcaattgtgggtatctaacttttaggaccaatgacagaatacaatgtgtccagagaagagagtgccaaagaataaaggacctagaaaaacatcgtgtgaagaataaaggttataagaatgtttaaactgggaggaaaatggcacaagagaaatatgacatgtcttcaaataattcagaataccattgttgctattcaaaagaagaaatctccctctattaaactagggacttcaagtcttggtctttactcattctctcttccttcacttcatatcaaaggaagcacccttcttttcattaacattatttctccacttgtgctctttattctatcactttctgctgcttcttgaattttgatcatctctgcctcttgcatcttcaaggcaatctttctccataaacatacacacctttccactatttaaaaacaaaacaaacaaccaaagaaacttcctgtgaacctgctttcacttcaagcttctatccgctatcttacttttctttattccacgctttatgaaaagtcatcttccctcttttaggcacaatttttgcctagttttgttactgctatatcctctggcacatagtaggcactcaataaatatatgataaatgaattgattacatgaaattgtgctgtcttggcattcctcttttaactgcttctttacagacctttttccagaaactccctgaatattctttaatcagcctcttctgtctccctacattctgtttcttgtaagcccttctatctcatggcttcatctcttactcctctgaggctagcctcttagaaagttagcctcatttaaggagcacatccaaagagagacctctctgacccttccgtctcaatcacagcacccagtttgtttccattatagcactcactgcaatttatcatttttatgttgtttatgtgcttattttctgtcatccctactagtctataactccatgggagcaggaaacaaattttcttcctcctggagcatagtgcctggtagcatggcatgagaagtcaggaggggctagggtatcctcatagggaagccagggttcagttaaaagtgaaagaaagggagttgcttgggtagtgagtaaggtaagtaaaggaaggcctcactattaaggtgacattggagaagacacctgaggaaagaagggggaagaaagtcatgagggttagtaaggcagaggcctggaggtaggagtgtacataatgtgttccaacaagaacaacaaggtcactgtggatgaagctaagtgaagaagggcaaagaagagtaggtggtagctttagagagacagtgaaactaagtaatataaaaccctatcagacactataaggactctggcttttcctctgagtgaaatggaaaaccaatagaagtgtttttgagtaggaaaatgaaattacctgactgaatgggatcacttctggctgtttgactgaaaatagactgaagggaatatgttatggattgaatatctgtgtgccccaaaactcacatgctaaggccctaacctccagtgtgactgtatttggatatatggcctttctggaagtagttaaggttaaattgggtcataagggtgtggccctaatccaatggaactggtgtccttataagggaaagaggaaacatcagggaactctctctccattcacgcacagaagaaaggccgtgtgaggatataacaagaaggcagccatctaacaagccaggaagaaagccctcactcaggaatggaattggccggaacttgatcttggactttgtagcctccagaattgtgagaaaataaatttctgttgcttaagccactcagcctataatattttgctgtggcaacctaagcagacaatacagaagccaaaaaaaaaaaaaaaaaaaacggaggaaaactagtcaggaagcaagagatgattaggtcttggactatggtgttaatcttgaagataatgtaaagtagtgaaattctggatacaatttgagcacagaaccaataggatttgctgaagaactgaatgtaaaatctgaaagaaaccgtaaaattctgggccaaacaactagaaggatggcactgccttttgacaaaatgggaaagacttggtgatatgcaaatttttgaagaaaggggtacagatgctagattttcagctttggaaatgctgagtttgagaagcctattagtcatctgatagatatgtccagtagggaattacatacacaaatttagagttagggtggagtctgagatgaagaaatagacttggtaattgtcagataaagatgatattggaactcaagagattggatgaggtcaatgaggaagtaggtatagacagagatgaaaagatgtttgagtactaagccctgggacactccgatgcttagagatcaagaagatgagggcagttaactatggaatagggacacgatagattacattattggcctctccttttatatgctctttgccgtatgactttgtacttctttccacttatatgagttgagtatatttctcttcctctttatttgaggcttggttttgtgacctgatttagccaatggatggtaaccaacatgatgcaagcagaggcccaaactgtgcttgcatgattgagctttctctcttatgcacaatcaatgcccccctgcctagtcccaggaggaagataatagacacgtgcagcagagattcccaggctaacttacagcatcaaacatacttcccccagcttcttcaagaagtcaccagtgaactaaatgaaaaccaaaagacagtcgtatctcagaggtcaaaagaaaacggtggttcaaagaagagacagatactgactttgtcagtgctgatgatgaatcaagtaagaggagaagcaggaattgactgttggatctaaaagtatgtcagtcattagacaacttgacaaaggcaaaaacaaggacttttaaaagtgagggagttagagtggcctcaagagagaatggaggaaagaaattggatacaatgagtaaaaacaagcttttctaactacgttgctacaaaggggtcagagaaaggggatggtaaggagaaggaaatgtgagatcaagagagtttttaaaagatgagaaatattacatctttgcatccttatggaaatggtacagttgagaaagaaaaaacgtatggtattaaagacagaaaatatttgtcagagttcccacgtggacaagaaaggataggatccaatgaacaagtagagaggaattagccttagatacaaacctaaaaggttcatttaaagcaccaggaaggaaagtagacacaggtacattggcagatgtggtggtggaaatttgtgattgcttgtggtttcctcagtgaaataaaagcagtatcatgatcagagagggatgatagagaaggaggtgttgaagttttggaatagagatgtcgtgaaattatcatctagggaaatcagagagtaaatggattataatggataattatcgcctatgtacatatcttatttctggtgccactataagcctttgagagcaaaagctgtatcttacttagttttgcatcttaacagctcttagcatggaaacttgtactttttattattaactttctgtaattttactttcatttcctttaatagtcacataaagtctaattggcttaaggttgtactagttctttaactcttcaagtcttatgagagaaacttataagaaactcacacaatgaaagcactagcatgatatggcactatcgctatctggttacccaaaatcaagttcaaaattcataaaaataattgctaacttcaagagaaaactgcccattcaaccctactttcttaatatcttactttgactgattctctttattaaaaaaatatttaaagactaaagggtttataagtaaagatgatatgaaatttgcccaaagtattacttactattttaaatatgtgttataatttaaaattactcagagagtaatgatgcagaaaataaacttctagagcaaatattaacatcaatgctgcatttaaaaacatatgtaggtcaggtgcagtggttcaaatttgtaatcccagcactttggaaggccaagaaaggaggatcacttgagcccaggagttcgagaccaacctgggcaacatagtgagaccttttctctacaaaaactaaaaaaattagccgagcacatcagcacatgcctatagtcccacctactcaggaggctgaagcaggaggatcacttgagcttgggagttctaggccgaagtgagcatgattgcaccactgccctccagcctgggtggcagaataagaccctgcctttaaaaaaaaaaaaaaagtaaaataaaataaaatcacatgtaactactaggaaaagacaagatcctcaaaagccatctataagttttaaagatttattcataataacttgaatgtaattgaagtctaaaagtacaatactataatttaccaaatgggattacttttaatactaattcccaacaggttagctagagcagtttaatgaatattaaatctactgaaacaatttgaggctactagctacattgttcactctcagccagtgagaatatcaacaaacctacttgatattcaaaaattttgcactgagtctgatgggaaaaacttggtaacaattaatttgagtaataaaattaaatattcacccccccccaaaaaaaaaggcaatgagaccaaaaaaaaaaccaacatattttctatgaacaaagcaacaataacaaaagcaaaatatcaactaaggctaaatatattatggaagattcatttcattgagatatattttagaaagatgttgtcagttctacttcctagaattcttagaatgagtgtcaatagaagaggttatagcaacacagaagttgtccaccttactcagacatcaccccgatacttctgattaggtgttcaaagtgatctaagcatattgtctgcctttcttctgatatgtgaagaacaaatctaaatgtggtgaggaccaagcagacaatctaaaggaatgacaatggcaatgatataaaatggtagaatgaggtcggagccttggaaagcatttaccccatctaaaagcactcaaattcaatattttaaaatactctttagccaaataatgcacatatgcaagctaaaggccacctaaaattcaaagtcgtgttggactttcaaaggtccccttcaaatgtcacttccatcaatgacttctcatgttctccctcttaaaatccatattttcctcacccgtagatccacagctctttgttttagcatttattatatgtcatggatgggagttattcttgcaaattttttgtctcctccactaagcgtggggcagagatagttttggttttttattctccaaaagcacaaaatacagtgttttgcagaaaaaaaggacacatcatatacatttataaaattgaatttaaactctttcccttctggtcatgtcatctagtacaaaacatgaaaggatcttggtcagggataccaagaagcttactgacctcagtcagaggggaagtccttggttatattgcagtctgtgcaatcaagtttaaaaatattacagaagtgtgaaagcagtacatccagattagagaaattcaacatttatacaataaacatctagtttatcattaaacaacttttaggaaaataactttgtgagtcacctacaatagtaagcatacctacttattttcaatacccctttgaggagagagactgtttttccttaatatgactgttagaaaaaattcttatgcttttttgagaggctgccaaagttgaataaataagaaattgagaaaagatattacaaatatctaaactactaaataatgcaggcaaagctctaaagcaagctctggttcagggtgctagccttaaaactgagattggaaggcctgagatttttctaaattcaataaagaaaactctggaaatacaggattcaatctctgaacaattcctaggaaatataaccccatctgtgagcacgcattccacctggagtgtgtaattatttgcaacatttgccacatttagtccctctgggtattcacacccttttacaattcacgccctcttctaatacagaggtagactctattttccaactccttgaatatgggttgcctttatgacttgcttcagccaagcaaacatggcagaagtgaaggtgtactagttccaagcctaggcctcaagaagccttgtacaattctgttctctctctcagaaccatgcatgccatgtgagtaagcccaggctgacctgctgaatcatgacagagaagtggcagtctcacctatcaccctagacaacatccagccagcctctgaaacagaaacacataactgatttgcagttgatttcacacacaagagaacacagccaagaccagaagaaccatcagttgagcttagactaaattgccaatcacagaattatgagctaaataaagagttattgtgttaagctattaagttttgggatagtttgttgcacatcaatggcttactaataaggggagaaggtcacaatatgacagaaagcaaaaaagtctctggaagataagaatgctgccattaacttggaagccaagaaataaccatgaaaggaggaaaaggcaaaaaaaaaaaaaaaaaaaaaaaaagactaaccctggagttggggctaacttaagacaagatatcaaaagtaggctgtggccaggcccagtagcccacacctataatcccagaacttggggatgccaaggtggaaggattgcttgagcccaggagttcaagactagcctgagcaacagagcaagacctcatctctacaaaaaatacaaaacttagctgggtatggtggtgtgtacctgcggtcccaccagctactggagaggctgaggcaggaggatcacttgagcccaggaggtggaggctgcagtgagctgagatcacgccacccaccactgcactctagcctgggcaacagagcaagactctgtctgaaaataataataataataaaatatactaaattaaattaaactttttaaagtaggttgaccattccttgtggagaaacaaaacctatccaaatcctattcttcctacaaagctcacctcaaatcacaccttttccatttttttttttctgagtgtccttaggcatagtgatcattccttcattagttatgtataaacagtacattacggtggaaagaggcctggactttaatcagtaagtctaaattcacatcccggttttatcaactatgtgtccttagacaaatttcttaaatctttgaatctgattcctcatctcttaactgaaatttaatagttctcaatcccaaaggacagttgtgagaattgaattctaaatgtgtcaacatgctaaacacaaagtacatactcaacaatgttaaagtgaattttgttccattcattcattaaactctgactggattcctactgtatgttaggctgtgtgctagatattgggacaaaggaaacaattactaatgataccacacacaactgccatctactaacttctcatgtgtatagccctcaaattagaatgaggttagagattatgccttgtagctcttcatatttcccaaaagtaggtggcatagtaccttgaactcagtagttacaaaagtacttgtgaacaatttgattaaaagatttctacatacaggttttcacatttgaatcccaaagccaagcaacagcatcatcacttttaaagcatagctaaaagcacactcacttgacagctcacatccattcctgcctccagcagcacctgcacgactgctttgtggccattgcgcgcagcaaggtgaagtggcgtgtgcttgcgagtgttgcagctcattaagttaggatgtgcactgatgatcatttttaccactctaagccgtccgtagagtgccgccaagtccaaaggtgtttccagcttgctatttctaattgtcgggtcagtgagctcttctaggagaacagcaactacttctgagtgtccatattgagctgcacagtgtagggcagtttcattttcattgttctaagacaaagatttttaaaaaggcacattttcagaaattcaatttgttatcaaaatcttaacacagtaatttaaaacctgcaatgctttgaaatgtaagttaagatttatccattttaacaagtatgcctaatggaattttatatttgataaaagtatctaggattcattgaatcaaaaaaaaattttttatatcactttaatcgaaaacaatccaacatttccctaaatcatatatgccaacttccaaaaatgacaaatgatttagccatgtttgtcagaggccctcctgggtccagaaggacagtgatatctgcatggtgcatcacatctttagacatttattaataagagagatcaaaacaattataacagacttttaatagactggctttccaaaagacagataagaaggtaaattcttggtaacaaaaggtttatagaaaggtttcccaaattaagtttcattttattttccatgtaagtacaaatcattgcttcctttgcaaagaaaatgaaaagattttggccttaagatataaaagtacctttttgaaatgttatcatgggttgtgaggatggacctagatcagttcccagacaagttactaggagtatcacagtacaacatgtgcagcttataagggttcagttgaaaatcaatgagattttcctagaaatgtatcaagatttttaaaaatgttaagatacagaaaactgaacccagttgcaaggcagagggacccttcagactatttgagcaatataggtagatggtgtataggtatgtcaggaggtggaagggtcaggagaaaaatgaacaagaaattttagtaacaaaaatgcaataaccgtaaatgagggttctggaaagaaagagcagctgccaccatcagagttatcatcatagctaacactatgtactagacatagttgcattttatatatgtttactcatttaatcctcattatgagatagatactattatcattatctccattttacagatgagaaaactgaggcactgaatagttgaataactggccttccgttatacagccatttagtggtaggaccgggatttgaacacaagtagccaagacccaaagtgggtgttcttaaccatcacacataccaccttccaaaataggaactattactactactacttgttgagtgcctaaaaactatatatattgtctcatttaactcttacaacaattctccaaaatttatattaaaattgtctacttcatggacaagtaaactaaaatacaaaaaggttaaattacacatccaagtagaattaagatattttgcaagctggatctgacaaatccaaaacccatgctctttccactataccatgttgtctgccatgtgttgctatattgtcaaagaagagctgggaattagtgatctgaaagcagaatttctagaggttttgctcagaaaaataccaaccgagaatagggagtagctgtttagatagctgttctgatgaaaataaaaggataagaagtgttcagacccaaacaaatcttaatgttctagaaagtaactcaagtttgccctggatgatagaagaatgcaagtaagttgagagtctagagggaagatttgaaaatttaaaaaggagtagagtgacaaggggaaaacagcactaggaaaggcttcttactactttaccttgcaaataagtatcaagagagagcatttgaaggtcaaacccacagggaaaaatctactctttcaagacaatcaatgaaaagttaagacctgttagatggggaatccagctgagggtactgtttcttccatcatttgtcaggagtccttctttacttggtttgaaagtattactataatctacttcttcataaacaatgatcacatacaggtttagactccctggtcttcttatctgtttttcttatcaggcttataaaacagccaatcttattacttcacaccatgaaaacattatacagatatatacctcctgaccaacccaaatttccccctggtctgaaagggattcaatctcagttttcaaaatacagtatctctttgagaaaagagaaaggccagttatgaaataatgattcctcaaaggcctctctactggtccagagccctgagcctaggaaattacaagagcaaaatcgaaaaattttctagtaacaccaattagcactgttcagatctcaagggaaaatatatcaatcattcaagacctactcaggataaaaagttcacagattttatccatgatcatcacatacttggatcgtcacctcagtggacgccacaacggtggtacttttacgagagcatgattgtgtatttgtgtatgctcacaagtgatctaaaataatctaatttgaaataaataggctgtgatgaggcactgattaataattcctagtatggctatgcagaatattcttaaaagttttttaattccttcttttttaccaaatgggtattctctgaaacattaggacccttccagataatggatgatagaacaaaactggctaacaaaagccatttaccaaaaactcttggttcagagtaaaacatctaacaagagttggattcgagtttcggtgaatggcaaaggcaatgtgtttttcagataaggcccctctgggttttgccctaatgttaaaataaagaaaaaaaaaaagaggaagagaaggtaaagggaagaaaggattaatgaaatttaaagaaattgaaaattttcaatttaaaggaaatttaaattgcaaaaaggaaataatcagatgataaaagagaaggatgtggcaattataaaaaccataatccgggtagagtccactttgtttagaatggtgaacaagacctaggttgaagtgttaccatgtaaattacttcatctctccaaacctatcttatctgtataatgagaatattattttccctataaaccttataatatagtttataaaccaaaagagataacatatttttaaaatgcattgtaaactttaaatattaaaatgtagaatagaattatttttaaagaaagctgtattagaaaccaaagataactttcagaaatcagaatgaagccctgactataatgcataattttaacataacataaatgtattactggttgagagcttaggctttggatcagaaaaacctgcgttcaaacactggctgcatttcttagtagctgtgatgttacggtcaatctactctatctctctaaggctgtaactccatatatatagtagcaacagtaatctagggcttagtaagataacggggatgaagtattttgcacaatgcctggcacacagtaaacaatccattaagtgataggatttaggatgacaataccaatgcgctgttgtgtaaaaggctctggagtcaaagtcctgagtctcagtctcagtttcagtcactcagtaacacgtggccttcgacaagttgtttagttttacagagcatgatttctcaactataaaatgcgagtgatattatcaattcagaggattattgtgagaattcattaaatcgtatttttgaggtgaaagtgtttagaacagtgcccgctttaccttatgtctcaataaatgctaattaccatttttatttcctttattgtttaaatacataaaagtttataattaacaagaagattctgtcctattcagaaggaaaaaagaaagctaaaattaaaagttatctataaaaataaaaatcctacatcaaaaaatttaggagaaatggcatagaatgggaaaactatgatcagcatcaaaagagtatacatataacaatgaaaaaatactaaaattatggtattaaaaatcgtaagaaagttgcaacttcttgccaatagaaaccgcaacacaaagcaacagaggtgaacaaaggactttgaatatggtctccttaaaaagacactttttgtaatttaattgatctattcaacattaccaaaaacaagtatttctctttaaaacatatagcaacttttcactttcaaatgtaagtgaatactatatgttatttcttattttcatgtcatttaaaaacatcttgtttgtaaaaactaacatcctcttgtttaaccttggattgtttttccattttattatttcaggtttgctttgcagtattcagacaattttaagaataaccaccagatggctcatctcataaatgatctaactgttggttttctgtggaagagaagagcattgtcataaatttccttttagcatgatatgatgataaagatagccatatctgtcatgttttaaagactgggtgcattcttattaaaatttctgcatttttgtaacctgtaaacatggaaatttttattgtgataaatattaataagatacttttccaattaataaaatgttttcctgattagtcctttcaacaactgcatatatattttcattgaaaaaatatgtatttttcttccctttgctatttacagcaattgttactttttatccttcagtctgaatttcaaagtccggcaaagtctgcatccatttgaacaatatgctaattgtgctttattagatatgcttgccctaaagtaacctacttgcattgatattggacaactgccaacctgcagcttaatgccgtgattgtaattcaattgttggactgtctgctggttttcaaatatagttttacaaaatgggaacagtagggggcatgcagagatcaacatgtttgttatcatactgtattaggggaccatattttactttctagaatctgtggtcctatctgtttagaatactgacactggttttctttttaaaatatgtccattatgtgtaatatagatattgtgtacttacaaatacattaactgtcagaatcatactgctgctgtgttttattcaacttattctgggcatatgtgtttgtgtttgtatatatatatatcaaaaaattttaacttaatatgtgacaagcaactgtatatgctatatttcacattttgattcacaagagtacttaaccatgaaagtgctaagtaaatggtaaagcattatgcaaatgataggcatatcattgttttagcattcaaaattgtattaagaaacattgtaattctcattacacatatgaattctgttctatctttaaatattcaatggctataaaatggctgattatataagacaggcaaaaatatttcagctacttcctttatgtaggattttcccattaacaaagtatctttacaaatgcccaacttagtccctgcatatcatatccaaacaccaaagaatttttcaaatttctccttttaggaaattcagcaatggaaaggcctttgggcaaggtaaagataaaaaaatcacattttcaatatggctttgccttgtaaaactagaaaaattacatcatgagcaaacatttggcaagtgcacctgttcattgaccctggaatgtgatggtccatgatgaataagaatcttcacaatttccacatctcctttccaggcagccaggtgaataggaaaataccctttgttgtctgctacatttgttgatgcctcatactgaagtagtttgagaactatgtccctaaaaaggaaaaaacaacaacaacaaaataggctgagcaagacaaactgtattaaataggtaattttaaaagaatactagatgctgggtgggaatttagagtaatcattcaaggtactaagatataaagttgggtttcaaagtttttgcctactcaacatttggctattttacttacctggaaaaccatcaccccatgccacacacacacacacacacacacacacacacacacacacacacacacagagagagagagagagagaaagagagcgagagcacacattgactaaccaattaaactacttaatagaattcatataagcaaaacttaacttatttcattaattagatgagctaagtaaaatgaagaggataccaactcccatttttttttttaaaaaaagagctctttccagatagcccatatctgagatttagtttgaaggaaaagttgaagttacaagtatattccttgtttacacacacacaaaaagttatcataataccaaggaggcatttataaaatttacacatcattcctacagataattggaataagagatttaaggggtatgtaaaagagaaagaaagtgcagtatgtaagggacccttgacaagctaactgtagtactagcccagggttaaaaaataataataaaaaaattttaataacttctcagtgatggcacacaacacactttgagtattccttgttcctacttctgtattccttcacctttcttctccaagcataaaaaattatttcaaaagggaaactcatttaaaagacaagttccaccattaatgcaatttcaacacatattcaatatatcctacctcaaaaattttgaacttaatccccaccaggttttcaaagtaaaaatcctgacctgcattactcaaccttagaaagaattaattaataattattagcataaattatatcaaaatatatgtcaacaatcaaaagcagtaattctaaacaaaactgtattttcatttggatgcatttaagaagcaaattctattaactcactaaatgaaatgctagtcagacacacataaataaaaatatatatataattacaatatataataaagttgtttcttacatacaacaaatcactaatggggagggtgaacataacagatttacatttaaacatttcataaaatcagactctagatgcaagtaacaaatgaaaacatttggaggaaattttaatagaaggaagattagaattttgatagctcacaagaaaaacagatatgatatgatacaaaattatggtaaatggtaaaacatactgtccagaatgtgtcctaaagtcacaacatttgacttaattgctaaatgtaagaaatcatgattttaaaaaaacaagaatatgttgtagaaatatttagaatccaaggagtcctaaattgtctaatgatataatttctgagaaattaagaattaaattttaacatttctctttgaaaaaccagcattattttacgaaatctgaatttagaagacttggatttgtgtcccagctatgcaaactacctgaggctgtgattccggagaaatgataatcacacaccacataatgataattcgatcaacaacagaccatccgcatatataatggttgttcaaaaagattatcatacctcatttttactgtaccttttctatgttttgatatgtttagatacataaatactttctgtatctattgtgttaaaattgcctacagtattcagtacagtaacatactgtgcaggcatgtaactcgggagcaacgggtcataccatgtagcctaggtgtgtgacaggctatatcacttagatttgtgtaagtgcactctatgatgttcacacaatgatgaaatcacgtaattagacatttctcagaatgtatccctgtcattaagaaacacatgactgtacttagtctcattttctttttcttcaggagatactataatgataatgtctactcaaaactggtaatagcattaaataagatcataaaaaagaattcactcaataaatagtaaagcactataccaataatagcacttgtcccaagtaaaaataaaatactttagaagtgaaatgaaatgcttatagaaagtcaccttcgaaaaacagaatcagaaaatcagaaggaaacttaaaggttatccagttcacacgcttctccccatttccctgccaagcaagggttgttatatagggtcttccattctgacataaataaatacataacttcagtgaggtaatgagaattcaatacctatgaataacaaaagcagataaggaaagatctgaagtcccaactctctactatttacaaacctggttaccttgaggaaattaagtaacctctgtctctctttcagatattgtgaaaatagaatttagagattacatcttggtgctagtttcaaacagttatggtgtgaatcaaatgagaaacagatgtaattgtaaaattatatatacaatcaaaagttgttctcaaggcagattgttgcaatgttaaacaattccagtgattgctttttaaataaaatatttcagcatttaaaaggcaaaataatagcaaaagaagttagtcaaattaaatacctggatctaaaatgtagaatttagcctactacaaaatagacttctccaagttactgtcaaagacaactgtgagaagagaaaaatttcatttcttaatacctaaggaaataaaaaatatattctgaaacaacttctcctataaagcatttcctttcaaggggtaaagacgaaaaaaagattgatgggatcatcaattctatttccttttactcttgctccaatcacttagaatttcatttgttctttggctcaaattttactgacattttctaataatgtaagtgatatacattcattcttcatttatcaggaagatttatgacaagtgaaaaaacgtctattttgaaaactgacttactaatcatttgtattttctagtattaccaccatctaatatctaaatcagaaaagaataatctgtaagtttgtaaaattgcctttggaaaacactaagatcctaactacacattatttacacattatttttaagttttgaaaaatgtatttattttaataaataaatattttgttaaatgtgcttatttttttcttttttaattttatttcaatagtttttgggacacaggtggtttttggttccatggatgggtaacactttagtggtaaattctgagattttagtgcactcatcatccaagtagtgcacaatgtttccagcgtgttgtgttttatccttcactcccctccaaacctccctccaccagtccccacagtccattatatcactctgtatgttttggcatccacatagcttagctcccacttagaagtgagaacgcatggtatttggttttccattccctagtcacttcacttagaataacggcttccagttccatccaagttgccacaaaagacattatttccttctttttatggctgagtagtattccatggtgtatatatataccacattttatttatccactcattggcacttaggttggttccatatccttgcaaatgcaaattgtgctactatacacatgtgtgcatgtgtctttttcatataatgacttcttttccttcgggtagatacccagtagtgggactgacggatctaatgatagatctgcttttagttctttaaggaatctccatactgttttctatagcagttgtgctaagttacagtcccaccagcagcgtaaaagtgttcccttttcaccacattcccaccaacttctattgttttctttttttactttttaattatggccattcttgcaggagtaaagtggtagctcattgtggttttaatttttatttccctgatgattagtgacgttgagcactgtttcacatgtttgttggctgtctgcatatcttcttttgagaaatgtctattcatcccctttgcctactttttgatgggattatttgttttttttcttgcttatttgtttaagttctttgtagattctggatactagccctaatttgcaaatattttctcccactctgtgggttgtctgtttactctgctgattatttcttttgctgtgcagaagctttttggtttaattaggtcccatttatttattttcgtttttgtttaaatgtgcttattttaaaattaaaattaaaattaaaatttattttcaaatttttgtttaaatcgagctttacatcttattcaaagataccagctaatgaattggttgagctcagatttctagtgttaaaacatatttgtgaaatataaagttgtatccctgatcaaataagtatctgtcagttttactaagttataagtagaataaagtgttaatcagcaaattatgattaatcattcttatgatatatccatatatatccaaagtaatatgaactaaataggccattttcatccaggctcattagaacaatttaaatttcatatataatatctaaattagaagagcagttaatatagtgtagtaccaacttagtatttttattgatacataatagttgtatatattttggggatgcatgtaatatttttatatatgcatacaatgtgtaatgactaaatcaggataattggggtatccattacctcaaaggtttatcttttttttgtgttgggaacatcacaattcctctcttctagctattttgaactatacaatattggtaactttagtcagtctactgtactatcaaacactagatcttattccttctaactgtatttttgtattttaatcaaatctcttctcccccccccctttccttcaaagcctcctataaataccaattaactttctacttccatgagatccccttttttttagctcccacatatgagtgagagcatgtgatgtctgtcttcctgtgcctggctcatttcactttacaaaatgatctcatgtccatccatgttgctgcaagtgacaggatttcattcttttttatggttgaataatattctattgtgtatatgtgccacatttactttatctgttcacttgttaataagtaggttgatcccatatcttagctattgggaatagtgctgcaataaactggggaatgcagatatcactttgataccctgatttcctttttttttttggatatgtacccagcaggggcattgtgaaatcatatagtaattctatttttagttttttaaggaacctccatacttgtcgtccattgtcattgtactaatttacattcccatcaatggtgtacctgcattccccttcctctgcatccttgccagtagctattatatttgtcttttcagtaaaaatcgttttaactgaggtgagatgatactgtgattttgatttgcatttccctgatgattagtgaggttaagcattttttcatatgcctgttggtcatttgtaagtcttctttcgagaaatgtctataatcgtttgcccatttttaatgaaattatttggttttttgctattgggttttttagttccttatatgttctggctattaatctgttgctagatagatagtctgcaaatatttttttcccattctgtcagttgttgaagctgggaaaactggataaccatattcagcagaatgaaactagacctctgtgtctcaacaaatacaaaaattcagtgaaaatggattaaatatttacatctaagacctaaaactatgaaactagtaggggaaaacacctcaggacattggtctggacaaataatatttgggtaagacctcaaaaacataggcaacaaatgcaaaaatagacaaatgggattacatcaagcttaaaagcttctacacagtatttctttaaatattatttaggttgagccttatagcttactttaaggtatccacaaaggaacacatcgcctgtgcttggtcaactggcatgaaatattcagtcattgattgatgagcatttgggttggttccacgattttgcagctgtgaattctgctgctataaacatgcgtgttcaagtacatttactaatgtaaccaaatatcacctggaccacaataacttattgaaaaattaatgttaaaaaattcattgggactgtgaaaaaagaaatattaagttacattgctaatcaatatctgtaaaatagcaagcagcaaaataatccctatgtcttaaatgtaaagtagcattttctgatatccagcatttgacaaataacaaatactctaaaatcctaaagcaaatgtggttgacaagaaaatagaaaaaatattttggaaaatggaaatagaaatggaaaaatactttccatttcccaaaaacaaagtaaaacatcaaattaaatttaataatatccaatgtaaatagctgcaatattttgcagctttaagctaatacatgtaagttcagttaaaaacaggaattctagaagtattgacttttgctgctatatttaattcacatccattttctgaaagatataaatacacatctgattaataaaaaatgtatttcggtaagttcagcatatgctctgagcaaaattaaataaattgggaagagtcaaccttcaaatttctttgcctcaacagcaagattccctgtaattaaatcacaaccaaagatgtttatttcataccatcctctcttgcttgttgattgagtccaaagaatttcaaaataaatgcaaatcatcttcatatggatgcagaattaacatctaatgaaactctcaaatttaataaggtccttttgatttcagattttcttgacacttttacttctctttaatgggaataaagttgcagatgtgttcaagatggtcaaaagatttcaggacaatacgtcccattttctaactgaagtttctttacatgttgaattcactctcatagatttctagattacagagtgaataaaggcaaattttaagtagtctgtatccttatccaggaaaaaaagcaagatgactaaagatgtttctagttattcaaagagcaacttcagagaccagattatacaatttttagaggaggtatgcctcttttattagaaaacctaagaaagatcaaatcatacagatagcttattatatggattctagatccaatttgatacgcaatctggattacagataatgagatctagcatgcattaaatactttaaaaggtagaagaatagaaaatatcttatgtgtatataaaacaatatacatatttcagaaatacaataacgatctgctgatatttttcaaaacagcatgcaagtgtcacaatataccaaatatagtttaataacattaaacttaagaagaaaataaggaactatttgttaagtagagaagaaaaattgaattgaaatatgagtatacaggtttaatataacctcacagggaaagataagattattactaaaaataatggatgaaaagaagagaggagaaaagtcagaaagaaggaaaagtaaaggaaaaaggaatgaggggactaaggaaagcagaggagaacaagaaaaaaagggatgagaagaagtgggaggcagggaaggaaggtagagaggaaggcaggtagtcaggccagccaattgcttttcagaggagaattaagggatttgaatttgcagtagaaatacatgtgacaatgaatcctccatattttaaaaagagaaaaagatacaaagaaatagctctctactctatctatggaaataatttataatacttgcagtaaattttgttttattaaccatgattttttcctatcatttgatggtaataattttctaatctgtgattacaaataacccaagaaatcaccagtagagtacattttccattgtgtcctgatctggctaattgaagatgaatatgaaataatgcatttcaggtacaaaatgctgcttcatttgtggattaactagcattgataaacaatggctcccaatgaaaatgtacaaaattggggaaactggtttaattttcagtatgaaggctttagattttatgttgggggtagggggacagtttgtgttcaaagcaaaagaataaactatatgatcccgaaacattactgctggctttatgattctatgaactttagcctaccaattataatgtttatggaaaaaatctagagcagatggatacaacaacagcgacaaacatggaaatgatgtgtttctgtgcagactgctaaggcttgcttgggaagaatacaatataatcattgttagttacctctgctaagtgagaatgcaaataaaagaaataaccttcttctctggctctgagatacagtctatgacattattttctccctcaaatatcttttaagccaatattaaaattagcattccatgtaaacatatgacaaatgattatgggaggcaggccagaaatatataatgtgacagagaagagccagggagagtttaacaacaaaggggagataatgcagagtactggtaaaagcatagacttagaaccagaacacttaagctctagacacaaccccactttaatatctatgtggccattaagtcacttaactaaatgggcattgtttctccatctataaaatgagggagctgaggggtgtcaggtagaaaaagtgatctctaactgtacaagttcatagattatttaaacttgcaaaatcaagaaacatacactctatatgaaattcccaatttcagaactgtagcatcatagtgcataactgagccataaataataccaacacagtgtatcattcaatgttatcattgtaagaaacaatggagaatatcaagccaatctattcaagctattgaactgaggcctacagatgttaagtaaatggttcaaggtcacacaactagcagagatggggagatggggttagaatcttcctgctttttccaatgcctataggatgacactgaaaattaaaaagaaaagataaatgagatctttcagacaaaagcacagacatataattcccacagactatctgtaattaaagggatctttaaaaatagctaatcaaattatctgtttgtgagaatcttaatgattgctattcaatttgcttaaattatctttattttctaaatcaccaaaaaaaaaaaaaattatgccatgggccatagaaaaacatatctcaacagttagaacttcatagactgtcatgtataaatcagcatttactaaatacttcactgaaaatgaaggagggatatgaatgctaatccattttgggacaatattactttaagaagtgcttacctaccaatgccaatctgagaaagaacaagaaaagtagtatgcctcaaatgaaaggtcaggcccaagatatcctgcccattagatgtaatagagtttatcttcccaattagaactaaaaaatatgatagtagcctgaatccataattcagatagccaagaagccatcaggattatattacttgggctgatttgtctttgttcctggtgactcaggtaaaaaaagaataacaacattctcctttaaaatatttagatatctggacatactttccattctataaaggaagagaaaaaattagaagatatggcaaaatatttctaaatgagatgatataagacaatatagaataggaactgaataaaaataaatacaatttgggaattccaattctaaaaatctaaataatgaaacaaagtttataatagtttatgtaactcaaatgattctctaaacaggctgatggcattaaatttatacattttaagagaaaaatgtcagtgatcaataatgacaaaaaaaatgtcttgcattaagagctttatgaccaccaaacctaagattaagtatgaagaagacccttgagtcaccattcacagaataaaagaaatgttaggtgaaaaaacaaaaggtaactaccatttctactttttaaaaaataatttcaacttttattttagattcaggggacacatgtgcaacttttattttagattcaggggatatattgtatgatgctgaggtttgggatacaatttatcccatcaccttgatactgaggatagtacccaatagtttttcaaccctccctaccccctctagtggtctccagtttctatcattgccatctttatgtccacaagtagccagtattaagttcccacttataagtgagaacatgcagtatttgatttgctgttcttccattaattcacttagaataatagcttctagctgcatctgttgttgcaaaggacacaatttcattcttttcatagctgcatagtattccatggtgcatatgtactacattttctttatccaatccaccactgattggcacttcaattgattccatgtctttgctattgtgaatagtgctgcaatgagcatgcaggtgcttgtgtctttttgatagaacaatttactttcttttggatttataccctgtaatgggaatgctgggtagaatggtagttctgttttaagttctttgagaaatctccaaactgctttccacagagactgaactaatttttacattcccaccaacagtgaataagcactctcttcactctataaaagatgccaacatttgtcattttttgactttttaataatagccattctgactggtgtgaaatggtttctctgtggttttgatttgcatttctctgacgattagtgatgttgagcattttttcatacacttgttggccacttgtatatcttcttttaagaagtgtctgttcacgtcttctgagtactttttaatgggattatttggtttttgcttgttgaattctttaaattccttatagattctgaatatttggcctttggtagatgcatagtttatgaatattttctcccattctatagtttgtttattgatagtttctcttgctgtgcagaagtgctttagtttaatgaaattaggtcccacttgtcaattttatctatttatttatttatttttgagacagtcacccaggctggagtgcagtcatgagatctctgctcgctgcaacctctgcctccagggttcaagcgattctcctgcctcagcctcctgagtagctgggattacaggcacatatcatcgtgcccagctaatttttgtaattttagtagagacagggttttgccacattggtcaggctggtctcaaacttctggcctcaagctatccacctgcttcggcctcccaaagtgctgggattacaggcatgagccactgcacctggcctcaatgtttctttctgttgcaattgcttttgaagtctctatcgtgaagtatttgcccagttctatgtccagaatggtgtttccaaggttttcctctaagattcttatagtttgagatcttacatttaaatcttcaatctaccttgagataatttttgtatatggtgaaaggttaaggtccagttccagtcttctgcatatggttatccagctatcctagcactatttattgaagagggagtcctttctccattgcttatttgttatcaattttgttgaataccagatggctataggtgtatggctttatttctgggttctctaacctgtttattggtctatgtgtctgtttttgtaccagtaccatgctgttttagttaatactgtagccttatggaatagtttgaaatctgctatcatgatgcctctggctttgctctttttgcttaggattgctttggctatttgagctctttttttaaattcaaaatgaattttagaatagttttttcctagttctgtgaaaaatgacattagtaatttgataggaatagtacggaatctgtagattgtaactagcacttttaaagcagtaattaccacatctaaaagactaaagtgagggccaggcgtggtagctcacaatcggcactttgggaggccaaggcgggcagatcacgaggtcaggagttgaagaccagcctgatcaacatggtgaaaccccgtctctactaaaaatacaaaaattggccaggcgtggtggtgggcatctgtaatcctagctactcaggaggcagaggcaggagaataacttgaatccaggaggcggaggttgcagtgagccacgattgtgccactgcactccagcctgggcgaaggagtgagactctgtctcaaaaaaaaaaaaaaagtgaaatgaaatgatacagatctgggaaaactaacttggatcattcacacaaagggaaaacagagacgagggggagataaaggaagagggtcattttttttctgtaggggaggacagaacatctgaatcatttggaggactcatcacactttaactctgtcactaaaccattaggatacctagctaaaatactggaaatagagattgttacggctacacactcttgcactctccataacatatactattacattatttgaaacagttttacttattaaaaaaatttagggttggcaaatctaaaactagaaagacaatcatgaatgacaaagataaaacattttagctaaataaggattctgaagtggttcatataagtgaccagggctcagaatagtgggagtcatgctaagtttacactcctagtaaacactcctatgttgggtgaatacaaggagacaccaaaaaaggtaaaggggtgttatcaagtggttttatcccattctctcccccaaagatacacatgactagcatggtcctgtcaatttttccattctcccagtgtgataggttgagtattttagagcatttctttcagcttacactctgcacgcaattatactcagcaacattcctaccaagtctaacttgtcagtgttgtcacctggtccctttccaaattcacctaagcccattggactcacagagacatgagaaaggtatcgtcaagacataattaacttcatcacatgtaactaaatacacacgattccgtccaaataagtggcacttacttatgtccatttaaggctgcgtggtgtaaagcagtgtaacccgaactgtctgtgcagttcacattggggcctcgccagatgctgcaaataaagcacaagcgcagagttaacagtgaagccagatcttgccttgaaaaacaaaaagaaggctggtagccccacagtcagcagcaggttgtagataaaaattttagccatgtggaaaatgattgccatcttctatgaattcccctcagaacatcaacttcatttatttgataaaaggaaactaatagagaatgcaactattaatatcttcagaaattattaacaaatgtgtgtccatggtcgtgcactgaagtttggatccaaaaattccctattactttctatcgttacttaaatattagaagcaactaacattcagctactatattccataccaaagaataaagatttatgagacctgcctcatgcctgttaacacactccttctgaggtgccggtgatttatataagttataagatatttttgcattgtgggaagaatataaagtctttttgctcttcaattgcaaccaggaaaatgtaatcaatatttcatacttgaaaataaaattgaagatttggactgttgtaaaccatgagaagatcctaacaattttgcagtcatcattgattttactatgcaatatattctggagataacatgtaactatataaaagagtctattttttttttgataactacaattaaggaaactctttttaacttttggaaaataaggcactgaaagacacttttccaaaaatagaacaaaaaattgctttatctgatggtcatagtgatatcaaaactatcaaagataaactagttcacacattcacaaaacatttattgtacaccaactgtatgtcacatattgagctaggcactgggagcacaaaatcgtaactcaaggtccttctttacaagaacatagtgtaatggaaaagatagacacacaagctaataattacaaagtggtaagataatcaaggtaccagacagcacacaggcatctctgaaaagagaatgaatagctattccaaacaaggggtcatggcagacttaaactaaggtgggtcaatgaaaatgaatggaatgtgcttatttgacagttaattaaaagaagaattaatgaaacacatggatcaattggaagaaggtgggaaactggaagcagtagtctagagatgactcagactttaggcttacatgactagaaaaaattacaatattaactaagatgtgaaataaaaaaagagcaaaatctgctgcagggaagacaatgcaggatggagagaaaacaatgactcctagtttgcagacgttaaatcttaagtctctgacttacttacattacataggttcaatgcaatccctatcaaaatcccaatggcattctttaggaaattgaaaaaaaattctaaaattcatatgaaaccataaaagaccccaaatagccaaaacaattctgagaaagaaaatcaaagttgtatgccaggctcagtgactcatgcctgtaatcccagcactttgggaggctgaggagggaggttcacttaagctcactagtttgagaccagccttggcaacataacaagactccatgtctgctaaaaataaagaataaaaaaaattagtcaggtgcggtggtgcacacttgtggtcccagctacccaggaggctgaggtagaagggttgcttcagcctgggaggtcgaggctgcagtgaaccataatcatgccactgcactccagcctgggcaacagagcaagaccctgccacccccacaacaaaaaaaagaaagaaagaaaaatggaggcatcacacatccagattccaaattcaggggatatatatacatacaataaaatattattcagccctaaaaaagaattatatctaaacattttctatgacatgaatgacccgggaagacattatgctaagtgaaataagccagacacaaaaagaaaaatattgcctgaaaatatacggaatctgaaaaaaaatcaaatatacagagatagagaacaaaagattggtagggggagtagaacgggggaaataaatatcagaggatacaaagtagcaaatatgtaggatgaacaagtgtagaggtctaaagtacaacatgaagactacaggtaccaaaattgcactgtatacgggatttcagctacgtgagtagattttagctgctcttgccacaaaaacaaaaaataaagggtaactctgtgagaggtggtcatttgtttcactgtagtaaacttttttttactatctatatgtatcccataacatgtgtataccacaaatatacacaataaaatttatttttttaaataccacaatgacatgctactatataactatcagaattgttatctttaaaaaggcttcacaaacctatattgacaaggatgtagatcaaccagaattcacacacacactgctaataggcatgcaaaatagtacaaccacttagtgaaacaatttggcagtttcttaaaaagttatatacaaataccacacataacttaccatcaaatcataccatacaaataacatacaaataccatataatccagtcattccactgtaggtatttagcccagagaaatgaaagcatatgtccataaaaagacttgtacatataatattaataacagctctataggtaatagcctaaaacagagacaacccaaatgtccattagctggtaaacagataaattgtgatatatccatacaatggaaataaaaagaattaaatactcagaaacaaaaggaattaaatactacgacattggttgaaaatctaaatcaattagattttctcaggaagaacagcagaatggctgcccttcaatctccccagcagaaagggagacattctctggcacagataaaatgcatgatctctggactagacccctgattggtagccttcatcaacttctgtgatgtaaatacttcaacttaacgcagtgataggaagagatgctaacaactgcacttcacaagcagacacaagccaatccagcacaccattcaaaggcctacaaccaacaagtcccaacactatgaactcagagcttcccatgagtttttgaaaacctccactctcaaatatgaacaaataaccaaagacatccaatcacttgaggaaagcctttactactaaagaaaccaaaacaaaaaattaggaacaaactacagaaaaaaaagaaacttagagaaaatttagactatgcatggagaagaaattttcaaaaacagttatcattaatatcatctcaatattagaaaagataatgaatgtaagaacaatgaaataaaaaagaaaatcagagataaaatcagtagaagaattaaaaataaagctgataaggccaggcatggtggttctcgcctgtaatcccagcactttgaaaggctgaagtgggcagattacctggtcaacatagtgaaactccatctctaccaaaaatacaaaaattagccaggtgtggtggcgcacgcctgtagtcccagctacttgggagggtgaggcaggagaatcgactgaacccaggaggcggaagttgaagtgagtcaagatcgcaccactgcactgcaacctgggtgacagaatgagactctgtctcaaaaataaaaagtaaaaaataaagctcatgaagtatctcagatacttagaaaaaaaaggcaaagatatagacaaatagaagggaaatcataagaaaagtaggacaccgatttagcagttccaatattgaaaaatagaggttcttaaagtcaaaacacagaaaacaggagaatgaaaacaatgaaagacatcattttaaaaattatcagaactgaaggacattaatttaccaaataaaatgtacatgggccagtcgcggtggctcacgcctgtaatcccagcactttaggagaccaaagtgggtggattacccgagtgaggtcaggagtttgagacaagcctggccgacaaggtgaagccttgtctctactaaaaatacaataattaggccgggcgcggtggctcacacctgtaatctcagcactttgggaggctgagtagggcggatcatgaggtcaggagatcgagaccatcctggctaacatggtgaaaccctgtctctactaaaaatacaaaaaaattagccaggcatggtagcgggtgcctgtagtcccagctactcgggaggctgaggcaggagaatggtgtgaacctgggaggcggagcttgcagtaagccgagatcgcaccactgcactccagactgggcgagagcgagactccgtctcaaaaacaaacaaacaaacaaaaaatacaataattagccaagcgtggtggtgcatgcctgtagtcccaactactcaggaggctgaggcaggagaaatgcttgaacctgggaggcagaggttgcagtgaggcgagatcacgccagtgcactccagcctgggcgacagagtgagattcggtctcaaaaaacaaaaacaaaaacaaaaaaggaccaggatagctttgataaaaaataaaaataaaaaaaagacaaagaaataactgaagtgagtccgatacggtcttttaaatttcaattaaacaaacaaaccaaattcctaaaacacccatccagggctattctcttaatttaaatttttcctctttcaactctagttacactaacaagtcttcactattcaggaaacctagaatgaagagaaattattcatacctattacttctacttcaatctgcaatcttcaattattaatggacactctccaagttctaagtccaagaaaatacaagtccaagaatcaaacaaaataatgaataagatatcatctcttcctccaaagagctgacaatctaatagagaaaaatatatacagataaattacaatataggcagtgaccatagttcctacagcacagaaaacacctaataattgtttgttatcaatcttcttgttcttattaaataaatgctacaatagaaaaatctttaactccctaaattaatacatctgttcaacaaaaatctctatggaatattttacggaaaactcaactaaaagttctaaatttgatttagaagaatttacgggaaaaaaaattgtgaaacaagaagtaataatgggatctacatactaccaattatgaaagcatatcataaaacaataccaaaaaatgttagtctagcaccagaatagagagctcaatgaatataagagaagccctagaaacaaaccagtcatacatataggaataaagctgacatctgaaagaagcaaaaaaaaaaaaaaaggaaaacatcattcaataaatagtcccgagaaatatgttttaattaatgggaaggaaaaaacaatttcaattccctaccccataccatttagcaaaatttaatccacatgatttgttcttgacttctcaaacctcattcctaccctctttttctcacacaccctgttcaaaccacacaggcctccttaaaaatataagtatgcttgcaccttatgactgttgcatttgaaattctctctgcctagaaagttttttcctcaatcatatggctcaatctttctgctcaaatgtcatctcttcggaaactctctccctaattattcagtcaaaaatagcaccctatcatcattctctttcctcttagttatgggacttatcaccatctggcattatattatttatttatatgcttactgtctgtctccccactagaatgaaagctccaccacactatctttgggtcttaaaacagtgactggaatattgtaggtgaccagtaaatatttgttaaatgaaatataaaaatgttgagtacatatatgaaaaatgtcaacctcactggcaatcaaagaaagcaaaaaaaaaaaaaaccaaacccataccattatatatttctttatcaaattgggaaaaaagtcaataatattcagtaatggttagcatgcagagcttataataagctggtggtgaaaatgtaaattggtacaatttttctggaaggcaatttgacattacatgtttaaaagctttcatagtgtgcaaatgtgttacctagaaattctccttaagaggaattattttaagaaattaattaatagtttgtacaaatatttagctataaaaatatttatcacagagtgagggtagtaaaaattatggattttgatatataatgccacttagaatagttattctctctttgctcttgtcagctagatttctaacactgcctgcctccagagcttagtactcatctttctctctagctttcttatatgagacccacagcatcagtgtcttatatggctccagtagcatatggcttgagctcctactgatcagggttttttttttttagcttatgtgaacctccctgggaggagaaagtctaccaacagagtagccagggatcctagagaggacgcaattcttcttagttttatacaatggctcaatatatgtgacagataaacagatatcactattctttaacataaaataaaaatctcacaacaaaatggaaaaacaggatattaacaggcaattcacagaaaaggaaatgtgaatggctaataaatatttgaaaatataattaacctcactgtggctagcaaagagcaaaataaaacagtggctgcctacttttctaccatcagatgggcacaaatttttaaagaaataattgataacaatcaatggaggcaaatatgtgaagaaatagtcactctcacagaatattcattgaagtgtaaattgctacaacattcttggaaagtaacatggcaatacataatcaaatttcaaatatgaatactcttagacccaacaactccacttttcaggattgatatctatgaaataaaaatattcatatgaagactgcagacacaaaaatatacactgtagaattttaatagtataaaagagaaagggtctggaatggtggctcatgcctattatctcagcactttgggtggctgaggcgggcggatcacctgaggtcaggagatcgagaccagcctgtccaacatggtgaaactctgtgtctactaaaaataccaaaaattagccaggggtagcggcgggtgcttgtaatcccagcactttgggaggccggggcaggtggattacttgaggtcaggagttcgaaaccagcctggccaacatggcaaaaaaaacactttactcaaaatacaaaaattagccaggcatggtggtgcatgcctgtaatcccagctactcaggaggctgaggcacaagaatcacttgaacccaggaggcagaggttgcagtgagccgagatcaggccactgtactccagcctggatgacagagagagactccatctttaaaaaaaaaagagagagagagagagagaaagctcataaatgcccagcaaaaaaaaaataaaaaattaattagtccaatagctgagaatggggcaaaaaaggaaaagttaattaggattcattcacactatgaaatgttatgcaactattaaaataaataactttgatctgaatgtattgactttgaaagtcagccaaaacatataaagtgaaaaacgtaaattgcagaatattgtgtgtgtctggagcattccaaatgctttatatgcattagcttatttatagccacacgactataagaaagttactattactattcccattgtatagatgaaaaatatttgcaataacatagaaaaatacatgcaaaaatacattattcattctgtgaatagtctgaatgttgaaattatcatgaatttctttaaggaaaagaaaagacaataaactacaaaggaagaaagataggtttgctccagattacgaagaacctcataatatattgaaaagcttggattttattctgcagcaacttggaactaaatggctttcagaaagataagtatgttcctcacatgatcagtcagtgttttagaataagagctcttgtaacaggtggaaggtaaacagagtgagagtcaggttaattgttttacagaccaggggagaaacaaagcaatttgaacaaatgcagatatagtggtagagagagagagggtgagaaaattcaaattgatatgtctaaaataaaacctatgggagatggtatccatatgaatagaataagaacaagagaatggctgaggtttcaaccatgaacgaaatgcatcaatgatgagatatctccactagaaaaagctgcaagggcagtagtatcttctggcaggagccaagtttcagttaaaactgattagaacactaggttgcttggagtacctcaggcaaaaaatggaaaagaaataggaaaatactgcaaattaactgtcatacattttttaaatttctgcatgttattagaccttacaaatattttgtaagagaagatatttataactaaaataagattcagggcctatagatttcaattacctataccaactcagttccccattatacaaaaattaattataatacacacatttttaataactccattgaatgtcgccttctcctagcaaaatggatatggatacatcttttttaaacaaggaggtttagaatggaaagttagcatatatctaaatatattcaactgcacctattgacagagcctctaggcacatatccacatatccatagaacatccaccgacacatctgaaacaccataaataagccagacccaaaccctccaactaaaaatttaatttaaaaaagaaaccttgatttctaaaaggttctgcttcattccaactttttatattgccttgccccctttactcaggcataatcttcaaatttagaaagagggcctagattaaaaacttgattaacttaagcttgtttcataaaatgcaagagtttctagacacatttaagaaatgtcttgaaaaagtataaaatgcttattacatatttattccaaaaaaagcaatttatagatccttggtcttagtctaatacacacccaaatcccatttcttatgcctacttgtcaatatcttaaattctgtatgtgagaattactgcccaaaatgaatgttctcagacaatatggggttgccaattaccaaaaatttaatttcctttgttatattatttgcactaatgtaacaaatcagattagtagattttagaataaatataaacaaaatagttttctaccaaactttcaaataaccaggacattcattagtcagaatattctattatctaagctttcacatattaaataagattattcttaaaccataagcctgagtttcttaggccaatatccatatgtacagcaaataagatttgaagcacaactactccacaaattgatcattattataccttccatcagtctatggggaaaatctatcagaaataacataaaactgtttcagtttttattgattcctatctgacccctgacacatgagatcacgccgaggcatcagatatggaaattcatacagaatgtgcatttaatgcctcaggcagggtcagagtatgtaggaatggtcttctgacagatcatatcatttcaagcaatgcaaaataaaccttattctcaatctgtgtcttaatagtttacttccatttttggatgaactggacatatgtacatatgctactgattactacaagtgaagttctcatcagtttagtgatggcacaattttattatcatgggctacaagtgtcccacatgggtcaaatgggtctatatcagcactgtcctttagaaatacaaggtgaggactgggcatggtggctcacacctgtaatcgcagcacttttggaggccaagacaggtggatcacttgagcccaggagtttgagatcagcctgggcaacaaggtgaaaccccatctctacaaaaaaaaaaaaaaaaaaacacaaaaagaaaaattagccaggcatggtggcatgcatctgtagtcccagctattcgggaagctgaggtgaggattgcttgagcctaggaggtggaggttgcagtgagctgacactgtgccactgcactccagcctggacaacagagcaagacccagtctcaaaaaataaaaagaaaaaaatatataatgtgagccatatatgtgaatttaaattttctagtagccacattaaaaagatgtgaaattagtttgaatatattttatttaacctagtatatcaaaaacattatttcaacatataatcaatataaaaagtattgagatgtttcacattcttttttgtactgttttcaatattggtgtttattttacacttatagcacatcacaattaggactagccacatttcaaatgcttaatatcctgatgtggacagtggctactatattgcacagcacagggcatttctatataattattccaaggggaaaaaagaaaattaactctaataatatgaaaaagctttctagtataaggaagagtagctaacggatgctggacttaatacctagaagatgggttgatctgtgttacaaaccaccatagcacacgtttacctatgtaacaaaactgcacatcctgcacatgtatcccagaacttaaaatattaataaaagttgatgaaaaataaataataaaaaagtattgtcacattggaacccacatactatcccatatgagtttattgaatgaatatttactgaaatgtgcaaaaccatctaagtaagatagatatacactataaagcttaaaaatgcagagaacaactatgaactggccttctgtgaagaatgagaacaagaatcagcaaactgtagaccatgagccacatccagtccactgtttgtttttgtaaataaagtttcatcgaaacacatacagacacatacacacacacacgcacaaaagctttctaaaaataactgcaaacgttggctttgtagtaaatacatgtctatttgagtcacaaacaatttcttaaagatatcttgcctttggagcaaaaataaataatagatctagtatacagtcatatcctagactgtaatgcacaattttacaaaaagcacatcaggagcatcatagtcaaaatcgtactaactaaacattttctgatgaataatgtgcaccttgaattacttgatgcaattctcaatacatgtatttttaccagcaaatgcgaattgaatgactatgagcaaaagtaactccttgagttataatcacacatataatacaattatgacctctcttcaatatatacagtatgtgccacaagatggaattttagaatatgaaaagaatttgtaaccacaccgagccataaacacagagtcaagagacatgagaggaaaactagagcatctattttaacctagttttaacttcatcacttgttctaaaagtgtaaaacattcctcccagcccatattttctcttctctgcatagatataattcctggaaaataaaccagcagacaaggcagattaatctctcattgtcacacgaacactgattttggtggcaattgtttttcctatcctcacattctcttcataggtaacaataattccagggtactatggtaggaaaaaataatggtacccccaagatgtatacgtcttaatctctggaacgtgtgcatattttgtattacacagcaagggagaattaaggttgcagatagacttacattgctaatcagctggctttatcccggattacccaggtgggccccatgtaattacaagtggagaagagggaaatggaagagtcagaatcaaaaagacggcacagtcaaaaagactcaactggccattgttggctctaaagatggaagagggtcatgaacctagaaacgtaagcagcctctagtagctggaaaaggcaagaaaacagattttcctagagccttcaggaaagaatgcagccctgcccacaccttgattttagcccagtgagaaccacagacctccaggactataggataacagatttgtgttattctaagccactacatttgtggtaacttgctacagcagcaatgggaaactaatacaggtgtgcttattgtaattaacacacccgaaatatgagacgttcagacctttccaaatacttgggaatttaaggtagcatgagaaagagagcatgaacaaaacattgactgcggacttgctacatactagaaactatgcaaaatgctttgtattgattacctaagttaatcttcataacaaccatgtgagacgggggcttttataacccctggatttttaaatgaagaactgaagagcagaaaagtaatttatcaaagatcacacagctagttcacattgcaggcaagatttggaaccaggctgcctgattccagagccaatgacattaaccactacattatacttcagtctcattgtttttatttacctttgattataataaagtggagacatttttacttgtataaatataaggggtccaagtgcagttttgttacagggatacattgcatagtggtgaattctgggcttttagtgtaatcatcacccaaataattacattgtaccttttaagtaacttttaatccctcaccgcccaaccccaaccctcccacctttcctagcctccaatgtctatcattccatcctctatgtccatgtgtacatattatttagctcccatttataagtgagaacatgtggtatttgactttctaagttctttcacttaagataatggcctccagctccatccaagttgccaaagacattatttcattctcttttacagctgtatagtatcccattgtgtatgtgcatatcacattttcttcatccaatcatctgttgatggacacttagattgattccatatctttgctattgtcaatagtgcaataaacatacaagtgcaagtatctttttgctacaattatttattttcatttggatagatacccagtcgtgggattcctggattaaatggtaattctttgagatatttccatgaagttttccaaagaggttatactaacttatattcccaccaatggtgtataagcattcctagaccttttatgtttcatgaccaatttcattttttctatgagtagcttgtttatattctttgcccagtttttgtattgagtttttcattatttttactgattttcatcattcttactgatttgaagaagccattttatatttatagatattaaccctttctaatgttgaaaatatttcccttatttcatctttcagccgaacttatggtgtactttgcctggccataatgtttactaaatcattctatctttctttaaatttattgtttctagccttggtaccattgaaagaaaggtcttcctgattacaagatgataacaatattctctagtatttcttcctatttctttttttgatgaaattttttaatttctctctattatgggtatatgatatgaggtatttcccaatggaataaactaattcaataccactttaaaataattaattgccatctaattaccccagtgaaatgcttcctttctcatatattatttttctgtacctgtatttcaaatctgtattttgactgttttgttacattcatctatcttctccaaagactaatattacattatttaatttctatagctttatagcatattttaatagctaaaaatagatctcttctgatatatatattcttaactgtttttatcatgggtttattcatctgtataatagatggtatagtcagaccaggcacagtagcatgtgcctatagtcccagttcctcagggggctgaggcaggaggatcacttgagcgtaggagtttcagtccagcctgggcaatacagcaatacctcatctttaaaataaaaaataataagtatagtcaaattgtcaaatttaaaaaaaagttttggctgtaattgcattaaacttatagaaaaagtaggaagaaatgagatctttgcaattctgtatttttccagctgaatctgatttccatctctacagctttggtaacagtcttaggcaaggtacttcacttcattagacctgagtttccccataggtaaaacccaaggataatcacagtaataacctcactgtattgtgagaagattaaagaaaaaatataagtattaaatatactacgcaatccacagaaggtacttattaaatgttatttaattggtctaacctttttatattttctttatagaactcttaaaaatattttaaaattattttctttaacatacttacatagtgaatactatgtgccagatatcattctaaatgttttctaaatattaactcaataaatcctcatagcaacgctatcaaatgagtactataattactacacttttcagattaaataactaaggtacagagtagtgaagtaccttggttcaggtcacatggcccctaccaggtgaagcagggattcaaaccacagcatgcctttaatcattatctattgccttgttattttaattcctaagtaatttagttctttattactattccacatgaagtcttatttttcatgtcttttaattactgctgctagttagaacactgtgtttttcaaattcattcactcattcaaaaaatagctattgagtatccactatatacaggcactgttctcattgttctagtcactgacaacacagcagttggagaaggctgtacagaaaaaagacaaaaattcctgccctcatggtctttacattctgatttagttagacaaacaatatacaaatgaatatataaatatatgaagcaagaagtggtatcaagaaaggcaagaggaacagagtgctgttttatgcagcatagtcgaggaagcctctgggataatagggcaactttggaagaacattttaggaagaaatgggcttaatgctgaggaacagccaggacagcagtgtggctggaatagggtaagcaaggaagagagcacagaaaagtgggtcagagatgtgtggctggatcatatagagccttgtggccattctgactttggccttgactgatatggaaagccatcggagagttttgaatggagaaatgacatgatctgacttgtattctgctgctctgctaagaatagtctgaaggggaaagggtagaagcaaggagatcagttaggaaattactatagtaatgcaggaaaagatgatgacggcttagagcaaaggggtagcatcatgtagagggaaaaaatgcttggattatgcatttaaaggtaaaggaaacagaatttgctgacaaattgtgacgtgcaaagaaaagaaacaggaaggactgcgagatttctgtcatgagcaactagaaaattggaattgccatttattaatttggataagtttgcagaagaggttctctattatttttaggtataataatcatgtatctcttcctttataatattcattccattttttctccttacacaaactgcattggctagaaccactaaaataataagaagataatctttgtcttgttgatgaatttaacggcatgcctggtagggcaccaccatttagtatgatgcttgctactggattctcatggataccttttcagcatattaaggaaacttttattccctcagtaaagaacaaaaaggtggaatagcataatggataaaagcacggactcaggattcaaactgtctggactaaaatgctgatcccctccctaactgcaccaccttgggaaaattacctaactactccgtgcctcagttctctcatctataaaatgaatataccagtaatagctagctcatagggttactgtaaagattaaattagatgtaaagtgctagcacaatgcctgacacataataatcatcctttctgtaggaaaagtttttatctagaatggctcttgtggtttgttaaatttatttaggatatctttcacgatggtcatacagcttttcccttttaatacattaacatatttaatgtcggatgagaagcatctctacactactggaagtaaatttatctacttatggtgtatttttttaatataatcctgaatttgatttgctctttgtaacaggattttgcattcacattcacatgtaaattgtctctggttttcttgtcttttttatttcagttttggaagcaggttacataaactgaagagtttggggccttttttctagtttccagaataattcaaccaacatagaaattgattatgttaattgaatatttgaaagagcaaatgtaaaatcatctaggattggcacttttgtggagtaaacccttaataaaattccagtgtcttctatggttactgacttactaatatagtcgactttttcttacattaattctgtcatttacatttctctaggaaataagttctttccatttaggctttctaatttattgactagaaatcatacatatttttaaatcggttgttattgtccatatttacagttctatcaccattgtaattcccagtgttctgtattatttttctctccttggttagtctaggtggggctagtttatcagcatattcagagatttagttagctttatttttatcaaatgtctattggatatgttatttattcattgtttatttactttttaattaactactctctgttcttaactataagaattcagttacctatttcacatttgagttgaatgcttcactcatttaattttattctttcttattcaaaggtaaaagcattataggctgtgacatttctacggaggttttgcccacatgacttaggttttgacgagttatttttcatttcaattattatatacacagcctgtaattcagtttttgtgtcctttttactctgaaaattatagttgttttttaaatttatcaatgcttagaatcattatatgtcttgctctatttctagtgttaccacattatagtcagaaaagaattcttcaacttctaataatttatttagaatttttttgaaaactagtatgtagtttttgttatgttacatgtgacaaaagttctttgattaaccaaattttagctggcctcctaaaacttctcctaggcccatctgtgtacttccttgtaaaatagcaagagctctgctcagtcagtttagcaagaacctccacccttgagatcttatcagattcctcatcctccaccatccctcaggtgatacctggtcaccatggcctgtcttcagctagacttttcgaagttggtttagccaaaaaccctcttacccatgtttcctcttggtaattttccatccactgacccctgccctgttccccggctatgaatttccacttgcccatgctatatttggcactgaccccaatctctctcccccactgcaaaatcccattgcagtggtccctatacctgtgatagtcctgaatattgtcttccttaccttgctttaacaagcatcattgaataatttttgttaatgcatgagcattgaaaagtatattctattttttagggagagatgtgtacttttcaagcttattaattgcataattcaaaccatcaataactatttagttcgtctacttcattcgcaaatttttggaaatgttaccatacacagtatatcactgtgattgaattattaccaaattttctttgtatttctaagtttgcttcatgtgttttgttgctgtagtttcttcagtttgtttgtttgtattaaggcttttttccaacttttaggttcaagggtagatatgcataacgtgcaggcttgttacacagggaaatgtgttcctacatcatttctgtcatttatgtttttctaggagataagttatttccatttaggttttctaatttgttgactagaaatcacacatatttttaaatctgttgttatcttctatatttacagctctattaccattgtaattcctaatgttctgtattatttttctctccttggttagcctaggtggggctagctgcacagatcatcccatcacctggctattaagcccagcatccattagctattcttcttgatgctctccctcctctcacccccaaccctccaacaggccctgtatgtgctgtccactccgtgtgtccatgggttctcatcatttgcctcccacttataagtgagaacatgtggtatttgattttctattcctgcattagtttgctgaggataatggcttccagatccatccatgtccctgcaaaggacatgatttttttcctttttatggctgcatagtattccacagtgtatatgtaccatattttctttatctagtctatcattgatgggcatttaggttgattccatgtctttgttttgtgaatgatgctgcaatgaacatacatgtgcatgtatctttataacagaataatatatattcctttaggtatatacccagtaataggattgctgggttgaatggtatttctgtctctaggtctttgagaaatcgccacactgtcttccacaatgttgaactaatttacacccccaccagcagtgtaaaagcattcctttttctccacaacctcgcatctgttgttttttaactttttaataacagtcattcttactggtgtgagatggtatctcatgtcgtttagatttgcatttctctaatgataggtgatgttgagctttttaaaagtttcttggccacatgtatgtcttattttgaaaagtgtctgttcatgtcctttgcccacttcttaatggggttgtttttttcttgtaaatttgttttaagttccttttagatgctggatattaggtgtttgtcagagagtagattgcaagaattttctcccattttgaaggttgtctgttcactctgatgatagtttcttttgctgtgcagaagctgtttaactcgatcctatttgtcaatttttgcttttgtggctattgcttttggaattttcatcatgaagtctttgtccatgcctatgtcctgaatgatattgcctaggttttcttccagggtttttctagttttaggctctacatttaagtctttaatatatcttgagttgatttttgtataaagtataaggaaggggtccagtttcaattttctgcatatagctagccagttctcccagcaccatttattaaatagggaatccttcccccattgcttttgtcaagtctgtcaaagaccagatggttgtaggtgtatgatgttatttctgggttctctattctgttccattggcctgtgtgtctgttttggtaccagtaccatgctgttttggttactatagtcttatagtacagtttgatgtcaggtagcatgatgcctccagctttgttctttttgcttaggattctctttgctatttgggctcttttttggttccttgtgaattttaaaatagttttttctaattctatgaagaatgtcaatggtagtttaataggaatggcattgaatctataaactgctttgggcagtatggccattttcatattaattcttcctttccatgagcatgaaatgtttttccatttgtttgtgtcatctctggtttctttgagcaggggtttgtagttctttttaaagaggtccttcacttcccttgttagctgtattcctaggtattttattctttttgtggcaattgtgaatgtgagttcattcataatttggctctcggcttgcctcttattgctgtataggaatgctaactatttttgcacaatgattttgcatcctgagactgctgaagttacttatcagcttaagaagcttttgggctgagatgtggggttttctacatataggatcacgttatctgcaaacaaagatagattgacttcctctcttcctatttgaatacctttatttctttcttttgccggattgccctggccagaacttccaatacttgaataggagtggtgagagagagcatctttgtcttgtgctggtttccaaggggaattcttccagcttttgctcactcagtataatattggctgtgggtttgtcttatatggctcttattattttgaggtatgttctttcaatacctagtttactgagagtttgtaatatgaagggatgctgaattttagcaaaggccttttctacatctattgagataatcatgtggtttctttacttctgattatgtaatgacttagtttattgatgtgtttatgttgaaccagccttgcatcccagggatgaagctgagttgatcgtggtagataagctttttgatgtgctgctggattcagttttctggtaatttgttgagaatttttgcagtgatgctcatcaaggatattggcctgaagttttctttttttgttgtatctctgccaggttttggtatcacaatgttgctggcctcatagaacgaggtagggaggagtacttccttttcgatttttttggaatagtttcaataggaataacaccaactcttctttgtatctctggtagaattcagatgtgaaactgtgtggtcctgggttttggttggtggctatttattactgcctcaatttcagaacaatattggtctctttaagtttttcagttaagcaaaagaatggcacatcatctttatgaattaaatgttttattattattttaaaaaattgactttgttccatatattgctctttaccttgaattatgccttgttattaatattactacatctgctctccttttgtttaacttaactagtagagttttgcctatccatttattttccttctatttctgtcattttatcttggctttatctcttgaaaatggcctatagctacagtttgcttttttgttttataatctgagcagctttgccttttaattcactaacatttgttattattcctgctgctaaattgtatgtaatgtttttattctcctttcctattcttttccctcctcttctctcttctctgttttcttgatcaagcgttcttcatttctttattcctttctagctatttttccttaacattttattcctaatagtcctttactttttgcaaatatattaaacctacatttcttactgacatcaataattacattgtaactatgtccatctttaacaaaacataacttgcatcttttcccacttttaacccaaggatttttgataaaacaaggtagaattttaatgctatagtgttactatttcctcttttatttcagaaatactttaataattatgttgtatttgacaaccatgttttcaatagcgacttaggtttactaatttcattgctcaccatagtttcttgaatatttaaaaagattatatgagatactgtgatattttgctgccttcaggttaccaaaaggcacagaatttacaaacatagtgccatgaccactaaagtcctatatactggaatatgattcatccaccccagagttgcaagcagtctttaggagatataaagatatgagaaatcttttgagagatatgaaaaaaggattagaactatgatgtggtcacattttgcggaatgcagtctttgtgtagacaggttatctgttctcctcccctcccataggtgtagaagaaaaaaacactcaactgggtttccttcccaaagttcacagaaagaagaaccaagaaaaacttgaagtgtgttgctgggcctcagaaagcaacaccctaaattatgatgttttggcacgctaagtactttgaactgaaggacagtggcagggcctcagaagcaaggtctctctcttttttctttcttttttttttttctttgagacagggtctcatcatgtcacccagtacacagtgcaatggcaatcatggctcactgcattctcaaactcctaggttcaaatgatcctcccacctcatcctcctgagtagctgggacaacaggtgcatgccaccatacttggttggaaatccttctgtccttctgagcttctttctcctgctcccctttcttccccaaggcaggccataaaaaatagaattcctcttccccaaggcaagtcatataaactagaaatattactctaaccttctccgacctttctgtgtacaacctggccatcaagaaattctctaacctactgtctgatagtaggtcataagaccctcattctagaaggagtcctgccctacacccagaaggaacaaatgcctcacagagaggtcaagaagaacctcaactgacaggccttgctgggtttccccactcagtctattaccattaagtcattccctttttgtctaatcacattcctatgtggccgtccattctcatcaaacctaaaaataaaaatgaacagttttcccttgggtctttacttctgaatgctcctgtgacatataaaactttgattaaataaatctgttattcttttttcttgttaacctatctttagttgtaggagtgttgaccctgacccttaagatgggttaggaaaggtatcacacccttctgcccctacagttgctgcatgaaggaataaccgacaaattcagtccatggttgaactttccctttgcttgacctaccccaaagcttaaggcagagtgggagtagaggaagagggacagggaaacattagactgaaatgacaaattgttcctggtgaaaaagaacagtttctagaatgtatggaacatgggtcctgcccagacccagggaagcctgaattggggcagcaaatggtgaatgagactgagagccacagtctggccatcaatcagtgcagcaggaggtaaacaagcaggagaggaagagagcctgaggctgactgcatggtgtgatagcatctatttgtgggaggctattgacaaacctgctttggagtaatgctgaagagaaaagggtcaaaaatactgtgggcagtcacagtgtatgaggcatcagttttcagtttcctccttgtccctcctccctgcaaagtggaagaatgggggccagggacagagggaacaggaaggggaggaaatagagagaaagaacagaccatgtattccctaccattctctaccataccaagttgcttttgcaaagagaaaaagcattaaatgaaatatgagatgaagttttcaagtggacaggaccaacaaagctggaagacttaaagtaccatatatcacgataatgtaaaagaacaactggcacagggatacataaatagatctatggaactgaatagaacccagaaacagaccctaatctatatagtcccttgatttatgacaaggatgacatggaagtgaggcacttcttattaaatgacgctgagtcaatttcatatctatatacaagaaatgaatctcaacccataccctgagccatatataaaaataaattctagacagattacaagcctaaatattaaagggcaaaacaataaaatttctagaagaaaaaaatttaaaggcacacagcccaataaaaaatgagcaacgtcaatggtggattgcatttaaaaaaaaaatgtggtacaatacaccatggaatactacacagccataaaaagaacaaaatcatgtcctttgcaacaatttggatgcagctggaagccactatcataagcaaactaacacagaaacagaaaaccaaataacacatgttctcacttgtaagtggagctaaacactgggtatacatgcacataaagatgggaataatagatactgggaaataaagagggggaaaggatgaagtgagacaagggttgacaaactacctattaggtgctatgctcactacctggatgatggattcattcatatcccaaacctcagaatcatgcaatatatctgcatatgtattccctgaatctaaaataacagttgaaaaaaacaaataagcaaatatttggacagatatttcaaaaagaatattcaaataccaaatatatatatgtgtgtgtgtatacatatatgtatatacacatatacacatagttgttcaacttccttagttgtcaggaaaaatgcaaattactatcacagtgagacaccactacatatccaccagaatgactgaaatcaaagacagatgaaaccaaatgttgctggggatatgaattctcataccctgctagtaaaatataaattggtgcaaacactggaaagttacttagtagtacttattaaaccttcaaatttgcatactctgtgaccagcaattcagaaattcttacctatgttcactaaaaaacatgtacaagcatgtacagcactgttcataatagtgcaaaactgtccatcaatagtagaaagaataaactgtagtacattcacaaagaatactacacagcaatgaaaagcaacaaaactattattactctccacacaaaaatgtgtcttacaaacataaaattgaacaaaagaagtcatatagaaaataacacatactgaatgattccatctgaacaagttgaaaaacgaaaacaggacagtaattacccttctgggggatagtaactagaacagggcacaactggggtttctgagatgctagcaatattctatttcttaatttggattctggatacatagatgtaatgacttcgtgaaaatacattgtgctgtaaacttatgatttacatacctctctgtgggtttatttaaacaaaatgacaaaaactaagtcttaatagctggaatgtgactgttttaataacagaaagtgaaaaattatagaattggatttagatgtcattagggagcatgttattcagcaggaatggagatttcattagataacagtggtaacagaaattggaaaaatacaattgttttatgtttattccttatgatctaagaattttcagtcatttcagttatattaatctttccttttcttgaaattgatgtgattcaaaacatgttatcccaaaatatggtatcttcgcatttgagaaaacagcagaagcaagaaagtctctctctctctctctctctctctctctctctctctcacctactctcccctttcttccctgaagcaggccacaaagcctagctgaccttatttattatttagttattagttatttatttttataaactcttttctcttaaatttaatctcttagtaacttgaaacttccatcctcttgctatagccttcattttatacatacagcttcaaagtaacccaaattctctatcttctaaaccaatttccaatgcacaaaacacatcaataattctaggtttctacaaatatatgatagctatttttgtcttccatttttatccctacaaactagttagatgcattttataatcccaagcagaaataccccaattatgttaagtgactcaagggatagagttaattttgtatgaaaagattaaatttgcttgattgctcttttttagtgaagactatgttaatgtcaagtttaagagtgatagtattttgcttttgacaaagacataagggaaaattcttctcagctagttcagtatactctaaatcagccacaaatataaatcctaactcaagtttctcacaactagaagaaatcagaagaatatgataaaaatcaaagaattcatatcatgaaaatgaaaggtacaagagaaattcaataacatgctcttcctattttttgtttgacttaccataaaaatctgcactaatgggggacatctatgttttcaattctaagcataagttttagatctccataacatgaaaatgaccacagattctgaatgagtagctgctctccaccaccatatttccaagctctagaaactcagtgctagagctaaactgagttgttgctattgttttatttagaccacttgaaaccctgaaaatcatcaaaatgcagaaaatcactatgttggttaggtttcctgtggcaggaatatttaaaacaatttaagaaaactcctaaccagaacatgttcagagaattattaacatttttattcagaagtttagatgccattttctgcctcatactccctcattccctccagttcaactcttcctaattaagttttctggccttgccctacccccacctgatcatcatgataaaactaggacataagtattaatacttattaaagcattacaagtattaatatgtctactgttccatttcatggatctactcctactaatgaaggaggagatactaaaaatctaaataagaaattgcttttaaccttgaaaatttagaacattacattatgatatccttgaggttatttgaggaaaaatattatttagtaaactggaaggagtgaaattttttttctaaaggtgtcacaaagaagcaagtaatattggtaataacaattttaataatgtactatctcttataatgaaagatgatgttggtaacccagacaagctaatgggcatatgtttcacactggggtaatacttcactaccagtcacaggaacaaaaagccttttgcaaaactatgtgacaaaattaactatgcagtatgtatcaaagaatactgtggtggttttcaaactatgctattcagaacccttcagagatttagggtaaagcagagtcacattttgaggtgttctgcttcattcggattgatatcttcattcatttatgcatacaataaatacttattaagctatctattacatgcatgcctgtggttgactagcactttctggtatcacacctgtaatatgatagaaacagtccctgctctcagaaagctcagtctagctaaaaataaacacatcaagcaaataatggtagaagtaattaattaatggtcaaaggtacaaacacaatagaaacatgtatagagtgctataaaagaagtctttggtaagtttccttcaccttacgggttttctcataagattttagctgaataaagggtacatgcttccaagtgaccaaaataatgtaagctaacctgacacttatggtattaattaccaaatctaagctctgatgccctattttattgtgtcactttgattcaaaagaaccatacattcaaacgttaaggtatcttaagaatctctgtataccagatactatgttagaagctttagggctataaatatgcattcacttaagaaaatatttcaaaatattggattgaatatttactatgctaggcactggggattaacatttccatgtaataattagtttccagcatttctcagaaaatgtatgtttttccaaatcccaagaaaaatcagtcaagaaatagagaaaaacaggagaaaaaatggcggataggaggtaggactaacttgcagctcccactcggatgtacagagcagcatgtggagactcacactgtgaacttttgctccaagaactaccataggaacatatcaggaaagccaagagaatgcacagaccctttgaagaaggtggattggcaccgcaggctgtgtgggacagcagaggaactgtaagtctactcgctttctcagctgggaggcttgtagcctgaggcaagttctccactctgctcaacggctgcctgaaaataaactcggttctattgggagggcacagtgtgagtgagactggcctttcaggctgtgagttgcgggggagctgggtgaggcctgtggctgccagctttcctccacttccctggcaacctgtgtgagcagcagaggcagccataatccccctgggaacataactccattggcctgggaaccaaactcctttcccccatagcagccacagcaagccacgcacaaggagtctgagctcatacacgcctatatctgccccaacctggtggtgtttctctacccacactggtagctaaaaaaaaggacaatctcttaggagcgctatggccccacccactcccagaccctagggcaagcttgtatcctacctatactactggagctgatgcgctcttgaaagtgccacctcctggtttttggagggcaaccaacacaaaaccagggcacttaaaaatacaaccaaggacccccatagagtccgctttgctcccctgctacacccacaagagcaggtgctggtattcacagctgagagacttgaaaacagatcacatcacaggactcttcgtagacactccccagtaccagcccagagcctggtagctctgctaggagactagattcagaagagaaataaccctcactgcagtttggctctcaggaatccccatcactaggggaagggggagagcaccacatcaagggagcaccctgtggtacaaaaaaatctgaacagcagccccttagtgtcccagatcctccctctgacgtagcttacccagaaaaacaatcctggtaatatggcaaaacaaagttctttaacacccccaaaagttcacactagctcaccagcaatggatccaaaccaagaagaaatctctgaattgtcagaaaaagaattcagaaggtcaattattaaggtaattaaggaggcaccagagaaaggtgatgtccaactaaaagaaataaaaaaaagatacaggatatgaatggaaaaatctccaatgaaataaatagcataaataaaaaacagtcaaaaacttctgaaaatgaaggacacgcttagagaaatgcaaaatgcaccggaaagaatcagcaacagaattgaacaagtagaaaaaaaaaacttcagagctcaaagacaagttttttgtttgtttgttttgttttgttttgttttgagacggagtctcgctctgtcgcccaggatggtgtgcagtggtgcgatctcggctcatgtgcaagctccgcctcctgggttcacgccattctcctgcctcagcctcccgagtagctgggactacaggtgcccaccaccgcgcccagctaatttttttgtatctttagtagagacggggtttcactgtgttagccaggatggcctcgatctcctgacctcatgatccacccatctcggcctcccaaagtgctgggattacaggtgggagccaccactcccggccaagacaaggtttttgaattaacccaatccaacaaagacagagagaaaagaatttttaaaaaggaacaaagcctccaataattttgggattatgttaaccaaacctacgaataattggtgttcccaaggaagaagagaaatctaaaagtttggaaaacatattagatagaaaaattgagaaaaatttccccagcctttctagagatctagacatctaaatacaggaagctcaaagaacacctgggaaattcatcgcaaaaagatcatcacgtaggtacacagtcctcagtttatctaaagtcaagacaaagaaaagaatcttaagagctgtgaggcaaaagcatcaggtaatctataaaggaaaacctatcagattaacatagatttctcagcagaaaccctataagctagaagagactggggttctatctttagcctccttaatcaaaacaattaacagccaagaattttgcatccagcaaaagtaagcttcataaatgaaggaaagatacagtctctttcagaaaaacaaacactgagagaattcaccactaccaagccagcactaaaagaagtgctaaaaggagctctaaatcttgaaacaaatcctctaaatacaccaaaatagaatctccttaaagcataaatctcacagaacctataaaacaataatacaattgaaaaaaaaacccaggtattcaggcaacaaatagcatgatgaataaaatagtacctcacatctcgatactaacattgaatgtaagtggcctaaatgttccacttaaaagatacagaattgcagaatggataagaattcaacaataaagtatctgctgtcttcaagagactcacctgacacataaggactcacataaacttaaggtgaaggggtagaaaaagatattccatgccaatggacaccaaaagtgaacaggagtaactaatatatattcttatattcaatatatattcttatattgcaacagcagtttaaaaacacaaaaagggacattatatattgataaaagaactagtccaacaggaaaacatcacaatcctaaatatatatgcacctaacactggagatcccaaatttatgaaaccattactactagacctaagaaatgagatagacagcaagtcaataacagtgggaaacttcaacactccactgacagcactagacaaaccattaagacaaaaagtcaacaaataaacaatggccttaaactataccctaaaacaaacggacttaacagatatttacagaacattctatgcaacaactgcaaaatatacattctattcatcagcacatggaacattctccaagataggccatatgatagaccacaaaacaagtctcaacaaatttaagaaaactgaaattatagcaagtactctctcaaaccacagtgaaataaaatggaaaatcaactccaaaaggaaccctcaaaaccatggaaatacatggaaattaaataacctgctcctgaatgatcattgtgtcaacaatgaaatcaagatggaaatttaacagttctttgaactgaatgataacagtgacacaacctatcaaaacctctgggatacagcaaaggcagtgctaagaggaaagttcatagcattaaatacctacatcaaaaagtctaaaggagcacaaatagacaatctaaggtcataccttaaggagctagagaaacaagaagcaaccaaaccaaacccagcagaagaaaggaaataaccaaggtcagagcagaactaaatgaaatggaaacaaaacaaaataaaaaatacaaaagataaatgagacaaaaagctggttctttgaaaagataaataaaattaatagaccattagcaagattaatcaagaagagagaagatccaaataagctaagttagaaatgaaatgggagatattacaactgataccacagaaatacaaaagatcatccaaggctactatgaacacctttatgcacataacatagaaaacctagtggacatggataaattcctggaaatatacagccctcctacattaaaccaagaagtagaaactctgaagagaccaataacaagcagtgagattgaaatgctaatttaaaagttaccaaaaaaaaagtccaggaccaatcagacatttaaagaattggtaccaatactactgacattattccaaaagagagaaaaagagggaatcctccataaatcattctatgaagccactatcaccctaacaccaaaaccagaaaaggaagtaacaaaaaaagaaaactacagaccaataaccctgatgaacacggacacaaaaatctgtaacaaaatactagcaaaccaaatccaaaagcatatcaaaaagataatccaccacaatcaagtgggtttcatacgagggatgcggggacggtttaacatatacaagtaaagaaatgtgacacaacacataaacagaattaaaaacaaaaatcacatgatcatctcaatagacacagaaaaagcatttgacaaattccaacatcactttatgactgaaaccctcaacaaaattggcgtaaaagggacataccttaaagtaatgaaagccatctattacaaacccacagccaacattatactgaacaggaaaatgttgaaagcattactgctaagaactggaacatgacaaggatgcccactctcaacacttctattcaacatagtattggaagtcctagccagagcaatcaaacaagagaaagaaataaaggggatccaaattggtaaagaggaagtcaaactgtcactgtttgctgaagacatgattgtatacctagaaaaccttaagactaatctagaaagctcctagaactggtaaatgaattcagcaaagtttctggatacaaaattaatgtacacaaatcagtagccctgctatacatcaacagtttccaagctgagaatcaaatcaagaactcaagcccttttacaatagctgcaaaaaaaataaaataaaatatttaggaatatatctaaccaaggaggtgaaagacttctacaaggaaaactacaaaacactgctgaaagaaatcatagacaacacaaacaaatggaaacatatcccatggtcatggatgggtagaatcaatattgtgaaaatgaccatacggccaatagcaatctacaaattcagtacaattcccatcaaaataccaccatcattcttcacagaactaaaagaaaatcctaaaattaacgtggaaccaaaaaagagcccacataaccaaagcaggactaagcaaaaagaacatacctggaggcatcacattacccaacctcaaactatactaaaaggcaatagtcaccaaaacaacatagtactggtataaaaataggtatataagccaatggaacagaatagagaacccagaaatacacccaaatacttacagccaactgatcttcaacaaatcaaaccaaaacataaataggagaaaagacaccttattcaacaaatggtgccgggataattgactagccacatgtaggagaatgaaactggatccttgtctctcaccttacacaaaaataagctcaagatggatcaaagacttatatctaacatctgaaaccataaaaattctagaagacacattggaaaaacccttctagacatcagcttaggcaaagctttcatgaccaagaacccaaaagcaaacacaacaaaacaaagacaaatagatgggacttaattaaaccaaaaagcttctgcacagcaaaaaagataatcatcagagaaaagtgacaacccacagagtgggagacaatcttcacaatctatacatccaacaaaggaccaatatccaaaatttacaaggaactcaagcaaatcagcaagaaaaaaacaaataatcccatcaaaaagtgggctaaggacataaacagacaattctcaaaagaagatatacaaatggccaacaaacatacaaaaaaatgctcaacatcactaatgaccagagaaatgcaaatcaataccaccttactcctgcaagaatggccataatcaaaaaatcaaaaaaataatagatggtggtgtggatgtggtaaaaatggaacacttttacactgttggtgggaatgtaaactagtacaagcactatggaaaacagtatggagattccttgaagaactaaaagtagctccaccatttgatccaggagtccaactcctgggtatctacccagagaaaaagaagtcattatacgaaaaagatacttgcacactgatgtttatagcagcacaatttgcagttgcaaaaatatagaattagctcaaatgcccatcagtcaacaagtggataaagaaaatgtggtaaatatatataccacggaatactactcagcaataaaagggaacaaaataatggcattcacagcaacctgaatggagttggagaccattattttaagtgaagtaactcaggaatgaaaaaccagacactatatgttctcattcataagtgggagctaagctatgaggaaacaaaggcctaagaatgatacaatggactttgggaactcggggaaagagggggcgggtgagggatataagactacacactgggtacagcgtacactcctccagtggtgggtgcgccaaaatctcagaaatctccactgaagaacttattcatgcacataaataaataaataataaaagaaatagggaaaaccagaaccagtaaaagtactataattctcttgtgaggattgaagcttaataacatggagacattactggttcaaaggaatatactgatgtaaagttgaaagcaagagcagataatattgacacatggagtagaacactgaagttccagtaaccaaggaaggtgaacataggagagaagttgtcacatttaatcagttagtcttattgtggctgttgcagagttatatgtgagtattcatggcattgcatgctgctaacagtgaagaactcttgcaagtaaaataaacattaacaagtttacacgcataatatactttatgcaaatccactgagtggtgttccaagaaatgacaagttttggaagcaaagtaagcccttacattgacaagtttgacatataattctttgaggtactgttagctttgctaggagatctgaatgttatgtaattcaaatactacccaatcacttttgactggtgttttctagtgtctgaatattcactacaggctacagttctctataactattattaaacttcatatttctcatatattaaacaaaatgttagatatttaaaataatgagcaaagcatataaaaactgttgaaagttttttgttttgtttttgtttttttttttgagacagagtcttgctctgtcacccaggctggagtgcagtggcacaatctcggctcactgcaacctctgcctcccaggttcaagcgattctcctgcctcagcctcctgagtagctgggattagaggtacctgccaccacgcctggctaatttttatatgttttagtagatacagggtttcatcatgttggccaggctggtcttgaactcctgacctcagatgaactgcctaccttggcctcccaaagtgctgggattacaggcatgggccaccgcgcccggccgaaagtatttttaaaacaacttacaatttcaggaattcccagaaattctcaagaattactacttctcatttctgaatcccaaagattaatatttattgggaattgggaaatactacttgagataaaagttgactaagagaacttccctgcctctttgaagtttaggagagagatgaaaacatggaaaccaaaaaaagtattaaaggtgttaagataaaattctatttaggacacagtgaagacacaaaggcaaaagacacagagcaattatgcccacagaggtctggagaaggctttacagcaaagaacatgagatcttgagtggtgtcctaaaaggcaaaaactaccttctagataaaataaagggagatatgagactgctaacaggccatacagagggaagactgctgaggctggggtcatgaaacatcatgggttgttcagcaaacatttagtagtttagggaggaaggtggagtttgatgggagacaggaagaacagaaagggatttaattcagggaagatcttctaatgaaaggaaaagtctcccaagaatcttaagtagttgactgacatgatcagatttatattttttagaaagatccctctggaggacacatggaggatgggttcaaagtgtgtgagactagagattagtactgcaacagttaggtgcatccctaaacaatacaactccatacattgttaaagacccacacatacccaacacactgcagggtagaaacctgtaagaggaattgggaatgaaagtgaatactaagtctaatgggtaaaataacaagattttaaaacagagagtaaggcagtcatgatgcttgttgattgtatcatgaactgaagagtataataaactcaagccactgtagctgaggtacctaggaacaaacaaatgaaaggatggctatatctttcctactgataaattaaactacatttgccccaaggctgcctccatactttgagtcctatgtaaagaactacaacccaaattagtacataaactcaggaaaagctaattagaagtatacttttgtaacaaatatctgagtctcagccaatcacagcagctgagctttagtctatcacaagcagccaactgatcagaccatgttcaaataaggcaaatgcctagctaaaataaatcaggctgttcctgtacctcgcttctgtgttctgtccataaatgcagcttgcccaggtctcagagcagaaccctctgaacctcttctggttctgagggctgcacaattataatgcaaatcattctttgctcaaattaactgttaaatgtaatttgtctaaagtttttcttttaacactattcttttcatataatcacatgaaataagagaagaaaatcaatggtagaaaaattcccttgtacagtaaatcaaattgttaagaagtgtaatttctttaaaaagatatatctagttactctatcactgactctcaaataatctgtagaactttattcattttctaaagagtcttgttaccctcatgatccgtatcaacctgcaattcaaaatatcatagaattgatagaattgttttgtctatcagtaattgtcttcatggttatatttttttcagattatatttgggaaaagctacttattagaggaatatctacgaataataatcagtctttcacaagcccaaaagctctgatatctccctccctcatgatcccattgctgttgatagtgttatgcagattttgtaaacaattaaatctgttcgcatgcaaacaattttggtttaaccatgaacaacaataaagaagttcatatacttcttttatgtaattcacgatctacccatgctccttttaaaagcatactaatatatcctattatgtattccaaagctgttatacgaaagtgaatgttcttttcaaaattctttttgacatgccactggagcagctccagaaaaaaattaacacttttggggaattttattgcatccctttcagtagccaaaaaggaagcgggtggggcgggggtggggggctgaagccaaagattaaaataaatgcataattcatttttaacatggtaggttttctctcattcttcattgtaatagctctagaactaattttactgttaacactgaatttttagaggggtgttgtataaaccattttttacaaagaaggagactaaaaagattttctgctcaccatcagtgcacaaaattgaacaagtgaaaatcttcacacacaatatgcttccaatgagcatgctcttatgcatcaaagaggaaacaaagcatttcaggattatgtttgtaaaaggattgtttttgaaaaaaataaaaaagcatagagcaaatttcagagtggaaaaacatcaaaggcttttcaatagtcaaactcatcactagatttaaggcaacatttaaagcaagacatctgtgttatttatataatatcaaaaagaaaaagcacaaaggtagactcaagacaaataaagaatccacctcctatgctataaaatacttcttatgtttgtctctctaacagtatgctattattctagcaaggcaaatatgttcttaaaagggtatcatgttttgtatgatgctgatgagcgcagctttttcatgtgtcttgcttaatgcagctaaatactacgaatgctattcagttatcaaagatacaaagaaccattcaagtttaggaaattactagactctttcttacagaaacacaaattattataatgtattgttttcatcttcctgcccaatatccaaactttataatccattctatttttctctcacattgtaccatgagacacttttactgcgagcagtaagtatgagaatgcaaaatctagggaggggtgaaaagaagtaaaagaacaacaatgtaaaggaggggaagctgacatggagaaggaaaaataggattcaacactcttggattcagttattaattcttaacaaatgtccccagggagctcacccagtatttctagaccagatggaaaaaacagtatgctacagcaactctatccctagacccagctgtcatgaggaatagagaggcaatcccagtaaggaactaacatctaacaccatacttcatgtgtgctgcgccattcatatacaggctgaccttaagatggtgactgttttgtttgttggttggtttttgttttgttttgctggcttcttatgtatgtgcctctgttttttatatcaatccttgacctctctccaaagtccaatcatgcatttccaggccctgccaatgatctcctttgtacctttaagtcaacattccccaaaaccattcattttctcctaaacctgaaaaaaagaaaaaaactccaccacttgactttttccctgtggctggcaacaccattctctcaatccttcaagcattacattttaaaatgataactgagttttccttctctctcttcatcatatcaagatcttgctggccaggcacagtggcccacacccgtaatcccagcactttgggaggccaaggcaggtggatcacgaagtcaggagattgagaccatcctggctaacacggtgaaatcccatttctactaagaatacaaaaaattagccgggcgtggtggcacacacctgtagtcccagctactcaagaggctgaggcaagagaattgcttgaacccaggagacagaggttgcagtgagccaagattgcaccactgcactccagcctgggtgacagagcaagacaccgtctcaaaaaaataaaaaaaaaaattcttgccaaattatatagcctaatagcaaaatatttgtcaaaagtcgatccccttggccaagcgtggtggctcacgcctgtaatcccagcactttgggatgccgaggctggaggatcacaaggtcaggagatagaaactatcctggccaacatagtgaaactccttctctactaaaatacagaaattagctgggcgtggtggcacatgcctatcatcccagctattcaggaggctgaggcaggagaatcacttgaaccagggagtcagaggttgagttggaggttgcagtgagccgagatcacgccagagcactccagcctggcaacagagcgagactacatctcaaaaaaaaaaaaaaaaaaaaaagtagaacccctcttttccaattttgttatgtaattccatcccaaagtttggattacccaggcctctcacttaaatggtcacaaacacctaactggtctccccaccttcaatctctttatccccaattcattatatccactgctattaaattaatattcctatggcacaactgtgatcctcctcctccaattctcaaaaatctttagtgaattcacaattattgaaaatatttaaaatcttttagccatgaaaatcaaaggttttcatgatctcacctcaatctcacttttcaaaatgatctcacacaatctccttcatatactccatgtttgaaccactggactacatattattaagtgaaatgtacctgagcttgcacatcttgtgtctttattcacactaatcttccctccttgtttgctgtgatagggactgtgctagatagtatgatacaaagatgaataatagatcttatataggttctaagcttcttagagaagcatgagctttggaattagataggactggggtctgaattcagattctgcaattgccagctgtctgatttggggcaagctcttaacctgagagacagctttttgagctgtgaaatgatataataacatctaccttggaaagttgccaggatataaattacatattttaaaagcatgatatggtgtcttccatttaggtaagtcttccttctgaaataccaacattagcttccccaagcagaatgcactgatgacaataatgagttagctgtcacctgcaaagatcctgagttagtacagacagagaacaattgcagctttcctctactccttttcttccttgcagagacaaatgagggtgacctcacagtttatgcctcgtaacgtttgcctagtgatcttttccattctccaacaccatccaggcaataagcatcaatgttaatgagctgctggacagctttgtgaaactgactgaaagagccagataggtattggtgtcctacacatgcaaataatatactttcccttcaaatgtactatttttatataagtttcaaaagttacatcctggtggaatgacagtacccaactgaaatatgttttccactctatgttactgcttacttcaacgggaaaagaatatatttacactttgccatattatgtaaacatggaaaactgagctaactagtgtcatgttattaattgactccagtgatattttagcatcctttatagattggccccctggactcgtaactgcccgtaatccaagtatgtatatgtgaaataacctcaggggtcggtgggagggggaaaggggttatttacacagtgtttgaagaagtgcaacacttgcagtttcaattccagaagtagtaggtaccgaggcatcctggatagactgtaaaagagtagtcaagaaatcctggcagttatcaatgactagaagccaagtaaaagctgcaagtcataattgctggaaatttgtttacatgcaacagtattttcaagggaaagtaagaagcagagggaaaagggcttgatatagagcagacatccgaacccaagtacttaatagtaggaggaaaaagaaggctgaaactagcttagaagccatctaaaaaagaaatatttagttggtctttatttacactaaattagaaaaaattttacttaaacctatgcctcagtctaaatttcccagtgaacatttgtggagatttggctatctagaatccatttcttccttctttgggcaacagcatccttatttcattttagagaattccctcctctctattgtatccagtcttggtggtgctacaagtcaacatgccctgtgctcctctaaccagtaatcatccaagctatgccagtaagactctccaaaatttaaatctaaagtggagtagcttaagaatggaaaaggataaagtcccagaaatagcgctccaacaaaactattgtgagtatcttgctgttcagaaaccgtaagcctggtcactagcttttaccttaattctgctgactacccaataatctttcaataaattcctttctgcttccttaactagacttggttcctattgttggcagcctaagaagccctgataaggaattaaagccattttgcctaactttgtccctggtctttccaaatgaaaactacaaatatttgaaaacaaaactaccctatagtttgttgaacggtgtttttatggctctattacagaagtatccagcatacttgcatttttcaagcacacaaaacttaaagggggcatttttgtttacttttcctacctcattttcagcagtattcactctattcccactgtttcctgccacgcttccccattacacgattttcttcataattgggccaaggtttactctagtaacattagctgtattgatttatttgtacatttgctgtctcgagaacttaagtaatttgagtagctcatattattgtttacatgttcaattatcttgtacttcttaacattttcaatgccattgcctttattctagtatcttttcacaaatatgcattactgtattaagtacaatgtgtccaaaattaattgttaaaggtatgataccagtatttgttcccccaggactcttcgatgaaataaatcagtaaaagaaaatctaaatgtataatttataaatttatagaaattgagaaatctgaaaaatgtagtgatcacctaatctaaggccataattttatagataagggaataggtctccctaggccattatccttgattccaacatctccattgatttattttgggttttatgtgttttctgtcattgcaaggggttcagggaaaaagatagcaactgtgtatgtccggtaatccctcttaaacaagaggaaaaagggaaataatctgacatcccaacttaaatcaggggcaccagtaatctcacagtaatttaaaggtcaaagtttacagttatcttaaatttttatttaaatctccttcctattcacctggccactgtaaagattaaatgaaagtaatttgtagactataaaatgttatatgagtcaagattttgttaatattgctattcttcatcctttcccttcccacggcacaaacatagagccattatggccttacatcaaaattataacacaaaccaataaagcccccatcccctccccattgcaacccatcctataagacaactttttgtactagactttcaattctttcaaacttttaagaaataaataacaccaattatatcagtctattttcacactgttgatgaagacatacccgagactgggaaatttataaagaaaaagaggtttaacggactcacagctccacgtggctaggaaggcctcacaatcatggtagagggcgaaaggcatgttgtcttacatggcagcaggcaagagagagaatgagagccaagcaaaaagagtttccccttataaaaccatcagatctcacaagacttactcactaccacgggaacagtatgtgggaaaccacccccatgattaaattctctcccaccgggtacctcacacaatacttgggaattatgggagctacaattcaagatgagacttgagtggggacacagccagatcataccaccaacattacacctactcttccagagaacaggaaaatataaaacacttccaaatgtgtgttgttgttgttgttgttgtttgaagccaggatagtattaatatcgcagcctcacaagaacattgcaaaaaagcaaagtcaaaagcaaatcctaatcgtgaacatgagtacaaaacacctgaacaaaatttcagcaaatcaaatcctgcgatatatagaaaggataataaaccatgatcaagctgggtctattctaataatgtaatatcatttactacagtaacaggatgagggagaaaaatcatatgattatctcaatagatgcagaaaaagcactctataaaattcaacaccaattaatgatttttaaaaaagaaactagcaaactggcaataaaatgaaactgccttggactgataaagcaaatccaaagaattcaaaagtcaggatagtggttgtcctttgggagtagtaaatggaatgagtaagaaaagagcttcagaagagctaatttctttatctgaatgcttaaaacccaaacgtggcaagttcatgagaatttactgagctgtacaaatacagtatgagcactttcttctatgtatattatacttcaacaataaaaaaacctatagcagtcatacttaattatgaaataataaaagttttcttcttgaaattggaaattacacaagcatgccactaacaccattgttcttcaacaatttattggagatcctaggcagtgcaataagaaaaagaaatagaagacatgaaggacgacaagaaagaaatttcatgcagaaaaccccaaaataatctatggataaagtattagaataaaaatacatagcaagattattggatttcaggtcaaaatagaaaatcaactgtttctatatatcagcagttaaaaaaaaagtttttaaatgacaccatttataacattaaaaatatccaacacttcggaaactaatggaagatatgcaaggtccttacagagaacactataaaacattattttaaaaatttaaggaagaggccgggtgtggtggctcaaacctgtaatcccagcattttgggaggccgaggcgggcagatcatttgagatcaggagttcgagaccagcctggccaacatggcgaaatcctgtctctactaacaatacaaaaatagccgggcatggtggcaggctcctgtaatcccagctacttgggaggctaaggcatgagaatagcttgaactcgggaggcagaggttgtagcgagtggagattgcgccactgcaatccagcctaggtaacaaaatgagagtctgtctcaaaaaataaataaataaattttaaggaagaaataaatggagagatatatcatgctgatgaaagagaaaatactgaaaatgtcaatttctccaaattgttctatagattcaatgtgattccaatcaaagtcccagcagaatttttgtggaaattgacaagatgattataaaaattaatataaaaaaatcaagagaattttgaagaagtgggaggaggtacaccatcagacaactagaataattaagacagtatggtattggcacaaagataaatgcatgaaccaatgaaacagaagagggtgcaaaatagactcatacatatattttaaaagattgggctgggcacggtggctcacgcctgtaatcccagcactttgggaggctgaggcaggaggatcacctgaggttgggagtttgagaccagcctgaccaacatggagaaacccatctctactaaaaataataataatacaaaattagccaggcgtgctggagcatgcctataatcccagctactcgggaggctgaggcaggagaatcacttgaacccgagaggcaaaggttgtggtgggccaagatcgcgccattgcactccagcctgggcaacaagagtgaaactttgtctcaaaaaaaaaaaaaaattgtactgcagagccacagagaaacaatgatcttttcaacaagtggtgctggttcaaataaatatcaatagcaaaaaatgaaaactgctatatgcctcacatcatataaaaaaagaactcctaatagatctatgaaaaaataataaaatatcttaaaagtttacataaatgaataactcatgacctttatataagcaaaattttctttttctgtcctttaatttcaacttttttttcttgctttttttataatttcaacttttattttagattcggggtagatgtacagatttattacacagatatattgtgtgatgttgagaattagggtacaactgatcctatcactcaggtagtgagcatagtattcgatagtttttcaactcttgctccgccgtcactcccctttctagtagtccccagtttctattgttgcaatctctacgtccatgagtacctaatgtttagctcccacctataagtgagaacctgtggtatttggttttctgctcctgcattaattcacttgggataatgtcctccagctacatccatgttgctgtaaaggacatgatttcaatcttttttatggctgtatagtattccactgtatatacgtatattttctttatccaatccaccattgacaggcacctcggttgattccatgtctttactattgtgaatactactgaaatgaacatatgattgcatgttctttttggtagaacaatttattttcttttggatatagacccagtaatgtgattgttgagtcaaatgatagttctaagatatttgagaaatatcccacctccacaatggttgaactaatttacattcctaccaacagtatgtaagtgttcccttttctccacagccttgccagcatctgttgttttttgacttcttaataacagccattctgagagatggtactcattgtggttttgatttgaatttctctgatgattagttatttgagcattttttcatatacttgttggtcacttgaatgtcttcttttgagaattgtctgttcttgtattttgctcactttttagaagggatatttggtttttgctttttgaaatgtttaagttccttatagattttggatattaaacatttgtcagatgtatagcttgtgaatattttctcccattccataggttgtctgtttactctgttgatagtttctcttgctgtgtagaagctctttagtttttaaattaggtcctactcgtcaatttttatttttgttgcaattgcttttgagacttagtcataaattctttcccaaggccaatgtccaagatactgtttccaatgttttcttctaatatttttatagtttgaggtcttacatttaaatctttaatctgtcttaatttttgtatatggtgaaaggtaggggtccagtttcattcttctgcatatagctagctggctatcccagcactatttgttgaatagggagtcctttccccattgcttatttttgttgaagatcagatggttgtaggtgtgtggcttcatttctgggttctctattctgtcccattggtctatgtgtctgtttttgttctagtaccatgctgtcttggttaccgtagacttatggtatagtgtgaactccaataatgtgatgactctggctttgttctttttgcttacgattgctttggctatttgggctctttttttagttccacatgaattttagaatagtcttttctaattctgtgaaaaatgacgttggtagtttgataggaatagtattgaatctgtagactgctttgggaagtatggccattttaataatattgattcttccaatccatgagcatggaatttttttccaatgtttgtgtcatctataatttctttcagcagtgtttagtagttctccttgtagaaatatttcacctccttgattagcagtattcctaggtattttgtttttgtgtgtgtagctattgtaagtgaaattgtgttcttgatttggccttcagcttgtacattattggtgtatagaaatgttactgatctttccacattgatttcatatcctgaaactataatgaagtcatttattaattccaggagccttggtgcagtcttacaatgttctaggtatagaatcatatcaccagcaaggagagacagtttgacttctttttttcctatttggataccttgtatttctttctcttgtctgactgttctaactaggacttcaaaattttcttaaattgaatacaaaaaacactaactacaaatgaaaagattgataacttgcattagctaaaattaacaactattattcgtcaaagacaacattagaaagtaataaggcaaaccacagatgggaaaaaacatatgtactaggatggctaaaattaaaaagattatcaataccaaatgttttggataagaactactcatgtatttccaggcggagtataaattttttacagccactctggaaaaatatgcatacactataacctagcaataccatttttagatataacagaaatgtgtatgtatgtgcatgtgtgtgtataccagttagaaagaagcatgagggtgtttcttagtactggtaatgttctgtttcttattctagatggtacttgcataggtcttttgcttcataataattcataaagctgtatacttacagtcagtgcccttttctgtatgtatgatatacttcaatttttttaatcaggggaaaaataaggagagaaaatcaccaatgtgaaacaaatatcagaaatgcccatccaggaacctgaaatcatttctcactggcacaaacactacccagtgataaaataaggacttgatatttagacaacaacaaaaacctgatgtttcagtttatctatacagccttagtaaatgtaagtatgtaatttcattaagctttctgaaatgctaaaaacaattttaaagattcttattgtttttgtgtacccttttgtattcacagatcccagattagaaattagtgccctagtctgaaaagaaggatcaccagacaaaaatattcagtaaatgttgcctcttctctttataatctatatgttaggtttacactgaaaactatctctttagggaaattatatagatacaccaatcctaagtaaacatttttaaataaaatgatgagggtcttattctcaattgtttccaacactagatacattataaaaagaagttttgtccctataacccccaaatctatgttctttgttaatcagtgtgtcacagttcaaatcttaatcacatccaaaattttgtgaccttgggcaaatttcttaatctgtgtttcaatttccatatctggagaatggggatgatgtgactaatacctacctcatagggctattgtgaagattaaatgcaataatgcatgtcaatcacttagcactgtgtctaaatgttaggctattattattatcaccatcatttttgcctatttatttattttttaaagtaaaacactaaattgctgattacaaatttgtgagcatgaggaagactgttgacataagggcttcattctcagtgatcatgttaggaagtaaccttgtactgggggatttctagatatcagtatatgaagtcttctttggagccactcgattctttcaaagaagaatacatttttctcctaacctggaaagtgctgtctagttgatgatgctgtgcaaaggaacaggaagaggagtttaactgctccatagatcaactttctacctatccctttgtttactgcttaaagactcattccctaccctcagctctacctcgtagttccaagcccttcaaatatttaaagatagccgttattttattctgagtcttctcttctccagttagacatacccatctcctttaactatttacagaccattctctttcatcatcagtatattcattcaaatctctgttattgtgatggttaattttatgtgtcaactgggctaggccacagtacccagatatttgatcaaagattccatgatggcaatttttaaatgagaataacactaaatcagtagactttaagtaaagcagattgccctctgcaatctaggtaggcctcgttcaatcagttgaaggccttaacagtctgacctccctaaaggaaaaggggattccaccagcagaccacctttggactggaactgcaagtcttccctgagtctcctgcatgctggtatgctctgcagattttggacttgccaaatctccataatcttgtgtgccaattccttaaaataaataaatctctctctctctctctctcacatatatatatatatatatcctgttggttctgtttctctggagaaccttgactaaaacagctatgcttcaggaatacaagtagaaaacactacctacctttgtggatatgccagtctaacctcactttattatatccaaataactcttaaaactgtttctaggtcacatggacctatgcaatcagaccaatgcaatttgaccataatatagaataaataaactgcaatttcacctccctaatataattattttaccgcaaccaaagagcaacctaatccacatcactgcttatattgagtttaccataataaaatccccaaaaacttcccacaagaactgttacagctcaccaattctgtatttgtgaattgttttggggggcctgcacataatacctaacattttttcctactaaattttatcctctgaaatttagtttttcattgactgctgtcaagatattttggattccagattctgtcatttcaatacatttacaaatactctcagctccatactaatgaaatattagtctttatcaaactaaaagaggcatagctaagatcaagagaagtctctgacatcatcaactataaacaaagcctgaattcaaataatactgacatacatatgctgctattaaaattctcagggagtattagatatgcaaggaaggtgggacatatgctgctccagacaggcctggtgtcaactgctgtctctaaacttacaagttttataactggacaatttgcttattcctcaaagagtttcaatttccttttcaataaaatggtaaagataaaacttacatcacaagactggtgtgatgttcaaaatacacataaagcacttgacagaatgcctaatacattgcaaatacttgacatgtgtctactttgaagcacgtattatagtaagaactcagcaaaggtgagatacattcctgcttcatcactttcccttggatcaactataacctaaataacttaacctctcctggccttggggtaaagaggtagacagagggggagagaggcagatggaagaataaagttgctgcatgaagttgctacctaaagagactattttaaaggctgagaatcctttaaaagatatcaaatagtttagaaagatgctttgacttgggctgttagaaaactgcagcttctagtcagaaaagaataaatgcagtgatgtttgggatttggttaaacatttaaattgcatttcaaaatgttggatttggcaaaatttaaaataaattttgccaagtccttaagttttttacttgcatgtattcaagggaaagccagcttgtagatttgaatcatttagatttaactcattaaaatgtatagagtgctttatcaagccacaaaaattgtgccccaaatcatttacagtttaacttagaaaaaaaaaagtcttatataaaccacagctcttgtacactaagttgctgagacttagaagaaaagattaactcagaaagacctcaagaaagaaagaaattttgaagaagtaatgaaaggagtggaatagcactgaatgcacaggaaatggaaaaccattccaaggatgcagacagaagtgatattacataatagctgacacagactatatgcaaatttcagtgattggattttgacttaaagatattttcctgaaatgtctggaagaacaatgggactttgggggcatccataaaattataatcaagatctattcagcagatgtttactgtgtgtctccacgtgcaaagctctctaacaagcactgagaaacaatgctgaatgggacagacatgtccttgccttttggaagcttacagtctattgacaaaatagacttttttatgtgaaaacagaaaataataagggctaggaagtatcaagatgtaggaagcagtcgcattatacacggattttaaggtgtaacataaaagaatcatacattttcaatttcttagggactttgaagttcatcagtccagtttttccaagaggaatccaagacagcaatatgtaaactgcttcgattgaggtagggggcaaaaggaaaagcaaagccagacctggacacaggtgtcctaactctatatcaaacatccattccttcattcaacttttacgtgatatttactatgattaggcactgtgctaagtgctgcagaaaaggtaaaaattaaaaacacctctccctaacatggtcctggaagagagataagtatgaaaataaacaatccccaaaagataaatgatgtaacagaaaaattgcacaaagttgtgcagcacccaaaagcaagaccctctctgcttaggaagacaatggtggctttacatcagccaaatcatataaaatgagtaggattttcccaggaacataaaaagaagagaattcaagaaagaagaaagaggccaggcgcagtggctcacgcctgtaatcctagcactttgggaggccgaggcaggcgtatcatttgaggtcaggagttcaaaaccagcctggccaatatggtgaaatctcgtctctactaaaaaatatatatacaaaaaaattagccgggagtggtggcgtgcctgtagtcccagctactcgggaggctgaggcaggagaattgcttgaacccgggaggcagaggttgcagtaagccaagatcatgccactacattccagactgggcgacagagtgacactgcttctcacaaaaaaaaaaaaagagagagagaggaaagaaactgtgcaaagaacactgtatgtttggaaaagtataagtataaaaagtatgagttcttttacttctgagctttttttcttaattagttttatcaaagtaatacatgcacatagtcagatggtgcaaaaagactcgaaacacagcagtcctgtggccacccttctgctggttacactaccatcaaggttctctcagtcccagatgcaaccatgttaaattggtttagctgctgcttctggcatttagcgccatgcttctaaatcacgtgtgtctatactgatatactggtatcctacacagtataagaactttcacctcatacccacttcacccccccaccccagtccccaatatggttgaaacataatgtggggtgatatccataattgtagttataatgactaagtaaatattgcttgctgattaaggtattatactctgactatatttcctctctgtgataccttttcctttttctaatgttgatttgcatgtacttgattgttctcttctactctctggtttaatcttcccccacattccaatggctctaaagccatttctaaataccatttttcttatagtcaaacctatcagataatctatttttccccatgattatgccccctagaaatctgcccctgtactcaccccttggcctgtcctaggaattccttctgtctatggtgtaaaccaagaaataggaagcctccaaatctaggaaacataggctctaacaatctcactttgatagaacccacattctactagcttcctgagaaagaatgcatgagaggtaaatttattttcatacatttgtcagtcatccttgactgatattttaacaatgtaaacaattcaaggttgaaaattgctttccttcataattattatcttctagtttctagcgttgatttgtggggcttttcggcttctcaaagtatgagttaggattgtgtttagttgtaggtaaaataaaatccaacaagttataacttagccaaatagggaacctgaccaggtgctgaccacacctgtaatcccaactctttgggaggccaaggtgagtggatctgctttgagcacaggagtttgagaccagcctgggcaacatggcgaaaccccatctctaccaaaaatacaaaaattagccagacattggtggcttgctcctgtagtcccagctacatggaaggctgaggctggacagtcatttgagcccaggaagtggagggtgcaatcagatcactccactgcactccagcctgggtgacagagtgagaccctgtctcaaaacaaacaaacaacaacaaacaaatagacaacctcccacccccaatgtaacaagaaatccagagacaggtagttgctgaaattgattcagcagttcaggtatatcagagctgagaactctgtgattctcatggtcgcaaaatactgtagctccagacatcttgttcaggtttcaaatgagaaaaagtagaagagaaaggagaagattcaacagatttccacttacattttatgggccagcactttaccacacttggtcatatctaactacaaaggaattgaaaaaagtaagcttttagctttccggcctctacaatgaagaaaagcaagggttgaaagagacaaactggaatatgagataacattacaatgtgctttggtgtgcgtcttttcaaaaatcttttgtgctgggcactctttgagtccttctaagtttgaaacacatattttcagtcctagcaattttccttttaaaatttagttgatagttttatcctttttgttttttcattctctctggagagctcctaaaagtcaaaggttgaacttctgatactgatcatctatcttttttctcctatttcccatctcattatctttcacttcttttttattttaagttccgggatacatgtgctgaatgtgcaggtttgttacattggtattattttttacttcttttttaggagacttcctcatctgcatttaacccttttattgaatattttatttcttaagtgctttcttactctcttattcttccttttctatagtattatgtttttattttatggttgcaaaatcttctcatctttctgagggtactgattataattccttgaagttttcttctttttcctgacagtctttcttctgagctttattttgttattgttattgtttatttctttgttagttttgatctcttttcctgttggagtttctccttaattgactggtgataattgattctgtgtcatatctaagaatgaggtactagaagggtgactagaagctgcgtgcatgtggccaaagcttaatgagtagtaagctttactaaaggacaatcaggaagcccgttagtttcctcatcagggaagcccacatgtcagtatctacagagtttttctctgaagcatgttatcccttcagagaaggatcacctatctgaagaggtgttaagagagaaaggcagttataagccttgctgctactgttgtagaactcagcacaggaaggcagctagaagtctcaccattatgcagatcacttaattcccctcactcctatcctccctactttgcagtctctcaggttcagttcttcacagattatacgtttcatatgcagcagagacagggaagtggcagttgttagtgcctagtagggatgactgaaaaatataattaattttaaacaattcttttgtttgtatgccacccacatcatctctccctcacaatcacactccaacttccataatacctaatttctgattcctaagcctatctcagattctgcaggatgaatcagtttgtttatcattggtatatccctctgcagataattagattttacattcttgctgctaagttatctacaattcttccatatgctttcaattttcctatactacagatgaaggttagagaaatctagttttcctaaagatggaaagtacctgttgcttttgtttgtttgtttgttttaagtgatttctagtaaagaagtactttttctgccattttgaaacaggtaagtctctaattatgaatttaaaacttgaagacattgatagatatgaacaaaatatgctccagagcaaaactctacccattaacaaccagatcatgcacgaccagattagaatggccattatattgttggttatccccattctggtaatatgacgtagcagctaagagcatgagctctgaggtcagattgcctagccttaaatcctgtctctaccactttacaagatgcataatcttgcacacattctgtttatattatcctcttgacctgaaaaaatgtagagtgatgatgaggattaagtgaacaaaatgcctggcacacaagtattcaatatatacaaactactattattaactccaacagatcaaattttccaaagtagtgagagtaatatgcactaagcgccttacagatattaacttactgaatcctgaaaacaatactatgaggtagggatatcaccgtgccaattttataaaagataaaactgatagatgaacaggttaaataacttgcccaaggtcacacggccaaaagtagataacagggattcaatctgaagaaatctggttccatcgtctttgatcttaaccacttacaatacacagcccaaggatagcatcattcaaatttgagtccccaggttctctctagctctcttatggaatgccaagtaagttatattcggtaccacagactaacttaaaggaagatttcaaaacgacactgcaaaatttggaccaaattatttctccatttaactgccttctatgtacaggtagtagtatagaatagttgtgtacatgtgatgctcatttccataatgagtaaaggacataaaacataaaaatatcatgcagtttttaggcctattgctcccaaatcattcactctgattatatcctttattacagggaaatgtgttttctaagtctatcttctttgcatggattgaaagatttgtgaaactgaaaactaaccttcctctgccaagagccccatcaagacagaagttcttaattaactaagcaattagtcataacaagtgaaagctaaaatggagcatgaatacataatttgctgattatttttctccactagaacccttagccagaatttaacaaaaagtgttctgtgggtgctagttttgggaaggatggtaaaacctggacagaatgcactgaacagctatttgagggctccaaagagtaaagaattgcagatggattggagaagaccagaattcaaagtatcagcagtgcgtttcttgtttttccttagtatcccccagtctggtgtctacacctggtacaccaaaaccaggagtagacaccagcatacaaacagagagatttccagagaagtcctctagctctggctcaacaggtaggaaaacaaagagatttctaacactcagagagagtgggggaaattccaggtttttctcttatatcatcattattacttatgttttctctctttcatgcctcagtctccaggccatcctgtggcagtggcagcagcaacaatggcaagcaatggagtgattcacaggtgcctgaaacttggatagaagtgtagtccacaagagagaggcaaactcctactgctttttctctctatctctgtttacctacctcttgaacctaaacatgggtacaactacaggatgtgtgtggcagagcaggataactaaaactccagtttgtggccaaggaaccaaaaaatactggggatattgcggagaaagggttgggatatgagcccgtcctgagctgcacatacagagatatgatcttgaacacctaacaaagacttgagaaatgaattaaactactgaccactacccagatctcagactggctgcttggttgcaaatatgtgggacagagcaaaagagcatcacagagcgtttgaaaacgaattgacactgaaaccacaagccactgaaggctgatcagaccttacaacctgaattctctgggttgattgcatgctaaaataaaaatatcaacattcaccataggatgtaaataagacccagagtctcataacatgatattcaaaatgttcagaatataatacaaaattactcagcattacaaagagccagaaaaatttcaaattacatagaggaagaaatttcacagacatcaatgccaagatgatacatatgttagaattacctgacaaagatgtcaaagcagctattaaaaacactcttgaaataaatagaaagtttcagcaaggaaatagaagacgtgaagaagaaccaaatggaaaatttagaactgaaaaatgcaatagcaaaactttgaaaactcactgaatgagttctgtaacagaataaaaatgacaaagtatcaataaacttgaaagcagatcagtataaattatccaatctaaacaacatagagaaaaatactttaaaaaataaataagagcctcaggacctgtaggacaatatcacaatgcctaatatgtatatcatcccagtcccagaaggagagaagagagagtatagtacaaagaaaaacaatgtaattgctaaaaactgaccaaatttgccaaatgacataaacccagaaattcaaaaagttcagtgaactccaaaaagaataaaccccaaaatacccatacctagacatatgataatcaaacttctaaaaattacagaaaataatgttggaaagtaaccaaagaaaaatgatgcattacttacagggaagcaatgatttcaaagtctgaggatccctcatcagaagtgggagctaagctatgaggaaacaaaggcataagagtgatataatggactatagagacttgcgggaaagggtggggaagggggtgaaggataaaagacaacacaatgggtgcagtgtacactgcttgggtgatgggtgcactaaaatctcagaaatcaccacctaaagaacttatccatgtaatcaaacaccacctgttcccccaaaactactgaaatcataagaagaaaaataattttttttaaaaaagaagtcatggaggccagaagaaagtgcactcatttttaaagcactgagaaaaaggaaccatgaaaccagaattctgtatctagcaaaaatactcttcaggactaacaatgagataaagacattcttacatgaagaaacactaagagaattttcattagcaacagacttctctacaagaatgactaaaagaaagttcttcagccagaagataatgatgccatatgcaaatgtggaacatcagaaaggaagagagaacaacaggaatggtaaatttctgggtaaatataatagactattctttcaccctgagtcatttagagtatgtttaacagttaagagcaaaaaacagagcattgtctgatgagattttcaatgtgcaaacagagtccaaaactaggcctacaaaagtatgatcaatgggtttttgacgaaggtacaaaggcaattcaatggagatatgatagttttttccataagaggtgttggaacaaatggacgtttcgaagcaaaaaaacaaacaaacaaaaaaagaacctcacgcattatacagaacttatcttaaaagagaacatagacataaacataaaacataaaactaatttaaaacatcaaatatagttttttgagtaataattggaaaaaatcttagtaacattagtttaggaaatgatacaccaaaagcatgattcataaaaaaaattttgataaattggacatcatcaaaataaaactcttgctctgccaaagaccctgtaaagaccatgaaaagacaaggcatagacttggggcaggggggaatctgcaaatcggccgggcacagtggctcacgcctgtaatcccagcactttgggaggccaaggcgggtggatcacgaggtcaggagttcaagaccagcctggccaacatggtgaaacctcgtctctattaaaactacaaaaattagccaggcgcattggcaggcacctgtaatcccagctacttgggaggctgaggcagaagaatcacttgaacctgggtggcagaggttgtagtgagctgacatcgtgccactgcactccagcctgggtgacagagtgagactctgtctcaaaaaatctgcaaatcatatatcaaacaaaagatttgtatctgactatatgaaaactccccaaacttaagaaaacaaacaactcattaaaaaaaataaatacatgatttgaaagaaaacttcaccaaagaagatacatagatactaggttggtgcaaaagtaattgcggtttttgtgattactcttaatgctgaaaaccacaattacttttgcaacaacttaatagtaaataagtacatgaaaagatgctcactgtcattagtcattagaaaatgtaaataaaaatccacaagaacatgctactacacacctattagaatgggggaaaaacagacaactgcaggtattagcaagtatgcagagccattggaactctgaaacattgctgatgggaatgtaatattacagccactttggaaaagtttggcagtttctgacaaaggtaaacattcatttaacttatgacccagtaattccactcttagttatttgcctaaaaggaatgagtatttgtttcacaaaagcacctgtacatgaatatttacagtagctttattcataaataaaaaatgcatatgtccttaaactggtgaatggatggaacaaaactaattgtggcacattcatacaacagaataccactctccagtaaaaatgaactattgatacacacaacaacatgggtgaatcacaaatgcactatgtaaagtcaaagatgacagatgtaaaacactatataccatataattccatttatatgacattctggaaaaagcaaaaaaacagggacagagaaaagatcagaggttgccaaggattagagctagggaaaaggctgactacaaaagagcagactgaaggcattttcagagacaatggaaccctttagtatgttcattgtgatggtggttacacgattacatatttgtccaaactcatagacctgtacaccaaaaacagtaaattttattgcattttaacgtttttaaattttaaaacaaatttacctatttaaaaaaaaaaacaaagacagcaacaacttaggatcccatattaccatcactatttaatgtgatcttagacaaatcacttaatatagagctttggttcccccaatttttaaaatgaaaaatatagtatttatatctcataggtctttataaaaaagttttttaaaggtttcaagatcctgccttttcacattctatttcttctgaaatgtttcttcccatcctctcttccctactttgcttggctaaatgctatttgattttcaggtctcagcttaaacgttattttttcataaaagcttctcctaactcacattttaaatcagggcctcagctatgcctttactgcccagtgtactcttatttcataacacttctcatgtccttttttttttttttttttgagacagagtcacccaggctggagtgcagtggcccgatcttggctcactgcaagctctgcctcccgggttcctgccattctcctgcttcagcctcccgagtagctgggactataggcacctgctaccatgcccagctaatttttttgtgtatttttggtagagacggggtttcaccatgttagccaggatggtctcaatctcctgacctcgtgatccgcccgcctgggcctcccaaagtgctgggattacaggcttgagccaccgcgcccggtctttttttttatttcaagagcttaggcgtacaagtagtttttggttacctggctgaattttgtagtggtgaagtctgaagttttagtgtacctgccacccgagcagtgtccattgtatccagtatgtagtttttttatcccttacccctcttctactctccttatttctgagtcttcaatgttcattatatcactctgtatgcctttgcacgcccatagcttagctcccacttataagtgagaacatatggtatttggttttccattcctgtgttacttcacttagaataatggcccccagttccatccaagttgctacaatggacattatttcattctttattttatggctgagtagtattccatggtgtatatataccacattttctgtatccattcatcagctgatggacatttaggttggttccttatcttttcaattatgaattgttctgtgataaacatatgcaagcacatgtattttttttatagagaggttgtactaacttacattcccaccagcagtgcacaagcattcccttttcaccacattcacgccaacatctttgttttttgattcttaaataatggccattctggcttgggtaagttggtatctcactgcagttttaatttgcatttccctgatgattagtgagtacatctataggtaaataattttatttaatgtctgtctctttcatgaaatggtaagctctgtgagggaagaaattgttatcagaatacaagcagtacaaagtgtctgaaacactggtgaatattctgtacatatttttaaacaaatgtgcaaaaacacaatggcatttcctattgtgtaattaattctttcttaatatctttacctttctcactatttatatgtatagacacatgtatcttaatgtttttatcttcctcaccctgtatatatacacatacatatatatgtatgtatgtgtatatactatgcataccatcaacaaagtttcttagcaaatgtccatcaaaagataacaaataatagattatgccttggttgacatacctgtttactaacttttcctcatttgtagtcattaacactaattgaacctgacaaaaataagatgtgacagacctactgtatatccacaagtcaaattaacaaattagttgaagaatcaatacatctacatatgagtctactaactgttgggcatacatccagacttacatgcagaaaagcacttaagaaccaaacctttttccctcttatataagctgtcaaaaatgttacagatgtgacatttaagaaactcagagcatgacttatagattaccttatgcataatggtaaaaattcctctagaacaaccagcaacattaataattagttggaactcaattacggatacttgccaaagcaaatccccagaaagctatcttgtatctttcaacctggccttgtagaaatgatctaatgtagcatcctacagtgtaggtacgtggggtattaatatcccaccctccttgatgggtcagtaactgaaacagtgaaaggctcaatgaagatcgcagcactaataaacgatgggacaggtattaatactgcaatgccgcactgtccaatatggtaaccactgagccacatgtagctacagagcacttcaaacgtggctaatccaaatcaagaagtgctgtaagtgtaaaatacacaccagatttcaatacttggtacaagataaagaatgtaaaattctcattatttgtttatactgaatacatgttgaaatgactatgggttggattaaataaaatcattattaaaattaatatcatctgtttcttttcacgtttcaaagtgtagttactacagatttttaaattatatatgtagcttgtattatatttccagcggcatcatgatagagcactcctggatcagtatggttgaataatagaagacatgtggaggcaaacatttaggtttacttcccagactctaccatatacacacagagtgactttgcagaagattattgtatatcactaagatgacttttcccacatttaaaatcagaacattaaatctatgatacagtactagtacgaggttaaataatacattaaaggtctaataatgtattctacaatgaatagccacttgatgttaatttctcttttcctcctttttcctaatccacttccctgttaatttaagctgcagttaaacttccatagtggacagattagtccccatgcctactattcccagtacctcggtctaggttaacacaacctccatgaccagaaaaccaggtacagaatggtggtcactgagtagcccaaagtaggtatgacacaagtatgacctgtctgtagtttggcatagtctaatacaatgggctcaaatagtgaaaaacagcatatctgctcccttcagaattcatccaagaaacagagacagactggttaataacaaaagggtaatggaagcagacgtagaaagagacatagaagtaacaagatggaaaagccattcatttgttcactccacaaatattaatgactgtctatttattacatgctatatgacctgagagaggaagtaacaggggaataattcccagagctttataagacccagacaacttccagttccagtccaaatgtctctttacaataaatattttttctttagatgaatagatgaaggctctgctccttgaaactaaaatgacctaactaacgtagcttcacaaaggaaggcacagaaaagtgcctttttgttagacactcacacacacaaagacaaaatatgtattgccctaggtaataaatcaaacaaaaagggttcttcctcaaagtgggccattcctttcctaaaaccagtaacagacagaacagaaaacaagtggagatagcaagggctactgacccttaatattcctttagaaagccactaccagaaatacacttttaagtgccttacctgcactgcatagaaatatgtaggcaaagagaaaaaagatcggccaactaaaactacagactataagtacttattaaagactactttcactaacataaatgggattcactacatcagagtcccctgatcactttttgcagggcagtctgtgggcctcactaaactaatttgcgatattaaggtaaggaaagaagaatttcctcattctaaatgtattattggacaggcttgaagtccaggtcttaagtatggttacataagggacaacaataactatttgtttcaaattgtatctctttcaataaaacaatatctcagtggtttcagcagggagtacaaaatctgatctcttaaccctaaaattccaaccctggaaaaatggctcaccttcgccaaaacacacacacacacacacacacacacacacaactagagactgattttccacacaaaatttatgtacttattaaaaaggaatttactttataattatgtgcaagaattatcatggtgagaagtgaatgttggttttaatcattgccagtagatcctcccatcagccacataatcatattcactttatggaggaagcactattactccgtaccaagcatcttatataatatagctctttgttttcatccctgtgacaaaccatgtgagatggctgtgtgacccttgttttaaaaacaaggaaactgactgctggaaaggtaagtaacataattatccaagatctccaacctaacaaatgtcaaagtatgggagctgaccttgggcttttatgctcttgtccacaataatccagagcacccagaacatttatatctctaagaagttaagtttagaaaaatgcatctttttttgcatatatgtcaccaacttcgggtatttcttattacaagagacctttttgcttaaagattccaaatcaatcacccatcatttttctaacactataaattctaaatgcaaatgtcaactaagaaaggtctatgaacattttaaaaactcattttccccaaatccatatgagtctgaatgctgagaaattccacactaaaggtagaatacttaacaaaacaccaacatttcccttcagaaataacaaagggaaatataagtttgtgctcactttttcataatgtcatggcatgttaaaagatgaaaacctagtaacaaagtcaattaatagaatctacaatctttttaaaatattttagtagcttaagaagcatattaaaactagaacctaaatattaggctggaatcgtggtacatctttagctcttccagaatcatactcacagtggggctcacactgtattttaataagcttctaggtgggcccattcatctagcagcttaaaacctccccaggtgattccaatgtgaactccaggctgagaactgtcatagttgaaaaccactggactggcacatgagagcctgatttctgctgaatgtcctttctttgagctcttctcccccagtcctatgaaaagcatggtcgctgattaactcagagttaggtgaagaaaatcaaacttggagagataattataatagataccgtgatggttaattttgtgtgtcaacttgactaggctatggtgcccagttgtttggtcaaacatagcctccatgttgctgtgagggtatttttaaatgtaattaacatttaaatcagtagacttttagtaaattagattaccctccctaatgtagatgaggctcatacaatcagtcaaaatcttaagagcaaaggctaaggtttccagaagaggaaggaattctgcttcccaaatgcaacactgaaactctacctggctttccagcctgcctggcatgtgctgtagatttcagacaggactgcaacatcaactctttcctgaatttccaggctcccagcttgccttacagattgtgaacttgccagctcccataatcacatgagcgtattccttaaaataagtctctttctcactcgcattcatggtgtgtgtgtgtgtgtgtgtgtgtgtgtgtgtgtgtgtgtgtgtgtgtgtgtgtattctcttgtttcaatttctccaggggaccctaatgctagataccattatttaaacacagactatgtactagaaaccatgctaaattattcacatacattttctgagttagcctttacacaacccaattaaacagttgaataagcaagctataaagagaagatgtgaccagagatagggaagcttcctttagtggctgtggagagcaagcagtacagaagttagcactaggtgagccaagaaaaagccaaggacaaaagaagataaggtgttcattgaaaaaaacaaaagacaaaagggaaaggggaaacctatagatttaaaaatacagtgcccaccataggaaaccattcttctactttctgcttttattgctttgacttttatggacattacacttaagtggaatcacacaacacgtagtcttgcatctgactcctttaaagaagcataatgtttttgaagtttattcattttgtagcgtgcatcaatagatcactcctaaaacttcttgaatatagaagtggaatcatgtagtagtaggtctatgtttaaacttcaggaaactgtgaaagcagttttccaaagtggttgcaccattttatattcttaccagcaatgaaggttccacgttctccatatcaatgccaaaatttattattgctaactttttaaattataaacaattgagagtgtgtgtgtatgtgtgtgtgtgtttgtgtgtgtgcagtgtgtactatatagaggttgtttatatctcattgtgatttttttaaaatagagacagagtcttgctatgttgcccaggctggtcttgaactcctgggctcaagcaatccatctgattctgactcccaaaatgccaggataacaggtgtgagccaccatgcccggccctcgttgtgattttaatttgcatttgtctaatgactatttatgttgagcatattttcatgtgtttattagccatttgtagatcttcttcagtgaaatgtctattagaatctttgactattttaataaactttggatattggtacttattttaataaaccaactgtaaaatatgtttatgataaaattgtggaaatttaaacattcaaaggatacttgatattaaggatttattagggttgttttgggtttgataatgctattgcagttatgcttttagaaaaaaatctttaccttttaatgtgacacactgaataatttatagatgaaataatgtgaggtctgtgatttgctataaaataatccagaggaggtaggggaatttatataaaagattggccatatgttgacaactgatagttcttggagctgagaaaaggattcatggggactcataatactatgtttgaaatttccataataggtttttttgtttgtttgtttgagatgcagtctcgctctgtcacccaggctggagtgcagtggcatgatctcggctcactgcaacctccgcctcccaggttcaagcaattctcctgcctcagcctcccaagtaactgggactacaggtgtgtaccaccatgcccggctaattttttgtatttttagtagagacggggtttcaccgtgttagccaggatggtcttgatctcctgacctcgtgatctgcccacctctgcctcccaaagcgctaggattacaggcatgagccaccatgcccagcccacaataggttttaagaaataaaagctgacacaccgaatgcatgcattaacctacatatacactctctcaaaatctactaaatacaccgtaaagggattttttaaggcataagcaacaagaagaaaaggaatgggaatgaagacaacagcaacaaaactttggaagctagaaagtatatggatgaacatgaaccaacttgagaaacctgaatccccaaccagaagtggaaaaagccaagaaaacaacctgatttacacaacaaaaatcttcaaagggtttaggaataggtggcatcaggtacatctctggagataagtttgaaggtggaactgaacaccaaggaataactgaaagtagatttaagaaaatgaacctccagatattttactacactctacacagccaaccaaccacccctctcctactccagcaaatgactttggcttattttctgcagagtcaaagagaggttctctgcgatgaagaatccaagctacggttgagggtggggacaaaatactaaaatgaagaaaataagtaaaagtctacagattgaatatagagacttcttcctcagttcagctcccagaatgcttatagagaggctaaaagattagaagaatctggatgtccaacaagaaagactaaaagatgctgacattagaggaccccccaccatgtctgctcactccacagtaataagcttcacccacgcacacagagttcgcactagctttacagagcccaaccttttcttctgagtcattaattggtagagataacttattggggttcagggggttgatttaaaaattgagaactataggccgggtgcagtggctcacaactgtaatcctagcactttgggaggccgaggcgggcagatcacaaggtcaggagatcgagaccatcctggataacacagtgaaaccccgtctctactaaaaatacaaaaaaattagccgggtgtggtggcgggagcctgtagtcccagccactcaggaggctgaggcaggagaatggcatgaacccaggaggcagagcttgcagtgagccgagatcgcgccactgcactccagcctgggagacagagcgagactccatctcaaaaaaaaaaaaaaaaaaattgagaactacagaaaaagttacagatttatgactatatgaggaagtaatgaaaagccatttcatgaagcagtggtgaatcaagtttttactatatgttacctcttgggagaatagtttatactaaattacttgttttattaaaaaaagaaactatgccaaaaaagaaaaacaatataaatggtcaaatctaatatatttttggctttctttttgacaaactgtctgtaaaaatggtgtctattgttcccatatttatgaccatgtgtatccaatgtttagcacctatttataagcgagaacatgtgttatttggttttctgtttctgcgttaattcacttagaataatcgtttccagctgcaaccatgttgcctcaaaggatattattttgtccttttttatggctgtgtagtattccatggtgaatatataccacattttccttatccaatccaccactgacgggcacctgggttgatctcatgtcttcgctcctgtgaatagcactatgatggacatacggagcccaacttttaaatacaaatggacaaccaaggatcacaggacattttagaaaagccccaaacatgaaaaatgaaggctgaaaagtgaaaacctgaagagatttgtaaaataaacctaagtgttagataaactgacaaaatttcccagaaagtaaagtaaaaagatttttaaaggtacaaatggacgagcgcagtgactcacacctataatctcaccaatttgggaggtcaaggtgggaggattacttgagccctggagtttgagaccagcttgggcaacatagggagacccccatctcgaaagaaagaaaggaaagaaaggaaggaaggaaggaagggagggagggagggagggagggagggagggagggagggaaagaaaagaaaagaaaagaaaaaagaaaattagccaggtgtggtagtgcacgcctgtagtcccagctactcaggaggctgagacaggaggactgattgagtctgggaggtcaaggctgcagtgagccatggccatgccaccgcactccagcctgagcaacagagcgggaccctgtctcaaaaaaaaaaaaaaaaaaaaaacaaggtacaaatcgtgcttgatttaccatggttcaacttacaatttttcaactttaacttggtgcaaaagtgagaggccttcaacagaaactatacctatacaaccattttgtttcagtacactattcaataaattacataagatattccatactttattataaaatagtctttgtgttagattatttcaccccactctgtgatccaacaattcattatatccaacaatttattataaatatataataataataatatatccaacaatatattgttggatataataaatatccaacaatttattataaaataggctttgtgttagatgattttggctaatgtaagagttctgaacatgtttaaggtaggctagactgagctacaatagtcagtaggttaggtgtactgaatgcatttttgaattatgatgttttcagtttacaatgggtttatcaggacataatcccatcacaaatcaaggaccatttgtataatagttaattttatatgtcaatttggctgatccacagtgcccagatatttggtcaaacatgattctgcatgtttcttggcaaacatgtttttcgatgagattaacatttaaatctgtggattttgagtaaagctgattattctccataatgtgggcaggtctcatccaatcagtcaaagaccttagtagaacaaaaaatgaccacccagaagcaagaaggaattttgtcatcagactgaaatatgtattagtcagggttctccagagaaacagaaccaacgggatagagaaatctagaaaaataattactataagttacctagaggctgagaagtcccatgtggcgaaatctccacaaacacatgaaccaattccttaaaatcaatccatcaacccccaacccgtgtgtgtgtgtgtgtcctttcgattctatttctctggagaaccttagtaatataggatagtaagaaataaagcatttaaaaaaggaaagtcaaagccaggaggtcaacatcttaacaggatatccagaaagacagaacagaaaaaacaaacttgactaaatcaaataaataattcaaaaaactaccccagaactgaagaacatgactttctggattgaaagggcccacagagtaccaaccacaaaaaaaacagaaatagatccacatgaactacctgcttaacacaccagcacacctccctctaagaaggccaaaacccttactcagagtaattggcctacaatttcagcctcttttctatggagtccttcggttctggaaaatactcctgagattgatgaatagaaaagaaacaagagcaggcaggactctgggccatctgcccctgcttcatttatagaagccctgcttttacgtttcatattctagatttttggataagtttttttttactttgcatttttgcattggctattttttaattgtatctctttaaggtatataacatgatgttttgatatatatacacatagtgaaatgattactgtaatcaagccaattaacatatccatcatctcacactgttactctttgtatgtgtgtggtacaagtacctaaaatctactctcttagcacatttccagtatacaatattattaactacagtcctcatgctatacagtaaatctctgtgcttacgtgtcctacataactgaaattttatactctcgttgacctccatctgcccatttctcccacacccttcattcctggtaaccactcttctattctctgtttccatgtacttgaagtttcatttcgttttgttttgtttagatcctacaaataagtgagatcatatagtatttttctatgtttggcttatttcacttagtatcatgtcctctacttccattcatgttgttacaaatggcagtaactccttctttaaggctgaataatactccattgtgaatagagacaccacaatttctttatccattcatctatcaatggacacttgggttgtttcattatcttggatattgtgaagaaaacctctttctttttgctctttaaatatataaagagccatctctggtgcaaattccaaaagaaccgcccatgaccaagactattcctgctggatcacacctcatcctttccctagctcccaacaatgacatctagaatattatactgaattacatttcaggcctttgtggtctagcctagaacttaaatgtgccttaagatccaaacaagcagcttttaaacaaacttttggaaaatgctctctattcataaatggaagctctctgtgcctacggaatagaagcaaattcatttattaatagtccctaggtcactcataattagtgcaaaactagtctgttaactaggcaacccctgaggcttcaggaagtaattcatttatgtgtttgtttttcttcaatatttatagttgttgtcttgcacaaaaatctatctcacagagatgtctgaaatctcttcactggtcattaactactctgataaacattatttacttttctcttaaaacatataagagaactagagaaattctgaaagtaaatgagatagcacaaaaaaaagatgaaagaacactgaagataactttggtatattttataaatcttcccagagtctcggcttatagctgggtttaatgccttgacacatacatatttatcaaaattggcagagtaataaaatcaggtgagataaaaactgacatgaacactacaaatacaaacttactatagcttttttcaaaattatattcaaaatggaagcatctaactgaaaattgttactttcattgtacacaaaatgagtatatgtgtatatgggtatatgtgtgtatctctcaaatgcatcatactagcaaatttgagcaatgtttttcacattctcatttaaacataactaaagtcatcctcagtggctacctaatcagcctaattactctgggaattactattaaactagtgaaagccacacaaaagattggtgtaaactattccagattcaaataaaacatatcatttctatttttccattcacagctgccgaggaacaactacacagtcagcagctactagaataaaatcttacagtccattcaaatctaaaaagcaacactgtgcttatttaacaaacaagtatgctatttatctaccatactagtgcttagaacaaggacggggagccattttggctataaagtttagacagcttcaagatgaaggtctgagctaagccttaaaagataggtagggatatagaaaggagagggaagaggagttctaaacgaggacataaagtttgaaaattaaaagttaaaaaaaaaaaaaaaaaccctgaaaactaccatccagcaaacagttttcccaaatgcagagttcttagaagagaatgatgggaaataagattaagtaggtgaaacttacactgagaaataacagaaatatttagatagaagtacaatgatggaaggcataattttttcagtgtacatgtgcatattaaatagcaacacatataaagctcttagcacagtatctggcccataaggctaaacaaatatttgctattattgttgttattattattaactgaaaatttcaaatagtattttctgtagtttggacaactagtaaatatgactaccccgatttttaaaatctagaattaaacatttctatgtacttcttaattttatatacatgatctcaccacaaagccctcaatattactcaaaaggcacatctttatttccctgtacttcaaatcaatttctatctaaacagaaattcagcttggtctttccccaggcaatgataaccttctctgacactctctaatgctgatgtcctccaaacaggactttctgtcctccaaaaagaaaaaaccttccccaaggaacagcaagaaagaaggaagctttataatagatgaatttataggcaagtctgtctcttatctaacttctgtgagtgtccagccctgatcctgtgtctttggtttaaaagaaaaaaagccctgggtaagccaagctcagccctaggcatcctcctcttcttcctattttggccctggcttccatgaccctatctgttttctgtaatttgctacatataatgggtaaatatggaacaacgatgaagaaagcaaagattggaggggggaggttgccaaactgctctccgctttagccccgactttgatataagaaggcaggagagccaaggattaatatcagaggtggtttttcatttttcataacatttcagagcctgaaagactgtaacaagatggtgatgatgatgatgatgatgatgacgacaacaacaacaacatttcacatttatttaggctttcactacataatcgcaaaaacactatctcatattaacaagaataacagctacctggagatcaatgagtctagtcctctcattttataggttagacaacttaatgaagtcagagagattaataactttgccaagactacaaattagtggcattggtgataataacagtgatgataataatgatggtgatggtggcagtgattacgttaataacccactaaattctttgtgtgccttgtctcatttaatccttacagcagccctaggagggaagtactatatttatcttaattttaagctgaagcaactaagaatttaaaagatcaaaaaacttgcccaaagtcacacagcaaataagtggcagaactgagattcaaaaagcagatggactcaaaaatctgtcaagttaaaacactaaactacacttcctgtagttaaaattacaactcgattcttctgactctgatcctagtttaatattgtttccctcatagcctgtctcctaaatttagtgaggtatgtgttgaaatagaaatctaatacgtattgcatttattttctaatatattatctgttacccctacaagtttaatgttacagaatatagatccatctctagctgtaaaaatatactaatatatattattaagtaattagcaatagtattcattttatcaatatgacatttaatcaattttagtttttataagtcagatgcacatagtttatttcaagaggaaaaaaagtcatctcactgttatattcttgcagaagattgccctgtcctaaaatcaggattatttgtagacaatacaaagcagctaaactagcttctcttagaatttccactgtaggaaataaataacaatatacactaagttaaaaataataatgcccttgttatttataatctaccctcagggaattttaaagcacttttcatgtcgtaacagtcttaaaatgtttccaggatatggattggcaaaccaaagtactgtaaaaagaattgtgattttttttttttcttttagatggaatctcgctttgtcgcccaggctggagtgcagtggcacgatctcggctcactgcaacctccgcttcccgggttcaagcgattctcctgcctcagcctcccaagtagctgggactacaggcacctgccatcatgcccggctaatttttgtacttttagtagagatggggttgcaccatgttgaccaggctggtctcaaactcctgacctcaggtgatccacctgccttggcctcccaaagtgctgggataataggcatgagccaccactcctggcataacagtgatctaaaaatcttctatatggccatgtgctgtggctcacgcctgtaatcccagcactttgggaggccgaggcaggtggatcacaaggtcaggtgttcgagaacagcctggctaccatggcaaaaccctgtctctactaaaaatacaaaaattagccaggtatggttgcaggtgcctgtagtcccagctactcaggaggctgaggcaggagaatcacttgaacccgggaggcggaggttgcagtgagccaagatagtgccactgcactccagcctgggcgacagagtgagactccatctcaaaaaaaaaaaaaaaaaaaaaaactatgtgaagtagctccttgcacacaatagtgacaaaaatatttagcatttattcaaagagctataatttccagaactctttcaattcttaccctaatcctgagaagcaagcagggaagattacattatccccacattaaagttaaggaagaactatgattcataatggatacttgtctcagccaaaatcacagtcaccaagaggcagagccaggattagaaccttggtcttctgactcgtgagtcctatatacttgctactctacttgatctttatttcttatataaaagaatgttcagttaatgtttgacaaatgaacgtatgcaatgcatgagcaaatcacatttcatcagaaagaaatgctgaatttctaaatttcagaccagcattttgccattatataattttttctctgtaactatactttttgtttctgaagaatgaggctgtcccctcaacaagtataattatcctctagaaaagcaaattgtctttgagctgataagctgataaacagctaacacacaaaatcactaaatttttctagataaaaatcacgagttaaaaaaatagatatatcttcttagaaatataccaagaaaaccaaatgctataacttttaaccctagtttatagcatagctaaagaacaattactatataaactagacacagttttggaatgaatgaatgaagactcatttataccaagaaggaagaaaagaatcacaacacagttcacccatgatttcacatctattaagtagaaaatattatcatattctcacaactgtcagcctgtgctgccagacttcacatttagcaattatctcaacgccagctgtccccacaatttcgtttcaaatttaatatgccctagaaaatattacatttcaaaatttctagcaatttgcaaaagatagagacagaagaggcagcctctgtagcaaaggcatgtgtaggctctctgcacactgtgggaacacactggaatcctatagtggacatttgttatgtgccccccaaccctctccaggattattctgggtcttctggtacaactccaaaacctcatttagataacacccctcccccattctcagtccatgtagactggatgaggtctccttactccactcaacaaagccaaaaatgaacataagactgctgatgccaacatcagtgctttctactacattatgcttcatattacagtgacatttattgttttgtctgcctaacacaacattcccttcttatggaatggcaactaatggctatgtgatcaagctgcctgggtttgaaacctgttcccaccacttcctacccatgtgacttgatccatttatttaactgctctaagcctccatttcctcatctgtaaaacaaagattcattcacatattcaacaaatatttattgaacacttattatgatccatgcttgtgcaagtgctgagataagaatagtgaataagatagaaaaggtcaatatcctcatggagctcagatatggcagtaaacaacaataaaccaacaagagaggtgcagattataagcgccataaaagaaataaataatgggagaagatagtaaaagagtgattctagatccacttacatagaatgtgcagaatttcaggataaagaggctttcagtataaagcctctctgaggaggtgacattttagctgaaatataaaaagaaagaataagccaaccactcaaagagaactggaagatcattccaggaagagggaaagccagaggaagaaaagagcttggcacaaaaggacatctagataactgaagcatggcaagtgagaagggggtaaaataacacaagacgacatcagaaagctaaacagaagccagactgtgctgagccttgcaggtatgggaagaaattgagatttcattctaggagcgagcaacggaaatccattgaagtgctttatttaaagctttgtgtttttaaaatgttattccagctactatggaaaggatggatatggaaaagaagagtcatctattcaatatagttaagaggatggatggaagagggaaagaaggaaggaatcagggatgatttctaggttacttgggttgagcagctgtgtatatggtgatctattgattgagactacaaagattaggcaaaagtcagggttcaagaattattacatttgagatgcctatcagatcctcaaaatagctgttatacacttttttttttttttttgagacagagtctcactctgtcatccaggctggaatgcagcggcaccatctcggctcattgcaacctccacctcctgggttaaagcaattctcctgtctcagcctcccaagcagctgggactacaggcatgcaccaccacgcccggctaattgttgttgttgttgttgctgttgttgtttttagagacagggttcgccatgttagccaggctggtctcaaactcttgacctcaagtgatccaccctcctcggcctcccaaaatgctgggacatgagccaccatgcccagccctgtgatacatattaaatgaaataatctatgtaaaaagcacaatgcctaatgcagagtaaacattcaataaatgttagctattattcatgttttgagaaaaagaggaaagttccttccttggtctacccatgtggttttggtaatgactgatgactttatcttatcccatgacccagctagggcattggacaactaactggtctagatgaaaccaacaagaatcacactctcttagctgtggtgattggtccatcactcaagccacaccaacttaagttcttccctatgattttcaaactagaagctgaaagggaagttccccttcctcttcagtagggaccctgtaagagtccagggatgctgatggtaaagttcctacttctaggagaaatgccctctgtaattggagggaataaggctgatacccagagagaagcacagatgagagacagagtactagaggcagagagtgcttatttctagtaattctagggtagtgctgtccaatagaagcataatacaagccacatatgaaacactaaaaatagacaggtaaagttaattttaataatacattgtatttaaaccaatgtatccaaaatagtatcatggtaatatgcactcaatatacaaagttgccaaataagaatgatacaatggactttggggactccggaggaaaaatgggagggggggagagggataaaagactatgaatgtggtgcagtgtatactgctcgggcgatgggtgcaccaaaacctcacagatcacactaaagagcttactcatataacctaataccacctgtaccacaataacttatagaaaaattaaaaataaaaaaaaataaaaagttgccaagtgttcaaaacccagtgtgtatggtaaatttgaactcagactagccatatttcaagtgatcaagagcgatatatgactagtggctactgtgttggatagcactaccaacactacctgggctctacccaggccctttgcaggccataagccaatgcatgcccttgtaggatttcattaatttaagttggatttgtgtctcttatcccgagagtccttaatttacctaaaaacattatttcacttattccatttacatctgaaaccctaataattctttttttttttttttagatggattcttgctctgtcacccaggctggagtgcaatggcatgatctcagctcactgcaacctccacctcctggattcaagataatctcctgcctcagcctcccaagtagctgggattacaggcatgtgccaccatgcctcagtaatttttgtatttttagtagaagaggggtttcaccatgttggccatgctggtctcaaatgcctgacctcaggtgatccgcctgcctcagcctcccacactgctgggattacagacatgagccactgtgcccagcctaatcatttttttagaaatcacacacagtacattatattctgaaaattgattcaccaattcttattagcataaggactatcacctatttccctacttgagtgccaactcccacttcacatatgcactacagttaagactcattagacctctgtattccagccttgattagcacaagaaaccataatggagcatctgcaaacaagaatcaaaggtactacaagtgataactctgattgagttgatctgaggtggaatctgggactccatttttttaaatgttgtcctagtaattttgataatcacccagattcaaaactaccgagttggatcacttactaaatctaaatagcaacttctgccccttatttaccttttctattgttacaagtatttcctctgttgtatttactgaagcgcatactatattcacctttgtatacttaattcctaaccccttaatggatatacttcaaatattcaataaatatttgttgaactaaaagaaaaacttaaagtggacttttaatatgatgctatttccaatatgatatctaaaatagtccagagaagtagtgggagataataagagtactaagtttaggtaatggcctatctctccttctttctgttctaattttaattagctctctgctagtctgaattgagggtaaagggagttaattgttggattactctgactacagttacattaaaaagaaagtgccctgtggccatattaagtgccatgttgtacccaaatgtccacctgtagttagataattttgatttaattgacttcactcacatccagagaccatggaagggagtggaagtttggtcaattaaaaatcaagcattaagaatgccaactgattcctcctgagtgagaattagagaaaaggaattctaggtctgtgggcacagggaaagacataccaaagcattcataaatggctcttggttcctcacctccttcttctcttccacacacacattctaggaggttcaataaagtgctgtaatgtgttttgcacacagaaggtactcaacaaagttgtatcagttgctggggccataaccaagtattacaggctgggaggcttaaacaacagaaatttgttttctcacaattctaaaggccagaagtctgagatcaaagcattcgagtggttagttcttgctgaggcctctcaatctggcatgcagatagctgctttcttcctgagtcttcacagggttttccctctgtgtttgtcaatgtcctaatctcctcttcttatagagataccagtcatattggattagagcccaccctaataaccccattttaacttaattacctctttaaagaccctgtctccaaatacagtcacattataaggtagatggggttaggagagcaacatatgaatttaagaagacataattcagcccataacaagtaccgtctaggtaaccactctaacagaggttagatgaatccaagaatagctgaatcttgaagaggtcatatagagttatttggtttcagggatatgttaaacatgaaagatctaaaccagcggtttcaaacactactgttcaacagaatcgattatggggtatgttacaaattatgggtgttctggccacactcagaaattcttaggagtagaccaggcatctgtatgtttgcagcctggaacaaagtctggtattgaccctaaaagacatgtcaacctagacagccagcaatgaggcaagaagcaggactggcaatgaagaggaaaagacctcacgtgaataatgtagtgatctgtatcgctacattctcttcatcattaagtctctgttacccaaaattcactctaataccatattactctctttgtgactttgtccaaacaaagtcttcccaaagacgtaatgcacaatgagaagtctatgcttatgatatttttcagaggagggctggttagaatcacaaatgatgatcatttacttcacacctaatataactcattctccgctgaacggaatttggttgattgactgatttgtttaggccaatggattcaaggaagtgggccatattcatctcatcttcttctcctttaagctgcctctgggacaagttgacacacattttcaccactctctagtctcatggttgattaataatatccgtataattatatttcatcctatcattaaacagtactggattcaaagtaaaactcagtgaaataatttggcacaactgcttttaaaaattatatttttgtattttctccttcatatgcttctttattctatctctgccttccattcaacaaatatttattgtagtgccgggagtatgggaatataacaataaataaaacatagcctctgcccttcagaaaagtaaagtctagaaaagaaaaaaagatgtgtaaacaaataaccacaagagaatgtgccatattataacaaagatacacataaggtcccatggagcacagagtagagaactaacattgcctgaaggcagagcttacacacaaactgaaggatacagtcaagtatccaggcaaggacacaggacaagaacaggcattaaagcaagaaaatgcaaggcaagtttagggaacagaaaatactcatgatggctctaacaaaaggcttgtaaggttgggactcatggtgggccttccatgctacactaaataaccagcactgtcaggggaagtcactgatagttttttaagcaccatcagttctgtgtttaatttcccccaggcataaaattttcctgaggctgtctgctgctccccactccccagcgtgcgcccctcttccacagccccatgccgcctgtgctgtagcaatcagaagtacttactgttctctaaatatgccaggcatgttctcactgactgctaatgtcaaaagcatgacttgaaaaacatctaaatgcatgatcagaccagtgatagcaaccctatggtggagttttcaacagttaataaggggagcaatattgaatcattccagttctctatattttgtcatttgctgttcctgctgcttcatggaaaagggttatattttctctgtaaatagaacttgatatatcttcataaccgtcagcagggatggacactgtgctacttcccagcaaaaggtgaatgaaaagtgatagcagttaaaatggtgttctttgctgtttctctgttttgttttcatactcttcttttaaaatcagactgtaattttaacaaggtggcaggtaaagcattcctttttgcttttaatgctgcctggaaataatttgttttctcctctccagagaaattcttaaaaaaaaaaaaaaaaaaaaaaaaaactgtaaaaacctgactgttctgatacaaaccttgttaataggatgttcaccttaaaactaacccaaaagaggaacaagtaaagcaacatgataacaaatcacagaattttagaaaggactaagagcaaatgtagtggtgtggttaaaagctatggttcctttgaagctcaaattaagaagaacctgctagtactgatcatctagcatcctaagtgggaacatagcaaatagacatagaattataaccctaagagttgaaatcagaataatagcaccaatgaactcctcaaatcattttttaaaggaatatatttgtgaggcaatgcaagtgaaaattacataatatacagttactaaattcctgagagttctatttttgtttattcaatatctactaatataaggacaaaaatcattgctaatgatcaaaagagcatagcaatcattatcaaattaagaggccaggcatggtggctcatacctgtaatcccagcaatttgggaggctgaggctggcagatcgcttgagctcaaaagttggagaccagccagggcaacatagtaaaacccatctctacaaaaaaatataaaaattagccaggcgtggtgatgtgcacccattgtcccagctacttgagagtctgaggtgagagaatcacccaagcccggggaagtcaaggctgaagtgaaccatgatcacgccactgcactccagcctgagcgacagaaagaaaccctctccaaaagaaaagaaagaaaaattaattaagatgtgattcaatacattttttccaattctttaagttattaagaagccaatgtcaatctctcatccactgcaggaatctcctagtttccctaatatacaacttcggtctctgctgaaatattaccttttttatcgtaaatacttaaggtatacaacatgatgttttgttatacatatacatagtgaaatcattatcacagtcaaacaaattaacatatctgtcatctcagataccttttttccccctttggtgataatctactctcttagcaaatttctagtatacgatgtgatatcattctgtacattggatctctagacatgctgtacattggatctctagacattcatgctacataattacaactttgtaccttttgacatacatctccccattcctgtccctccctccccaccccaggccctagtaaccaccattctactctgtgtctatatattcaactttttttttagattctgcacataagtgagatcatgcagtgtttttctttctgtgcctggctttttcactcaggatactgtcctccaggtttatccatgttctctcaaatagcaagatctccttttttaaggctggacaatattccatcgtgtgtgtgtgtgtgtgtgtgtgtgtgtgtgtgtgtgtgtgtgtgtgtgtaccaccatttctctatccattcatccatcaacaaatgcctaggttgtttccattctggaccatggtagatactgctgcaataaacatgggagctcagatatcttgacaaggtgctgacttcatttccgttggatacatacccacaagagggactgattgctgagttatattgtagtcttatttttaattttttgaggaacctccactcagttttccatagtggctgcactaatttacatacaaaagtttcctttcctccacagtctcaccaacacatctctttttggtttatttctgaactctctattttattccatctgtctatgtgtctgtttttatgccagtaccatactatttttccatattataactttgtaatatagtttgaaatcaggaagtgtgatgcctcaaactttgtttttctttctcaagattgctttgcctatttggggtcttttatgtttccatacaaatattttctatttctgtaaaatattacctttgcctcttcttttcctttcttcccatgtcatagttccctttctttttcttccctcttctctctatgcttctcattctagatcacatttgggtaatgttaggtacatgtatatagtgactatttctcctggaagatgatttagactacaactacaactataatcacttagaaaagtgtagaattcctctgtccacctagaatagagctgaatttgttcatattccattccaaacacagcattctaggaaactatgaagtattctgcaagctgtaaaaagatccatataatagaatattatttgccattaaaaaggaataaagggccagacgtggtggctcacgcctgtaatcccagcactttgggaggctgaggtcaggagttcaagaacagcctggccaacatggggaaaccccttctctactaaaaatacaaaaattagctgggcatggtgccccgtgcctgtaatcccagctacttgggaagctgaggcaggagaactgcttgaaccagggaggcggaggtcgcagtgagccgagatcgcaccactgcattccagcctgggctacagggcaagactccatctcaaaaaaaaaaaaaaaaaaaaaaagaggaataaagtacagatacatgcaataacatgggtgaattctgaaaacatgctaagtgaaagaagacagtcatataggccacacattgtatgattccacttatatgaattgtacagaataggcaaatctattgaaacagaaagtagattagtaattgtctacactggggagatgggaggaatgggaagtgactgctaataagtacagtggcttctttttagagcgatgaacatattctaaaattagactgtggtagtggtttcacaactctgttaatatattaaaaaccatccaattaaaaactttaaataggtgaacattatgagaattatatctcaataaagctgtttaaaaacatgtatctaacgcaacagtctatgtgtacacacccataatatatgcatatatatacatactcatttacagagagttctgaattatcagcctgcagtttatccactgaaattttaaaattcaaaatttcttacttccttgattgtatgagaatggtaataataacaataatgacagcaataataatatcaagtactcatttagttcatactatgtgccagctattgtgctaaaaatacgtaatcttattaaaaccttacaaagtcaccaaataatagagtctgttactaaccattttaacatattattttttataatcctcacaacaagaactacagtttttctcaatttatgagaaaactgagatttagggtggtgaaataaatcattctcggttttacagctagtagttggcagagcaatgatttaaactccggtcactgcactctgctgccacttgagctatccctctgtaagggcaattgagtctcagtgagctaaaagaatcttacattacttttgcagacaggcatctaacagagtaggaaaaatcccagaaccaaaagctgaaacccagaccgcagtctgagtcatgatacaaactaaccaggccagccaaattccaatcctctcatctacaaacatggaaattggaatagaaatttttcaaggtcctatcagcttaaaagtccatttgtccaagaaaaacttacttaaaaatctgagtcttcagtccaaaataaacttgccagaagaaatgctttctttattttctgccctatgagtttacgactattattaggttgtaaaaatattaagtataactggaaactgaaagcataattaacatttacttataaagttcgatatcacccattagcaatataacacataatgatttattaactttttactataaaaacttttaaacatattcaaaagtagacagaatagtattaaaaaacccaacgtactcatcatacacctttaaaaatcgtcaactcatggtcaaatttgttccatctatataccctcccactttgaagaaaatccatggcatcataacatttctgtaaatatttcagtatccatgtgtaaaagataagggttcccttcttaaaagtataatcatgataccatcatgacacctaaaaatattaacaataatatcttaatatgacaaacttggaaaatacatttagatatataaatggcaataaataatacagatttaagtaccactttcactgatattaaaagataaacctaggcacattaaaattttaaagagtttatttgagcattcagtgattcatgaattaggcagcaccagactgcaagtgatttgggctccaccaaaggcgtgcaagggaaaacttttataaggtgtctgtggaagcaggacagagaaaatgtttgatttattaaagtggagagtccctacttagaggtaattggcagtgtctggtaaagactctagatagagattcactggtgctttctgatttgttaaacttaagtttcatttcactgttttacagtgtgtttactgtttacagtgagtttggtttcagtttgcttacataggaacccaaagcactacctaatggtttcccaatcaatttttttttttttttgagacagagtctcactctgttgcccaggctggagtgcagtggcataatctccactcactgcaacctctgcctcccgggttcaagtgattctcatgcctcagcctcccaagtagctgggattacaggcacacaccaccacgcctggctaatttttatatttttagtagagacagggtttcaccgtgttggccaggctggtctggaactcccggccttaagcaatctgcccgtttcagcctcccaaagtactgggattacaggcgtgagccactgcacctggccccagttaatttttttaacactgacaaattttactttgagtgttaaggctatctgtatattcaaattttccagactattatttctatttgaatacattatttatatatataatctattatatctatacctaatgtctctgtactctattcatgaaatgtcatatggcactatactgaatgtgtccatagaagtagagtactaaacattctatatatactgagcttattagttttgtttactcattgagcttgcctggtattgaaaagaaattaaattagttaggcatggtttgtttgtgattaacctttcctgtcttccacagttcaatttatcatcctcttcgtgataccaaatgactactttatgaattgttccacaaatttgccagctattattcacgagctacatattttatccaactgaagtgtttattctgtgacccttattttcatataactctctataaccattttgcttctaccatacttactctcacattccttccctagcttgccttgccctccaaaacaaaaaagcttccaccatgaaattactaattgatattctgccttataaactttgccttgaaagattcctttgaaaaattaatttcatttcctcgatctagccaatgataaaataatgatgacagcaaacagaagtagaaacagcataattttttaaaaaaggaaacatcaaattttgtattgaaaatttacatcagcatttcactagtgaacagacatttcctctgagaaagagtgataattaccatttgcacctcatgtaaggattttcctgaggcctaagaaagctataaataatatagtttcttttgaaataaagaaaaaaaatttaattttctttcatcacgctaacaagaagtaaaataggttgcaaataatggtgtagtaaatggattaaagagattagcttcaaaataactgcactgcaggacctaaatgctgaacttgggttatccaggctaaataaaggccagtcatcatcttatttttatagttcaatcataagttagggcttatgggagtaacgcaattaagaaaatatatatatttgggggagttggaaaagtttggaaaatttcaaaaatcaaatcacatttcaaatggattaggagaactcactaattaaaggtggatagatttcatactgttaaaaaaaaaactcaaacaagtaaaaaaaaatttatgattaaccaccaatacaaacaataggcaaatttattagtttctctgctcttgctttacaactgtaacctttataacaaaccctgttagaccttgtaggagaccctgttaatgcccacaccatatccccctgacttgtctgtgagttctcttccactgctgtggatagtcatgctgatgctgacagcttcccacctaaaggacccacagttctttctccattttctctttattcttcctggaaccaccttgcacatacactacccatgcctaagtccttacaccagggtctgcttttggggaaaaccctaataagactgttggtaatagaaatagcactagaaagcagaccttcagaatgagattctggaattgcattacttgctggtcagagggcagcaaggatccaatttctagtgataagtgagtggtgataacccctaacaggctacagcagtataatgcccaaaatttttaactgaggtggactgtaatgtgttacaggaaggaggaagtacaagcttatataatagctctaatacttgaaagacatgtggtaatcaaaacaaagattttggagtatgtgttaactactcgagaagctttgaagaatgagaatggcaggcttgggtaagccatctatcaattcagggcatgctgtaaaagtcagaaaaactccatgtcagtatttaaaatgaaccttatctctggcactcagctaacatactatactgaaatcaggcctaagatttgatgaaggagcttagctacaaagacaactaaatgcacagccccagcaggtctcccatcagggctctgatagggaaagggggagggtggtgatgcatgggagggtgatatttaggggggtgtacatgagaccactaaacactcaaatctgctgaaacctctgggccggcagaatccaccctcatccctttcataaaggtaagccacctctaattgcatggagacctggcaaaggacatacctgacgggggtgccttcctccagatctgcccttcatctttcattgcctctagaccagtaactagggtcaggtcctactgataaaagctccaactgtaaggcgcagtggctcacacctgtaatcccagcactttggtaggctgaggcgggtggatcacctgagatcaggagttcaagaccaacttgaccaacatggtgaaacctcatctctactaaaaatacaaaattatctgggcatggtgatgcatgcctgtaatcctagctacttgggaggctgaggcaagagaatcacttgaactcgcgaggcggaggttgcagtgagctgaggtcgcaccattgcactccagcatgggcaacaagaacaaaaagctgtctcaaaaaaaaaaaaaaaaaagctccaactgtgaagggcacaccttcacattggtgggaagaatatgggaagaaatcacctattcaccgaaaaagtcagctgagcctatctgacatgtgtcattagaactgagagcacacataaggacgtggatgttgagggtgctgagctgaggcatggggaaagaatgctagatagaggagagtgctttcatatggaggcaatctctggtgattcataatttaatttgtagcaaggaaatcataagtaggtcctaaaacactaatgggatgtcaatgtgactgacaggattccaaaataacaggcatcagaggtggcacttagccatcagaagcaaggtgaatgcacgccattaaaggtagtaaggtcagagcagtaaccagagagcttgacctgcaggggtctgtggcaatggttgataagtcattagccattttgtttatagaagcaaaagagatgggtaatgtatttgttgctagggctgctgtcacgaactaagtgacttaaacaagagaaatttaccgtctcacagttttgaaggccagaagtccaagatcaagacattgttggttccttttaagggctgggtgaatctgttccatgactctctcctatcttctggtggttttctggcattctgttgcgttcattaacttatagaagcatcaccccaatctctgccttcatcttcacatgacattctccttgtgtacatttctgtgtcaatattttctttttgataagaataccagccacattggattaggggcacaacctaccccagtatgatctcatggttactcattacacaattcaacctatgacaagtagttaataaggttaattttttatttatatttgcaaagaagaccaagaactaaacagaagatcgatgttccttttctggatctaaggcagttctcagacccagagcccatcaaggggaggctaagtcctcttgagcgaaagagctaatgtttctccaataattctttaaggggaagtgctgccatataacagagtatatggcaccatatgccagtatatacactggtgaaagtggaatacccaaacctttcagggctattggatataggctctaagctgacacttataccagggtatccaaaatagctttgtggtctcccagttagagtaagagcatttggaagccagataataaatggagccctgactcaagtccatctcaccatcagcccaatgggtctccagacccaccaactggtcacgtacctggtccctgagtacataattgagatggatatacttagaagcagctagaatccaaacactggttctctgaactatgaaacaagagccattataatagaaagggacaaagaaagcccctggtatcacttctgctctgtccctggcccaaataataaatcagaaagaatattttggccaggtggaataacaatttgtgccaccctcagaatgcttcctgcaaaaaaaccatacggctcatggatgagtcagctaaatacgttggtgcaagaggaaaactactgtcacactatagcccaaggcaaggatgaactactgcaatgttactcaaagtgtaatccatagactagtgccaattcataaatttatttttgtaagtcgacaaaataattattaaaagtgagagtacatatttggaaacattagagcaatttgacattgctgtaataactgtagttttatattttacaaaaagatcactcatgttgaactgaaaacaaacccatatatagttccttcacatgatcagtttgagtagcactgttctaaaggacagtggtgaaaggaaatccatcaggcagagcttcataactttacatgaagaaagaagtggtttgaggtgagaacaatatcaattgttgggcaggggctagtggttctgctaattgatcagatgcctggaagaagcaatacttcatgatcagatacaaggaggtctgagaaggaggcatgtggatgaccctataggtgtgaatacctaacaaagcatctatagtagaggcagcattgaacaaccagatggaaaagatgacccatccaatgaatgtcagccaatctttgtcctcagccatcacaatggttgcacagtggacatggaaactgactagccataatgtcagggatggaggctatgcatgggcataaaagcatatactccctctcaccaagggtaatctagctattgacagtgctgaatgtctgaccaataagtactggcccaaagtggcccctcaatacagaaccatccctcaaaaaagccaatcagacatttgtggcaggttgattacatcaaattcctttccaccttggaaggcacagcaattcatcctcaatgggcctgatggttattcaaacatgcttttgccttttttgcctctgccaggtcatatttactagcataggatccaccagtctcaccttttatggccattctagcactccatcaagctgatgaaccactagcattccatcaagctgatggccaaaaggctcagctttagaataactgtctaaaggattggtgccccatcctcttaaacagaggtccccaatctccagcctgcagagaggtaactctccatggcctgtgaggaaccaggctgcacagcaggaggtgagcagcaaggaagcaagcattatcgcctgagcgctgtctcttgacagatcaggagtggcattagattctcataggaggtgaactctactgtgaactatgcatgcaagggctctaggttgcatgctccttatgagaatctaatgcctaaggcagaacaatttcatcctgaaaccaaccactctccccatcccagcctcccacctctgtccatggaaaaattgacttccacaaaagcagtctctggtgccaaaaaggttggaactgctgctctacagcgcagtagatgagtcaaaccaatgatcattacacgatgttctgtccccttagcatgggtgtgggaactaaggggtagaagtagaattggcagcactcaccacttaacccacttgggaaatttgtccatcctcagtagccaagttgggtaatttgtacttcccgttctctcaacttcagactctgtgggatgtgataccttaacccctatgagtggaacactttcaccagagagtaaattactttcacccaaaccctttattttggtgcctgatttaaaagagaatctgagttaactttaacacagttagatacaattattatcaccttatattgaggaatgaggcacgaggaagtttaagtggaccagggtcacacagctagtaagtgatagaatcagaacttgaccctgggcagtctcatctagagtccttgctttcaacctctactctaaattatctgtttttaaagttcatgtttttgtatttagttgtcttggagcaaagcattcctatattattttatgtttctaaggcaggtgtggctagcacctctataattaaaataaagttcaattaaatctgaacaagtattatttaatatagttttttattattttaatacaggtttcaatgtaatcagacagtaacaatgtctagctctgtcttcatttagcatgtatctataaacacgctccttaaaaacatacctaaacacacacacaaaaaaagatgtctttataacaaattttcacaagttatgcatttttgaacaacagttaacaggataagttcaaggtaacagttgccagtgattttcatccctaggaagtaggtaaatcaaccaggctaggagttttcaaaaataaacataaactcctttgtactagctaatccttatcatttagcatcacctgtccttcagctggccctatgcttgaggcatcagaatgaagccctgggaactagtattcaaatcacaattattttaaagtttacaatgggcaatttcctaaaagtgatatgatagaaagagtatgaattctggagtcagacaatcccagttttgcaacttacctgctatgtggcctaggacaagttatttaacttttggatcttcagttttccaatatatagaatgtggaagaaaaaaagattgaagtatgcaaagtgcctagtgtaccatctagcatccagcagctacttaataagtaatagtttccttcttcataggtattattaattaattcatgtttacataattacttgcaactaaaataaacaataaataatgtagaaaatcctaagggtcttataagtttagatggaaataaattggaagcttgcataaacagattaaaacacagattcacaagaagaggaaataacaataatagattagaaagcaggtagacccagccataggaaagaaaacttaaatactactcagcaatatctccaggataccatcagaactgttttggtcaccccataggggtagacatggatatccactgctataattttgcactgtactaacatggtagcctctagccacaggtggcaaattgagcacttgaaatatagctagcccaaattgaaatgtgctgcagagttaaaaaaaaaaaaaaacctggatttcaaaaacttggcatgaaaaaatatataaaatatctcattaaaaatgtttagattgattacatattgaaataatatttggatttattgtgttaaagaaaacattgttagatttaacttcatttccctctttttactttctttatggtggccactagaaattttaaatttacataagtggtttgcattttatttccactggacagcactaatgtgaggtcctaatttaacttgaacagcactgatgtagagtcctcattcttaggctcccatgttcttccctcccagtcttccattctttagcaaagacttagcactacagtaacaacaattttcattcatgtccctgtatgagggccccactatcctggatgcaacacacggatgatttgccacaaatagtctttaaatgatttataaaatatataggaatgaataagcggataaataactcccagcgaaaaatgtccctcaaggacaatattcacataggcaagactctgtggtactttctaacacactttaaaaggaacattattttaatatgcactatccattcacgacattcaagacaagtgaaggttagctgtctactagaaaaaataaaattttaaacttgaggcatttattcatataatcaagagtctaggaaaactgcctgaattagtcaaggttctccagaggacaaaaaaaaaaatgcatatatacatatatggagatttattggagaactgactcacaagattatggagactgaaaagtccaccaatgattaattcattcattcatactttacatagtttaaaagtccctggcatcaagcagggtacccaggaaagccggtggtgcgattcagaccaaatctaaaggcctgagaactagggaggctgctggtgtaaatctcagagtccaaaggagttcaaaggcctaaaggaggcgctccatgtccaaaggcaggagaagatgtcccagctcaagaacagaacaaatttgcccttcctccactttcttgttctattcaggccctcgaagccagactgaatgacactcacccacatgggtgaggacaatcttctttactcagtcaactaagtcacatgttaatctcttccagaaacacactcaacagacagacctagaaataatgttttaccacttatctggtcattctttagtccagtcaagtttgacacataaaattagccatcacaccacctcaatcctctacacaaatttggctgaaactagcttgataagtctttctatcagaggcttcagtggaaaaactgaccaggtgatatggtttggctctgcatccccacccaaatctcatctcaaattgtaatccccatgtgtcgaggaaggacctgtaatccccatctgtcaacagaggaaggtgattggatcatgggggtggtttcccccatgctgttctcatgatagtgagtgagttctcatgagatctgatgcttttataaggggctcttccccctttgctttctctgtctctcctgccgccttgtgaagaaggtgcctgcttccccttccatcatgactgtaagtttcttgaggcctctccagccatgcagaactgtgagtcaattaaacgtcttccttttataaattacccagtctcagggaagttatttacagcagtgtgaaaatggattaatataccaggcaactccacagactctgggtatcttcttcaagtgtttcacaaatacagtttcccaatctttacagaacatgagactccaaaaataaccaaattctcacttcccctgctcacactccccccaaaaaatctactcaccacaaacaaagcaatctaatctgatagtagaaaaatcaaaattaatgaacagaaaaaaatctgttttggagataaaaaccagagaaccactggagaagatgacataaacagtgaaagatcacaggatggcttttcatcttcataactctgccattagtaaacaacacacactaatattttgcttctatgaaaatctcctgtataaattttcaaggaaaaattagtaatataaaaatatgaaaaatataaacttttttttttacttcgaaagtttttaatctcttagacaagtataattacagcaagcacttttctacaagtaactttaagctaatggacatataatggataacaataagcatcctagagtcaagttacctgggttcaagtgccagctctgccacttaggtgctgtgtgaccttgagaaaatcccttaacctttccctgctcagtttcctcctctataaaatgtggataatagcagctacctgagggagttgttataattaaatacattaacatataaagcatttaaaacagtgcctgacacatagcaaaatctaaataagtggtacttattattacaaatgaccaaaaattaagtgacagtaattggtacatctaatctcacctaaatgtcttttcatttaattgatgactgttctcctcactaaggacttctttaattcttccaacaggtgataaattgttactaggtttaagagccaaaggatacatattaaattttttgcaagactcaataaatatggttttatagcactaaacacttctaacaagagtaggaaaaaaaacatttcaggaaaaacgttttgtattaagaataggaaagtcaacagattgataccattaataccaatggacataatacttaaggcccaaaccacaccatattccactagcatttactaagtgtcaattgtgtgactggtgtttccaagatactggacatacaaagaagacaaggactctatccttaagggctcagggtgagtatacaggcaatacacaattatgttatgatgtaaactatggtttgaatgtgtcccccgaagttcatgtgttgggaacttaatccccaatgcaatagtgttgagaggtgagaaattcaagaggtgattagggtatgaaggctctgcccttctgaatggattaatgacattaaggtaggaatgggttactcataaaaagaataagttcagcccctcttaccccttttaacttccaccatgagataacacagcatgaaggccctcaccagatgccaccccttgaccttggacctctcagcctccagaactataaaaaaaaaaaaattcttttccttataaattacttaatctgtggcattctgctatagcaacatgaaatggactaagacaatgtattataacagaagtatgagcaaagtgcattacaggcaaaagaagaaatctgaacaaagccaaagaagcatgaaactgcatagcatatttggggaatggtaactcacctaatatggcttcagcattccatcaagaccttacattgctcttgttttttcaaacattaactacctgtcatgtgcaaggcaccaaagaaacagacatgtaatccatagcctctgggaaggtaatatctgtttcaggtgctaatgtataaatagaagttagctgcaagaacaaaggagtaagagcattctaggaaggagaaatggcatatgcaaaggcattctgagaaccaggaagagtttaacaagtctaaatccacgggaggatcccaagataaaggcagaggtgggatcattagatgttttggatgccaggcttttataacaaaagtgactagtaatcactaaaggatttaaaataagatcatgaccagatctgtgttttaacaaagcccttctgatagaaggccagtaaggagtaatccaggaggtaaaagggataaggaaatagcattagtgatggtgacagaaaaaaaggaaagaacatattcaagagggtcttcgatgagaaaatttggtaaaagtaaggaagaaggagattccttggatggtgccttgagttttttcctaatccctctatccccctagtagaaacatcttctcctttgaacctattttatttctacgttagtggacttttaggggggtacctatttattcatgtctccctcctcctactggtaaactcattatgggcagagactgtgccttatcccccttatattcttagcaggaccagaactagggtgaggagagtgaggcattcaacttcaggttcatgctggtacaaggttgaaatctgtttctatttaaaattttcatattttgttcatcacagactttttgcatacattttgattttttaaacattaaattaaaatattgtatattatttaatactttggcacactcttaaattttatacctgtggcaagtacctcacttacccctagtcaaagacctgatactcagtgtcttcctgacatagtacctaacacaagcaggtacttaaatgcatgttgaatgaaggaaaagcaaacaagtggcataagcaacaagatggatggtggtgggccttttacagagacagtgaatacaggaagagcaaaagactctagaggaacatgagtttataatgcatgtcagaagcactgcttggtgtattacagattaatttattattcaacactggaagcatgtataatggaaatattaaaggatgacattactcaaggaattgttctcaagatatttccccattctctttttaaaacttacactaatatttgaggtattgcagcaatatctaatttcttagttcagcttttaagttaacatttcttaggatgccaagatgagatgcttgttacatatatgtaccattaacactgctatggtatgaatgtttgtgttcccccaaaattcatatgttgaaatcctaatccccaagataatggtattaagaggtggaaccttttgggaagtaatcatgtcatgacagcaaagccctcacgaatggcattagcacctttattataaaggcccccgaaaaatgacttgcatcttccactatttgaggacacagctagaaagcaccatttaagaatcagagagagggccctaccagacacttcccaatctccagaagtctgagaaatgaattgtttataagccactcagtcaatggtatcttattatagctgcccaaatagactaaagacaaacacagtctttgatatgacttcatcaaacggcacccacatcactctatttctgtatccttgctcacttttcttcatagcatttatcactactagatgcagtataagttagttatttttcttccccctttaaaaaagattcactccatgagaacacagaatttttctgttttgttcatagttgtatccccagcacctagaataaatgccattgaaggtcatgacaaagagtgcgagggtggctgggggctggcttacactggagcagaaataagacaaaaaaaataaattaaaccctctgtggatacaaaactagagctaggcgctcacaagaatttaacagaaagccctaggagccaaaaacaaagatgcaattgcaaaccagagcaataagcttgggagcttacctgtagtcaccttgggaagtaaccagtgggcttgggtttaatagcctttggccagatgagattcaaatctctggataaagctgataccctcaaaggattacatacttggctatcactggcataccagaagataaaaggaaacttgcatttctcagcctgggctccgggaagaataaaaaagtctccctgagaattcttaaatatgacctagcctcctatctttggggctttaaatttataccacccagatggtcttggactcccaagccaagaaagtatatagtggttctgggtgtgatagttatcaatgtattttctcacagctcccaatgcacccttctttgtcttgctttatatattggagctggaccctacgagcattttcctttgacttctggctcaatgttaagcttcgtcaaaaggagggacaaggctgatcagcccattgaaaaaaaggtaagtgattccaaacaaactagttttacttattaaatataataaaacataaaatatttgtttctgaaaacctaacagaaagttaatacatagaattgtcatccaatatgaacatttccaatggtagggctggccttaagtcaagcttaatttttcatatactgaaacattacccatctaacatttgaacagattttttatctgattctcatctaactcaatagctgttatctttgaagatttatagcctcacacctaaatggatagcttttaagtagttttttaggccagtgggccccagattcatttatcataagattggttgcctatatatcccatttcacattccaaatatcttcccattttatagaatgataaagggttatatgcattttggatatagtaagaatgaaaatcattgagaaaaacctgggttgccaatttatatatttaatgcttatcagttaaactttaacttgctctatagtaactttaacttgcttatattaggactgcaaagtacaaaacatactccaacccagattctagcaagtaccaccttgcgaaggttaattttatctgtcaatttaaggtccccagatacttagtcaaacattatttggtgaaggtgtttaaatcggtagactgagtaaagcaggctgccctccctaacatggtaagcctcatccaattagttgaaagtctggatagaacaaaaaagttgaccttctcttgaataagaaaaaattcttccagcccaactgcctttaaaatgggatatcagttttttcctgccttctgacttgaactgaaacatcagctcttcctgggtctcaggcctgctggtcttcagaatggaaccacatcgctggctctcctggatctccagcttgcagatcttgcatcctgcaggtcttggaacttgtcagcctccataatcacacaagccaattccttataataaatgcctttatatacatatgcacatatcctattggctctgtttctctggagaaccctaatacacactgcaaatgacctcttattaactcctgctaaagcatcccgcctaaatagctacaaatgttccagacctttccctttctcctctcatttcaaaaggtaaaagtattgtgtttactatcttgtcttctcattgtccccattcccccatgctactaccttgtggaaacacattcctaccccacctctgtaattctgtggttagaacatgagctttgaaatcctgcctaccctctggattacagttgtttggctggatatcctccaagctgagccaatcagaagccataaatgtaaattagatttttgaaatttgtatttagaaactgaaagagagttgattgaagtccctctctgccaacaaccatgtgtgggagttaggcctaagaaaatgaaggagacacactgaaacagaggtaaaagctgaaagaaaaaaaaatagcatcctactgatacctaattccctcatttatacctgaagcttagcctcaccctgtctttccctgacccctttacagtagtcaataaattcccttttggcctaaactggtttgaattaggtttcagtcagtcacaactagagaagacacagtaaattcctactgcatgtaaatcattacagaaatctgtgaattatattaaaaataaccaaacttagttattcaaatgttttctaaaatctgtttgccataaattgatattattcaaaaatatatatatgttccatatttgtcctagaaacattaacattgaagctacttaaaatgcaaagattgcctaggaagaatgtctctttgcttgtttttacaagggacttatcaaattagaaagcaaaattagaaatcataatgagttccatgttctctggtgaacactatgaggtaccattaaaaatgttatataaaccaggagcagcggctcacacctgtaataccagcactttgggaagctaaggcaggaggatcacttgggcccaggagtttgagactgcagtgacttatgatggcaccactgcactctagcctgggcaacacagtgataccccatctctttaaaagaaaaaaaagaagaagaaacaagaatatgctgctttaagtttgtactatttttataaattaattttaattttaaaaaacactttaactgctatataaaaataatactataactaaaaatattgtaatctgaatctttaaggaaaaccatacaaatttactaaatgaggttatcattaccaaatatcttcttggcacttttaagttttaaattgagtgttttcttagctggttgaaggctgaaattcattatcttcttatagaactcttgttatatagaaaacacttaattatgaagtagttattcatacacatgaaagataaactggtcctgaatttcctcctcaataatataaatgttatcctaagaaacaggaaaaaaatggtggcttgggtaattaaaattcagagataaacacaatcttcagtacccaaattcaattgaattcaaagtcttcaaccacctattattttattttattttattttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggcctcacctattattttataaagctgctgacaaatattaaagttttaatagttgttttctctaatttgattgcccttatagattttcctgaatgatgtgctaagtagcataattgtgaataagcagaaagtaagagagaatataaaaagctaacacacatatacacttcaaaaacaaacttgatgagaacttagtcacaaagggtataaaccctctcaggatcgtaactccaggtgacttttctttttcactcttactaattttaccaactacgaaagggaatcagataatcctagaataggtaagagaggaaaagcaggcttggaagtgatcaacagactctatataaggccactaaaggaactagggagtgataagtaaactagttagtagaagtattaataaaaatttcaggccccagaatcatgctcacagattggaaaggttagatttttctgttgctttaatattatacaattgcaggaaatattataagcttcatttgtccaacagcatcatgagaacaggtaatgaatacaatatttcaggttcagctcacagaactaattttcataaattcttatataagtgaaaaacctcttatcctattgcaatgttctcaatctcattgccattaagactcttcacacaataaccactcagttaagagaatgacagagggattttttttcatgtgttttttggctgcataaatgtcttcttttgagaagtgtctgttcatatccttcgcccacttgttgatggggtggtttgttttgttcttgtaaatttgtttgagttcattgtagattctggatattagccctttgtcagatgagtaggttgcaaaaattttctcccattctgtaggttgcctgttcactctgatggtagtttcttttgctgtgcagaagctttttagtttaattaggtcccatttgtcaattttggcttttgttgccattgcttttggtgttttagacatgaagtccttgcccatgcctatgttctgaatggtattgcctaggttttcttctagggtttttatggttttaggtctaacatttaagtctttaatccatcttgaattaatttttgtataaggtgtaaggaagggatccagtttcagccttctacatgtggctagccagttttcccaacaccatttattaaaaagggaatcctttccccattgcttgtttttctcaggtttgtcaaagatcagatagttgcagatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcaggctcttttttggttccacatgaactttaaagtagttttttccaattctgtgaagaaagtcattggtagcttgatggggatggcattgaatctataaattacctggggccgtatggccattttcacaatattgattcttcctacccatgagcatggaatgttcttccatttgtttgtatcctcttttatttcgttgagcagtggtttgtagttctccttgaagaagtccttcacatcccttgtaagttggattcctaggtattttattctctttgaagcaattgtgaatgggagttcactcatgatttggctctctgtttgtctgttattggtgtataagaatgcttgtgatttttgtacattgattttgtatactgagactttgctgaagttgcttatcagcttgaggagattttgggctgagacaatggggttttctagatatacaatcatgtcatctgcaaacagggacaatttgacttcttcttttcctaatcgaatatcctctatttccttctcctgcctgattgccctggccagaacttccaacactatgttgaacaggagtggtgagagagggcatccctgtcttgtgcccgttttcaaagggaatgcttcatcatcactggccatcagagaaatgcaaatcaaaaccacaatgagataccatctcacaccagttagaatggcgatcattaaaaagtcaggaaacaacaggtgccggaaaggatgtggagaaataggaatacttttacactgttggtgggactgtaaactagttcaaccattgtggaagtcagtgtggtgattcctcagggatctagaactagaagtaccatttgacccagccatcccattactgggtatatacccaaaggattacaaatcatgctgctataaagacacatgcgaaggtatgtttatagcggcactattcacaatagcaaagacttggaaccaacccaaatgtccaacaatgatagactggattaagaaaatgtggcacacatacaccatggaatactatgcagccataaaaatgatgagttcatgtcctttgtagggacatggatgaaactggaaaccatcattctcagcaaactatcacaaggacaaaaaaccgaacactgcatgttctcactcataggtggaattgaacaatgagaacacacggacacaggaaggggaacatcacacaccagggactgttgtggggtcgggggagaggggagggatagcattaggagatatacctaatgctaaatgatgagttaatggttgcagcacaccaacgtggcacatgtatacatatgtaacaaacctgcacgttgtgcacatgtaccctaaaacttaaagtataataataataaaatttaaaaaaaaagagaatgacagagggattaccaaaacagaaagggtacacatgctgatagtaatatccaattcacaaatattcctctacgcagttctaacccaggaaatatgtcttgtaattatgaaactttgatattttctgctatatagaagcattcattctaaacagtgaaatattctaaaaagttttgagtctatattaaggagaacattttaattaatgtgtctatcaaaataaaattagagttaatataagcaacatcaatgaaaggtttgtggaaaagaatgttttatttttatgggtacatagtgtatgtatttatggggtacatgagaaattttgatacagaaatacagtgtgtaataatcacatcagggtaaacagggtatccatcacctcaagcatttatttctttgtgttacaaacattccaattatactctagttattttaaaatatataataaattaatgttgactgtagtcaccctgttgtgctatcaaatgctaggtcttattcattccctctaattatatttttgtacccattaaccatccccactgccctactccccttcccagcctctggtaaccatcatcctactctcttatattcatgagttcaattgttttcatttttagcttcagcaaatgagtgagaacatgcaaagtttctctttctgtgcctggcttatttcacttgacataacgtcttccaattccatccatgttgttgcaaattacaggatctcattatttacaattgaataatactacattgtgtatacgtgacacattttcttcatctatttgtctgttgatggacacttaggttgattccaaattttggctattgggaatagtgctgcaataaacatgggggtgtaaatatgtctttgatatattgatttcttttcttttgggcatatacttagcaatgggattgctggatcatatggtatttctctatatttctagttgtttgaggaacctccatactgttctccatagtggctctactaatttacattcccaccaacagcatacaaatgttcccttttctccacatcttctacagcattcattattgcctgtcttttggaggtaagccattgtaactggggtgaaatgatatctccttgtagttttgatttgcatttctctgatgatcagtgatgttgaacatcttttcatatgcctgtctgccatttgtatgtcttcttttgataaatgtcttttcaaatattttgccaatattttaattgaattactagatttttttcccatagagttgtttgagctccttatatattctggttattaatcccttgtcagatggatagtttgcaaatattttctctcattctgtggattgtctcttcattgtttcctttactgtgcagaagctttttaacttgatgtgatcccatttgtccatgtttgctttggttgcctgtgcttgtgaggtattactcaagaaatctttgcccagtccaatgtcctgaagagtttctacaaaattttcttgtaccaatttcatagtctggggtcttaaagtctttaatccattctgatttgatttttttagatggcaagagataggggtccagtttcattcttgtgcatatggatatcaagttttcccagcaccatttactgaagagactgtctttttccccaatgtacgttctggcacctttgtcaaaaatgagttcactgtaggtgtgtggatttgtttctgggttctctattctgttccattggtctgtgtctgtttttatgccagtactgtgctgtgttggtcactatagctctgtagtataatttgaattcagataatgtgattcctccggttttgttcattttgcttgggatggctttgtctattttgggtcctttgtggttccatataaattttaggattattttttatgtttctgtgaagaatatcactggtattttgatagggattacattgaatctgtagactgctttgggtagtatggacattttgacaatagtgattcttccaatccatgaacatgaaatatttttccatttttccatgtcctcttcaatttcttgcatcagtgttgtatagttttcactgtagaaatctttcacatctttggttaagtttattcctgggtatttttttatgagattactttcttgatttctttttaagactgttcaccctggcatatagaacactactgattttttatgttggttttgtattctgcaactttactgaatgtgtttatcagttctaatagttttttggtgggggcttcaggtttttctaaatataagactatatcatctgcaaacaaggataatttgacttcttcctttccattttggatgctctttctttctttctcttgtctgattgcttagctgggacttgcagtaccatgttgaataacagtagtgaaaggaagcatctttgtcttgttctagattttatgggaaaggttttccatttttccccattcagtaagatactagctgtgggtctgttgtatattgcttttactgtgttcaagtatgttccttctattccaagtgttttgagggttttatcatgaagggatgttgaattttatcaaatgttttttcagtatcaaatgaaatgatcatatagtttttctcagtatctaatgaaatgatcatatagtttttgtccttcattctgttgatatgatgtatcacagtgattgatctgtgcatgttgaaccatccttacctccctgggataaatcccacttggtcatgataaatgatctttttgatgtgttgttagatttggcttgctagtgttttgttgaggatttctgcatcaatgttcatcagtaatactggcctgtagttttctttttttgatgtatctttgtctggttttggtatcaaggtaatactgaccttgcagaatgaacctggaaggagaaactacttccatttttcagaatagtttgagtagagctggtattaatttttctttaaatgtttggtaaaatttagcagtgaagtcattggatcctcggcttctctttgctgggagactttttattacagctcagtcttgtcagttgttattggtctgttcaagttttggatttcttcatggttaaatcttggtagggtatgtgattaggaatttatccatttcttctaactattccaatttttttggtatatagctgctcacactagtctctaatgatcttttgaatttctgcagtatacatcataatgtctgttttttcatctctgattttactggatcttctctttttcttagtctggctaaaggtttcccaattttgtttatctttcgaaaaccaacttggtgaaaaagattaaattcagtaggtcttaaatactttggtactttaggagattaatacaaaaaagaaaaaaagacatggattcttcaaacatctcacaatgaagagaggataaacacattaattttgtatataaaggagggaggagatatgtacataaatgcttgtctaagtatagaatctctacagaaggatatgtgaaaaccaaaaagaatgattgcctttgggtcagaggactgggggactggtgatctgggataagagcacttaattttcattatatactatttcccactgttggaatatttgaatgtatatacagtcctttctattccgataaataaattaaaaagcataaaccatatataaaataacttttacaaaacaaagttaaacgtaagagatataaattacacttgatattcaaaggatagaaagatcctattcacctacagaagcagagtaagtaccaataagggggtggtccatgagatggatgggtagaatagatatataacaaaaatcattccagggaagagaacacctgactatagccacaaagttgggaagggatggggcgtgtttagaaaagtgatagtttagaagcttaggctgcatataaggatgtgttctttttctgtagatgcctgacaaaaaaaaaaaaaaactatacagttagcatcttaaagaacgcacatttaccatctcacaggttttgtggtcaggagtctgaattagctaggtcctctacacagggtctcacaggctgaaatcaaaatgtccaccaagactatggtttcctcttaagcatagggccctcttttaacatcactggttgctgacataattcatttccctgcagttttaagacagacactcacccattttcttgctgtcagtcaggagccactctcaacttctagatgccaccagcgattccctgcctagtagtccctcaataagccctctaatgctcccaagatttgaatctttctaacttcagagaaaacccaatcccttttaaaggctcacttgattagatcaggcccacccagataatggccctcttaactgacttaaagtcaactgattagtgacctcatcacaagtgactctacaggatgtgtaccctataggatgacgtattagtccattctcacattgctataaggaaatacctgacactggataatttataaagaaaagaagtttaattgactcacagttccgcatggctgaggcctcaggaaacttacaatcatggcagaaggcacctcctcacagggcagcaggagaaagaatgagtgcaagcaggggaaatgccagatgtttataaaatgatcagattttgcgagactcactatcacaagaacagcatgggggaaaccaaccccatgatctgattacctccacctggtcctgccctggatgtatggggattatgaggattacaatccaaggtgagatttgggtggggacatggagccaaaccatatcaggtgagaatcttgggagccatcctagaattctgccaagcatagctggtaacagaagatgagaacaaaaattctcaaaagctaagccaaaattaaatagttttccatcctatatttctgtctccaaacgttatgctacttgtaaaatacacagggataattaggccaggcacagtggctcacacctgtaatcccagcactttgggaggtcaagatgggaggatcacttgaggccaggagttcaggaccagcctggccaatatggcaagaccccatctcttaaaaaaatggataattacagttgcaactgagaaacctcccatatttggtaactgtctactctttggctatttgtggtactcatttattataaggcctatgttactgactgggaatatctacttctcccttcgcagtcttttattcaatataaaccattcctacctctgtttgctgtactcttggctgccttgtctgttactgttagattaatatttaacttactaaggtcctcctcactccacaaagacctagcctctttattacttttttcccgctattttcagccattacttttgtgaccttgcataaattcacactagaaaagtgtaagtattcaatggttatatagcttccaactttgtttttgcagttttataaccttatttgatgtattcaatgatcagtagtttgttctcatctacactgaatgactatagattttttaaagtggaaacaggtacataggtaaccaaagtatacagcttgcttgggaaccttcatcctcattatgtttctggacaaccacatatggatacagtatgggacatcccttaaccttaggcctagtcagctttgttgaacctgttatcaatacgcacatctggagttcccatctccttcatgatggcaaatttctggatctctctgagtgccccaggggcatgcttcttgaagcccactcatggatgtgcttctgagtgttgatggtgtattcttgtgtcaccacctcattgacagcaggagagcccttcttcttcccacccttctctgcaggggccattctgccaggccaaagttggaaagtaacctccatcttaactacccaagaaagaagaaaaacaaacagcatagctttggtgtaagcaaaatgtcaattctacagctacatggtcaataagtatacacataattaatatttctacaatgttgaatatgattatttaggaaaacaagtctcagagttagaaatacccacttctcctttgatctggcagcttatattcttctcacagacaaaaatcaaaagcccttgataattttgcctgctgattgggaggcaatgctgatagacaaagaagtagaacactatgaaaagaaggcctcctgatacagttgctagtctttcctgacaacgtggcatatggttccaaatcttcaaacagctatcatattgctacactgatttaacaaggtgatctgtattctcccaaattaaatacatgtagagcactaggataccttcttctgagaaaaggggtatttattttctttctttgatactagatttatagcataacagttaagcctgcaagtaccaactgagtttctactaagtgtaacacattgtctagtaggtgggtgatggtagcaaagagaagatacatgataaatcagtcatgaatcctgccctcaagttatatataataagtgaaaagaaaatcctgggagcagaatcgacccaattttcctttctcttctgatgtcaggtgggctctgaacacaatcctcataatccccatttcctagtttccatgcaccattgtgatccctccccttgagtatgggcaggacctgtggcttgtttctagtcaaaagaataagcaaaggtgacacgacagatgggatacatgtacatgactatgtgattatgttacacaaacttgtcatacccattttgttggagtctctgtcttttaccggctttaaggaagcaagtggccatatggccaggaactgcaggacgattctagttgctgaagctggctctggactgatagccagcaagaaattgaaaccctcagtcctacaaccacaggaattaaattctgccaacagctgaaatgagcttgaaaacatctccttccctaattgagccccagttgagaactaagtactggcaaatatgttgattgaagctttgtgagaccttgagcagaggattcaagtcagctgtgccctgactcctggccccaaaaactatgagacaacaagtacacattgctttaagccactaagtttatgataatattgttatacaacaatagatgactaacacatctttcttcttatattattcaagttgctaacatatcataagaggtaaactcaagtattctgaacatccagtcaccactggtgacatgaaatccccagcccacatgctagagaaaaccagagttggtcacacagccagacccttttgtaagattcaagcggcaatttgccaccaatattgccaaaatagccagtatggctgcccaattaacagatcaaaaactaaagatcagctgctaattcctgccttgtacattctcagagagtaaggaccttccatttcccgactaaatgctcagaatgagccatcaggcctgttaggtaaaaatgagaaatttgaaggatcaagcggccccgcagacgctggtagagagggcaagcttaaggtgtagaagaaaactgtcattcccacttaatccaaaaaagtaaaaatatatgcctcctattttctttcagatataataaccaccttttcttaaacaatagcttatttgggggcctgcattcattacaaacaaaccagagtaggcttatatatcatctgaaggttcttttttaaaaaatttcttttgagacagggtcttgctctgtcacctagactggagtgcagtggcacaatcataactcactgcagcctcgacctactgggctcaaggaattcttctgcctcagcccctgagtatctaggactacaggtgactgtgaccacagccaggtacttttctattttttgtagagatgggatctcactgtgtttcccaggctggtctcaaactcctgggctcaagcaatcctcccacctcagcctcccaaagtgctgggattacaggtgtgagccaccatgcccagctaatttttattttttcttttttgtagagacaggggtctcactatgttgaccagaatagtcttgaactcctggaggatagtaatcctcctgccccagccttcgaaagtgctgggattacaagtgtgagccactgtgcccggccacatgaaggttctttccattgttcttccagaagtctcatcatcacaggctcattgtagtataaatattttcacataaggaatgaaagtgatgtgttagcatgatcttatcaggatcaaggtaactaaaaacaaatgacaaggtttctctttttattattcaacattgagaagcagaaaagtgttcaactgttactgtatttatttaatgctcaccttttaaagagtaaattcagttagttacgtgttataaaatgtgagataagacataatcctagagtaatgaaattttctcctttgtaaaaggagattcactataatttttcatgtaaagggaacatgaaaccaataacctagttccaaatggacagctaataaaattaagtttgcacatttaagagaaagttattttaatttcctttaattgtatacaatgttaaaaaggctttttgcaaatcattaacagttaagacgtactttcattgacaatttaggtagacaaaatattcaatgttgtgtgacaaaatcattcttataacattagtaaatgcataagcacatttccaaaaattgcaagaaataaaagccaaataattggaaagaatacacatttactctaagtaaagcttgattatacgcccagagatgagcatgcaaagtatagcctaatctatactcccacaatgcctcaaggtatctctgagtgccctgtttgtgaacatctgggtcagttctatggctgacaccacaatgtcctaaatagggcatgacaataaatgaaatgtacaataatgtaaagcagtataacctctagatacaataaggcactaaatgtaacaacgttaaaaatcagcaatatagaagctaataataaaacaaaacaaaaacatttatgggggtttcagggggaaaaaaactaggcagagtaaatgaaagataatctgtaggttacctctattcgctcctatcaggggcaagattcacatcctggtctctcccctgctaatacctgatgaatcaaactgatgaacatacagccaatcaacgaagccaaaaaaaatgatacttaaaataaatacctgaaaagatggatcccacattacatcttacttaacgcttccaacttgctatgagaaagatactaagatacgcaaagttgaaagtgattcaaattccacactaacaatttaaatgccttgtaagagaaagaatattcacacataataatacaaagcaaagcatgagatgagtcatgagaagatacaagtaaagtgggaccagagcttagagggtgaaagacgacttctagctaagataaggaagggcatcacagaggaaggggcatttaagttagattttaaaagatagaatttgaaaatacagactatagtagccttcatttcaatcaaaagcagcagcatatgccttcataactgcaatgaaatattatgtacgtaattattgaatgtctctcttcctcaatagatgtcaagttctgagagggctgagactatactttttcaatggtctccttagtacctagcagaatatctggtatgtcacagatgttcaacaaatatttattaaaggaataaataaacagaggcaggaatatagaggacaaatcgctcaatttgcctagtaaatatagaagacagggacatgaagaacaaaagatcacttaaggtgaaatgacagaagaccttgaaaagtcaaactgaagaatgtttatttggttggaaataaggagtcactgaagatctttatggaatgtagtgacataactagatctgtgctttcaaaagtatatctaaaagtaatgtacatggcagactacaaaaaagataaaatgaagaagtcaagagatcattataggagtctagatcaaagataacaaggacctgaagtagaataaaggcagtgggaatagaaagttaaaaaaaaaaataacgacagggatattaaacagataaaatcaatagaacaatcagttagttatccattccacaaacatcttttgagcaactactacatatctaccagacactgccaggagctggagacaggaaaaataaaataagctgtagtccttcacctcagagttgagagtcaatctgtcatctcaataagaaaaactgattgaaaactgatctcctagctaagataaggaaaggcatcatagaggaaggagcatttaagttgaattttaaaagacagtttgaaaatgtagaatatggtagactttatttcagccctttcagaataacacaataaatgaagaaagggagaagtcaatgcctctcttaaattttgagaacagaaactaagaggatggcatcaccatgcagagaatggaagaacaaaacagaagaaggtggacagggaggacggtatggacagattctgacacactgtctttgtgtggaatacgcaagtgaaaatgttcctgaattagttgcaaattcagaactggaggacagagcacagattagggcttatgatttgaaaggcatctagcataaatatgagagctgaaattgagagcagacaaggtaagaaagggtgaaacatgtagaaccttggagatgatccatatttaacgagatgagagaaggcaaagggaagaattaagagaaaattatcagaaaatcaaaccaagccaaaccaggaaagaggagagcaatcagaggcaaaaggatcatcaggacaacaataagtgtttccagaagcatggaccatcaacagcattatttgcaacagagaaatcacggaaaattaggactgacaaaaaggccactggatttgggaataaaagaaatgtattagtgatatttgagagagcagcagagtgataagggaaaactcagtttgcaaggagttaaggtatcagtgaatggtgaggcagtggagatagctggaacaaactgctctcttgaagtctgaaaatgaaggaaaagaaaatgatggaacaatagcttgagggacaacagaaggaagaaaaaaatttaggctaaggaaagattatatgagtatgtcttttgttggagaaaaagtggacaaaaaaagcaacattttttttagaacaggaaagagcagagatagaagatccagtaaaggcataaatcaaagatgcataaaatacttgatgtattcattcaataagtatttattgaatgcccaccataaactcaaaactggagaatatacaccggagaacaagctaggtaggatcccaagctcatggagcttgtatgtctaagcttccagaggaaaaggaagaatacagtggacagggtagaatgcctttattctaccctgttgttgcagaacagccacagagtttggatggaattaattccactgctaccaatggtctcagaaatcagcatcatcttatctgtgttatcagggtatttgattcacgaatgaccacacaacctaagttggtcctatcagaatgaaacctgggactttgattaaatggaaaagaggacaatcctgatcgacaaaatgtgctgaggtgaggtcgggaactgttgcatacattttgctacctgaaagaagcccacttgtgctgaaggcaacatagaggaggattgagctgagagaattatggctgtaaaaaatgaaactctgatcaaaccacatctgaaacccatcctttctttggacttttcagttacatgatccaaaacatctctttctttgtttaaggccatttaagccgagctttttgataatttcaagtaaaaccatcctaattacaaattagatgtcactgtaggcacaagtaaaacggttataaaactgcagcacaaaataagacctgcccagtgcagataccagagactgtgccctttctccactcttctggctttagctgtctgtattagtcagttctcacgctgctaataaagatatacacaacactgggtaatttataaaggaaagaggtttaactgactctcagttccacatggctggggaggactcacaatcatggcagaaggcaaaggaggagcaaagtcatgtcctgcatggcagcaggcaagagaaaacttgtgtaagagaactcccctttataaaaccagatctcgtgagacttactcactatcatgagaacagtatgggaaagacccacccccatgattcaattaccccccaccaggtccctgccacaacatgcggggattatggaagctacagttcaagatttgggtggggacacagctgaaacatatcactgttcatggttctaagctttgaaactacaactcattctcttttttttaaattatactttaagttctgggatacatgtgcagaacatgcaggttacataggtatacatatgccatggtggtttgctgcacccatcaacccatcatctacattaggtatttctcctaatgctatccctcccctagcccccaccccgcgacaggccccagtgtgtgatgttcccctccctgtgcccatatgttctcattgttcaactcctgctccttctcctataaatcctttccccactcctccacccaaggttattttctcttcatcagcccctaaacttcaagagatcttagcagcctgggagcataagggcactcttcctctcagcagcatccaaatttaccccatcttcatgctccagaattaagtgagaggggcctatgacttgagcaacagtcaccaataagggaattcttgggcctaggcccagcgaatatcctttctgcaagtttgcccctgtggctgtatcaaccctgagtttccatcttttcgtatcaatctggctgacttctcttcctttgaaactagactcacagtgcatctcctcctggaaggcctccttcccagtggcccttggccgtcagatgctgctcctcagggttcccatgaaaatcaatactcacctcctcctagccacacagacatggaaggacagagctagatacaatgtgatgttgttcttactgggacaaggattacactttattttatttgtgtataacctacatgtgtgggggaaatgaatgtcacttgtaatgtggaggaatgggtgctggactcgcaggcaaaacacaagacttccaggcatgaggggatttcttacaagttgcaggacctctccaagattcttaatctataaggactttatcactgggttgttgtgagattaagaagcatactgaatctgaaaagtattgtagtcctttgagaatgatacctagaaatatttttgttggatattatgaatgttcagaggaggcaagagatgccttcttgctagggattgctagggaaaaactggagacatagataagtgaaaaactcaagaagaagctggcctttaagctgactttggagaatgtgtaagatttagacatgctgaaatggggatggggagaggtagccaggtgaaggaagccaaaagctgagaagccagcatcaacttagcagctaattttactaagcaaatatgtgccaaccactcttctaagtgccagggttacaacagtgaaaaattcagaggaggcccctaccctaagagggtttacattccagttgggaaagacagacaataaacaaagacaaagatatgaaatgatttctgttagaggtaagtgatgtgaaggtgatgtgctatggggactggaggggaaacattccaggtaaggtagtaaaggccattctgaggtgatgacatttaacctgggaagaaagtgataaaatagagtggagctgaggaagaatatgccaaaggaaataccaggtgcaaaggccctgaagtaggaacaagcttggcgtgtttgtaaaaccagaaaaaaaaaaaaaaagccaatgtggctacagcaaagtggacaaaaacaaaagtagtatgagattaaggctgaggttatatctaagtaacagcacggtgtcagtttagattgaagtttgtagtagtagatgatccttgaaaacaaatttgggctagaattagaaaatctcagacaccaaattaaggtggatatatttcattcttcaaaagcaattgtctcacaatataatgagccaggtctgcgaggcaagtcctcagggatgcccacagatatttctcataaattaggtgactcttgtggaggtcatgggcacttaatccagaacaccaaggcagcaaggcaaagcagctgcgagactgttggtgacgtggaacacagactgagcagaaagttctctagctcaatttcccctgttgcaggaagaaatgaagcccagagaagaaaacaggcctgggaggagagagagtagacatcataactgatgttcaccaatacgtggttctcctctagttctgcccaaacaagaatgataatgtgtcactttgggaccaaagcatttaattgctggtgtttggctccccgaacctgccatggcaatcacttgttaccatggaggtgttatagacaggtacagtgtagaatgcagagccaatatctggagggaggctgccatggagaatcccccagatccactctggtggtgttaactcactgagaaattggaggttgtttgttatggaaggataacctaacctgtaatgattaatacaggatatagacagagtttttaaaaagaccagaaagagtagacattcttgctctgagtggggaaaggaggaggagagaatatgagatactactcaatgtctctgacagcatgcattttttgccccaattctccattcttggctagatcagtgacctttatcagatatgtaagccttgcacaaaataccatagactgggtggattattaaacagaaatttattttctcacatttctggaggctgcaaatctgagatcagggtgccagcatggtagagttctggtgtgcagatggccaccttctcgctgtgtcctcacatgacaaagagagaaagagagcaagctctctggtgtctcttcctataaaagctctaagcccatcatgagggccctaccctcatgacctcatctaaacctaattatatctcaaaggccccatccccaaataccatcacattgggggtcagggcttcaatatatgaaattttgggcaatggatatgattccatctatatctgagtgttttctcccactctttggtttacactttggccatgtgatttgcttggctaacagaatgagctggaattgacagtatatgccagttccaaagccaagccttaaagagcccttacatgttaacagtttcccccttgcacctctgctatgggcatgagaagaacatggcatggctagaccattccacaaaggaggacagaaatacatggagtactaccaccactgcaaacacatattgcaacaatctgcaacatgcagaaccacgacccaccaagcctgcagcataaatgacaaatgattatgtttttaagacagcaagtttgtggtggtttgttaggaagcactactggggcagtaggtaattgatctatataatgactacaggaaaatggccaaggaggacctgtggctctttaggaagagtcttatgctaacaaagctgcctaggaaaattaagttgtactgctccaaagactcttctcttcaaatcctgttttcttatttaccttttccagttccctgaaataggtcctaaattcaactctgatactggtcagcaaggtttgtgaagaagacaaaagcactggggagggggatacagaatcataaagtaatacaaaaaaaaaaaaaacagaaaagaaaatttcaggggagaaaaatcaagtgcaatacaaaacaccaaaggaaatgagatctgaggtctctaagtttactaagaaggctagtcatcatgaagccatttttggacaccagggagacagaggcatgggagttcaggaaaaaacaagtggcaagaaaattgagacagtgagtttaaatcattgagtttagaaacgtaacaatgaaaagaataaaaaatagagcaacaactagtggagcaggaaatagaattcatttcctaatacagaagacctatatatataggtttctatatcagtgctatatcagtgctatatcagttttctgttgccacaaaacaaattattacaaacttattatctcacggttttgtaggtcagaagtctgagtgagcttagctggggtctctgcttcaagtctcacaaagccagcatcaaggtgtcaaccaaactgggctcttatctggaagttctagagaataagacctccgggcatattcaggtggttggcagaattcagttccacacagcaaataggactgaagtccccatttccttgctggctattggctggaggttgctcacaactcctagatgctgttctctggccctgcatgtgctcatctccatcttcaaagtcagcaatggtgcactggacctttatcatattttgaatgtccctgacttcttcttctaatagcagctagaaacaaatctgttcaaaggcccatgtgactgtattagacccagataacctccctaccttaaggtcaactgattaggaacctcaattatatctcaaaaccccttgtgctgtgtaacctaacataattatggaagtaacagccatcatatttacagtcctagaaattatggcagaaatcttagagggccatcttaggattctgcctaccacatgtacacatttaaagttgaaaaagatccaaaagcgaaaagaccttgaagaagattttaaatagaaccttgtattacacaaattacctataaataggaaggaaagaaatcaaggaaaaagtatgccatcctggccatagcaaaaaaaaagaaggatgccttttattggagatttgaagaaagaattaaaaaaaaaaagaaaaaaaaaggcagaggcaaaagacaccttttatgccaactatttactttgccaaaattagtatcattttaatttagatacaaagaaacatattctaggctctttgaaaaagttcctccagatggttacatctccctggagtgacagcacctagcgtagccttgcacatattgggaattcaattaaacactgctgaccatctgattgagaattcagaggctggagtagctgactcaatataaacatatggcttagttcccatcaaaggaaaaatcaagtcactctattctcctccccaacatcgcacctcctttgcaatgtaggagaaaacagatatgaactaataaaaatagacgatgtaacagagattaggaaacaggcaaactggagaatacaaaatttctctaattttaccataaaatcagaatgcttcagctaaggatcagcactgtaaatatgtcattcttaattcaattgcattcaatcagatcaatactttccgatcatggcttcaggatatttaagatggggaagacacaatctgagcccagctgctaagtgttgggggataggagaagcacacaaatgactatactgtgaggttgagctatattaattgtggaaagccaaatgaagataagaaaacaaattaaaccacttttaaccctcttaagagccatatgaaatatttatacatgagaaaaagcctcaggcagatcaaaaatatttttcaagatcatataccaagtatattgtagggtacagattcaaattcaagactgactccaaactcagtctctcccaaagaagaggcaaatcacctctggttggctagttggatgggagtttggaggctggtggagagaaaccaggaacagtttcttagggaagcagttatttcaggtaaaacttggaaagatatacacagttttgaaaagctgagatggcaaagaaggagaacatttccaggaggaacagcaaaaagcacagaagcaagaaatcaggatcaacatttggagaatggtgagtagatcaagtagcacaaactctttacaaataaagatagattggatgcacattctggaagtcaaatattggggttaataagttactgtaatagttcagggaagagcctaaactagaatctcagacatgaaaaaggagaaaaggagaagaggggactaatgtgaggagtcagatggaagattactctcttatgtttacattacagtcaacaacaacaacaaaaaagacagccaagtccaaaaactaagcttggattcaaaagaaaaaagtcatccctctgccaccctcttttgccctctagtctagaggttagtaaactatggcccacagggcaaattcaacccaccatctgtctctgtaaataaaattctactggaacacagccgtgtccactcatttacggattgttaatggctgctttcaccctataatagcaaagactatgtggtccacaagacctaaaatatttactttctagtgctttacagaaaaaaaaaaattgtcaacgcttgctctagttccatactccacaagccactcttatttgtttgtttgtttgtttgtgacagggtctcactctgtaacccagactggagtgcagtagcacgatcacagctcactgcaggctaaagcaattctctcacctcagcctcccaaatagctgggattacaggtgcacgccatcatgctcagttaatttttttttttttttttttttttttttagcagagacgagctctgtctgtgttgcccaggcttgtctcaaactcctgggctcaaacaatcacctgcctaggcctcccaaagtgctgagattacaggcgtaagccacttcacctggcctgttccaattcttttagtagcttgttctcatctaaatattaagcttatttggatatttcctgactgataaattatcaagactatcatttgaattcctattatagtaactgagactttggcttgcttgcaccatcagccttccccgcatcctccccactctccttccccaccacacatactttcctttccccgtatgaatatatatttatattcgtagtgtttgcaacattattgtgactacataaatattcttcattactgagccagataatgtaatgtaattatgtttatgtttccatgcttataaaaatgttattttctgaagttaatagttatcatttgtttcatttgcttagtttttcatttacctatcactattttttctgagtccaacacatttgttctgttcatttttttccaaacattcaaacacaccaaatacttcatttttatttgttcccctcaaaaccaccccccccaataaccctccatcctttttctctaatctgagtggttgctctcaaggcctagtgaacagttgcttttctggaacttctctctgccctgccatattgagtctgttctcctgaatcctatgtctttctctttattgattttctcccttgttttatggaagctcatcctccagaagctttctatgaaatcacacataagatataaattgtttaatccttccaggacttagaatttcttcattctgtcctcatatctaattgatactttcagccggatagagaaatctaaactgaaaaggatttccccctcagaattttgaaagcattgcaccactgtcctctaccagccagtgttgccataagagtttgatgccattctgatttccatccatctctatgtgacttgtgttaatgctttgtttcattttatactcccttcacaaagcttttaggaccttattttaatctatgatgttcttacatttcagaatgacatggctggtattcttttctcatttattgtgctagatacttgggcagccttttcagtctagagacttacatccaccggtactaggaaattttcttgtaatatttctttgatagcttccttcctttttcttgtcctctatttgtatcaggcaacctgtagctataataaggcttcataataaaccatcctaaaactcagagacataaaacaatagccattcataattgttctagaatctaccagtcagtcaggcagttctgctgatcttggttggatttggctagggagttctttttggtgttgactagacctcacacaggtatctggggtaggctggctgttagctgaatttaaatggtatttggagctagtgcagtggctcatacctataatctcagcactctgggaggctgaagcaggcagatcacctgaagccaggagctcgagatcagccttggcaacatagcaagaccttgcctctaccgaaaaaaaaaaaaaaattaaaattagccaggcacaatggcccatgcctgtagtcccaactataactcaggaggctgagccggaagatcacttgagcccagcagttggaggttacagtaagctgtgatcctgccactgcactctagccaaggagacagcgagactctttaattaattaatggtattaggtaggacagggacctgtttcatgagtctcatccacaagcatgttttcatgataatcacagaggtttcagacattgtatacacgtatcaaaatatcacactttagccaataatggatgcactttaaaaaaagaagaaaaaagtatcacccataaatatgtacaattatatgtcagttaaaataacagtagaagaaaaaatgtgctttttaagcctctgttgtgtcaagttttctataacaaaattgatcaaattgggtcacataaccaagtccagagtcagtatggagggcacctgcaaaaggcttggatacatgaattcatgcatggaacccctattggtcagatcttggaaatgctgaattgatcctctaattttcttttctttcctatgttccatctcttaggtttattttttttctttgttgctgctgctgttgttgatgatccactttctatgagatttcttcaatgttatcctgaaacttctaaaattttttatgttagttcataataaattttaaatttccaaactactttcttgttatctaattttacctgtttcatagcatccgttcttgttttaaaagtacaatatcttctcttattactctaatgaaattagtaagagtttttggaagtattcttcttgaattgcctctgcttccctcagcaggtgaagggaagtttcacccaacttcccacagcagagaaaggtatctgggtgatctaaaggctcttgtactttcaaccaagatccatgttctgctctgtgttttactcccagtttttgtggtgccgggagtttccaaatgtgagtctctaaagggtttgcatctcatcaatgtcttttctatagggacttcagaaaattaaaggtaactctctgcaggtagcattcttcctttatttttcatcttccaaaattttgttaagatctctcttctgctatcccaatttctttatccttataagttaataccttttaaagtcttctactgccatttcagtgagatttgaggaaggaaagaagaggagtttacatggtctatagacactctctccatttgcttttggacacagtgaattccaagtaacaccacaataataaagcagatatccaatgattgaaaacacaggtgaagctcaagataaaggtcagaattagagatgtaaattggagaactgcttatacagaaatggtttctacaactatcaaaggaaataaacaaaatataaaataaagacaaaatatccaatgatacaatatttagaaatgcctaagctaggaaaaagaaactatcaaagagctcaaagaaggaggaatgataaaaatagaagagtaagtgggttagtactaagtcacaaaggtcaagggagaaaaaggtttcaagagaaaaaaagacaatcaatgatatcaaatgctgctgagaaacacaggaagatgaggatgttgaggacataccatttggtgattaggaagatgatggtgaagtttaagagagttgtttcaatagcatatgagtacaaaagataaagaagtagatagtaaagtagataatgtattggtggttcttttttccccaataatctggtggccagtggaagacaaaaagcctgagataagtgagaggagaatttgaacatacatgaaagttaagaaaagtttttgtgtttttttggtttgttgtttaaggaaaaaaaaaaaaccttagcaagagtacaaaaggaaagatttgaggaaagaatgtaaatgcaaagatgaggaaaatcaaaggataataaaggactggaggagaaaggtaggatatgcactcatgagcacacatgcagaggttcatcttagaaaaggggaaggcattcttactgcaaggcagatatgcagggaaagagaaagaataaaagcagaggtagagagagacaccagaaaaaattctgaaaacctcatgcccaaatgtcctcaagctcagttaaataagaaaccaagttatctgctgagagcaagaatgaaatttatagagagtgaaaaaggtttggaacagctggtctggtaaatgtaatagggggtttgtgggggaggcggtatttattaatttacttaagaaatagcggcagcaagaaaagtctagataaagctattctaagttctgggagactctaaacaaaatatggatttagaaacagcaaaatttctgtttttcacaatagtagctataataatgagagatgctcagtgggtatgaggtaggtaatgtcaagtgatcagaataaaatatccaaaaattaacaaaacctgaatttttcaaaaggacttccttttgtattttactttttaagaagaaataagaaaaagaaaactaataaatcttcaatccagttctttcaacatttattccttgctaatttctgactaataaaagcgttaattccaggctaattaagccttcttaactgaccttcaaagttctcctcaactatgcctaactatatcaactccaatctcctttgtccaaacactactcctccactacaatctaaaatagttgcatttccatgcatagtagttcacatttgcaaatacaaaggctgctgaatcttagaatttatttatctctaccaatgaccaattgttcacaattaggttacttttggtcctgattccttttggaatttatatggaaagatgtaacatttacggagccattcattatcactgttgccttcaccctttccttagctaacagcagccacttgattcatttacctctaaagcattggttctcaaccagaagcaattttgcctcccagagaacacttagcaatgtctagagatgatttttggcatccagtgtgtacaggccagggatgctgcaatcctacaatgcaaaggaaaaccccaccccgtccccaacaaaaaaaaattatctggtccaaatgtcaatagtaccaaggttgggaaatcatgctcaaaagctacctcattcatattctaagacctataaataggtcaacaacgaaataaaacctgcctttggctcaagctcattctctcctctgctcctgatctcctacattcccaggccctttgtctgccttgaccattgagactttgattgcctttttcccagcaaggctatgatatcctgattctcagatccttagctcccttgggccatctgacacctaagatgcagttgcccctgtgaagttccaaaactccccaggcttgtttctcactggggggtctttaatccttgttttctggacttgagtctttgcacggtctggcctctaacataacctgactaatcctaatcatctatttctccctacaccccagggtgacaatatggtttgacagtgcacatcagagcagcctttaaaaggccttctcgagaccatcctggctgacacggtgaaaccccgtctctactaaaaatacaaaaattagccgggcatggtggcgcgcgcctgtagtcccagctactcgggaggctgaggcaggagaatggcgtgaacccgggaggcggagcttgcagtgagtcgagatcgcgccactgcgctccagcctgggcgacagagcgaaactccgtctcaaaaaaaaaaaaaaaaaaaaaaaaaaaaaaaaaaaaggccttctcctgtctaactttggagtctcagcattccatctcttcttcctgcagtcacctaaggggctgttacctatctccagaacaacagtttacatgtgttaagacctcattatatggttgctggaggaaaacatgaaccaataacttgcaggcttgagttacaaagaacatacatttaaaccaactgaattctggatctaacagttctttcattcagttaccaaaatatttattgaagtacagtaccaggcatgtgggggtgggtggcttaaaaaaagtatccataaatagctcacagcttagtatataaaatcagatatgtaaataagtaatctgtaattagactaattacagtcagattattcctattttataatatctaaagaaaattgtaaaagaaataaaatccttcctcagaattgacagaactaatggtcttaaaataaaagtacatgggatgaggctgggtgccatggctcatgcctgtagtctcagcactttgggaggccgaggcaggcagatggattccctgaggtcaggagttcaagaccagtctggacaacatggtgaaacctgtctctactaaaaatacaaaaattggccaggtgtggtggtgggcgcctataatcctagatactcaggaggctaaggcaggagaattacttgaacctgtgaggcagaggttgcagtgagctgagatcatgccattgcactccagcctgagtgacagagggagactctgtctcaaaaaaaaaaaaaaaaagcgcatggataaataaatgagcaaatgaacaagcagatggataaatgagaaaccaaatatcaaacaagtaaattttttctgggggtcttaggcaaagtggtacatcatgtaaatgagagcctcattattctactacatctcctttcttttcatcttccttaaatgtcattctcactataaatgctaattggtttagcatatataacaaattaatctgggtgatagaataatgctacaacacaatccatgctgaaaaatctttgcttctcagttttgcagataatgaagcctctaaacagacatagcccaccagtatgtagacagaccaggactgatactaggccaaaagacaccatgtagcctctccagatgtttacagccagtgtgcatctgactggtcagtgcttgtgcctcatcagtggtaagttgttttaatgtcacccttgatcagtacattctctcaattttagagcagcaggcagggctcccaagaagagatttcataactatattatgttcattctccctttaaaagtataaaaattccaattaccaattgacatagcagaaagcatccacctggttagactgacttttcctctgcataataccttgttaatccatcataatgatttattcatattgctgctgcactgagatatcagatgctacaactacgattatcactgttcctcgtaaagtggagtcttacagagctggctttgaacccaagctctatcaggtactgtctacgtgatgttcaacctcttctaggctgaagtacgtgagactttaaccaaatgcaattgaggaaaataatatttaccttagaggtttgttgtgagcattgataaggagacgatatatctatacagactagaacataccaggtgcttaatgaatcctagcttctccttttagccaaatctgatacaaacatattgatcaagttctttcccttccttcctttcaccatgtgatgcctgctccccttcaccttccaccacaactttttcttttctctttgcttaattttctttaagtccctccaccttatcggcaatttactttttcatttatcaaaagttactaagagcacgagcttaccactgcctctcccaaaatatctcctacaaatctctggaatccatagtgaaaagtagaaactatgattccaaatttgcctttaccctaaacacattgttttgcctttgttttaaagtggcttttccctcctcatctctgataattttccagcattaagagcattggcttttgagtcaagcaatcttggattccaaatccaattctgttgcttatgtagtcgaattacttacctggttgacttattaaatttctgtggctctcactgtcccaaaaactagaacatgtatggcaatgggcacaatgcctagcacataataggtgctcaaatatatcatatttaattgttctcagcactggcattgctaaccaagactaccttctcagtcaacaattagtctcaaagatacaatccaaatcatgtcccattagcatgtgccctgttctgtatttattcactcaactaatcatctcctgaatgctgtatatgttctaggcataaaataaagacatttgtacagcactttcaaagataactaaaccaaagtttcagacttaaaggaactcattgtctagtgggaaggcaaacatgtaaacaaataattacacggcagtatactaagtgctaaaaatagatgcatgtacaaggtgccagggaagcaccatagagagagatcaggcaaagcttccttgaagagatgactatgccagagttgagtctgggaggatgagcagggattcactgagcacacaagggaaagacggacattctgggagagacaggggcaggcaacagtggaaagtccatgatgcctgctgaaaacaccaagtacaggaattgagtcgggttggagagtgctgctacaaagaactggtgaaaaaatggggcagttaggagggagccaaaccacaaaaggcctcaagtgatgtgccaaagagtatggactttattcattaagcaatggcaagccactgattttttttgtttttggggggttttttgagacagggtctcactttgtcacccaggctggagtgcagtggcacgatctcagctcactacagcctcaacctcctgggctcaagtgatcctcccacctcagccccccaagtagctgggactacgggcatgcaccaccatgcctagctaatttttttgtattgttagcagagacggggtttcgccatgttggccaggctggtctctaactcctgagctcaaacaatccacccacctcagcctcccaaagtgctaggattacagatgtaagccactgtgcccagcctctattgatatatttctaagtcaaagaataacatgtttataatggcagaggaggaatcaggttggaaggactgttattggaagtggtgatactgagtggacagaagtagtaaggaaaaacgtcaggcatggctctagagtttctagtttaaatgatgcaccatagttcctaacacaaatgatgcaagtaacagagcagaactctgggtacagataattaatgttttgcatttcatacctccattgaggaggagatgttcaataggacaccggggataacatgtctagcgtgcaggagagagaaatgaattacagatacaggtttcgggtagattttggagaataataatttttaaaaccaaagaacatgctttttttttttttttttttgagacagagtctcactctgttgcccaggctagagtgcagtggcatggcgcgatcttggctcactgcaatctctgcctcccgggttcaagcgattctcatgcctcagcctcctgagtagcttggactacaggtgcaggccaccacacccagttaatttttttttttttttttttttttgtattttcagtagagacggagtttcaccgtgttagccaggatggtctcgatctcctgacctcatgatccacccgcctcagcctcccaaagtgatgggattacaggcgtgagccaccatgcctggccaagaacatgctttttaaaagaaatataattcatttagacttctctcccaacttcaagtgaaaagattacaaattaaaaaccttaaattactatctattgcatatatattaaaatctaacattaaaaaatatggaaagatgtcaacacatttaatgaaaacaaaaaactttaacagaggtaagtattgtatatttatttgtctattactttgcttaagcagtctgcttgctaatataaggacattttccttacctataagagtaacgtatttccaaaataatgttttcatggccaaaaaaaagcataacgcttgcttcatcttctgaataaacaagtgtgtttaatttcctgagtaaacattagtcatagttgacactgaacagcgtccaaattcaaggaaggagttaagaaatttctaaaaccccaagagcaatatacctcacccagagaatctagtgaagagcttattataaaggactaaaagtcaatgtcataccaaaattttaaataacatcatgcatccctctacttaataaattatttcaaaatcaggtcacaattgacagacacactatcttgggcagacgggagagactagataagcagggaaaatttccttttctctactgaagcatgtccaccaactgtcatatctggaaaacagccaaaatgagcactttatttgcaaaaagaacaggagatttataatgtgagcaaaatgtgtgctatataaatgcagaatatagagaattattttaagattcatatttctgtatgtttagaaataatgtttcaaagacgtagattaaaaccacaagttcatctatataaaaagctctaaaagccaagggtggcaacgcttaaatccctatagataagctttacccttttcttctgggctgtgaccatctatgcgaggtaaggtttccttataaacttctaagacagataatctggcctcacaggtatctaaatgaattagccacataaattactctgagaaaaccacagccaaatcatgtctctcttaaccttcctttccttctgctccctaaccctctgttttctctttagtcacagagcattttctagtttcctgaccacggggtttaccagccaaagctgacacagctgagttgagaagggaaagcagctgaactataaaggaaggaaatcagagagaaaagaggcagggagtctggaaatgctaactagaggggaaataagaaaaccctggactgtgtctgaatctgtagaaacttgcaactctagattaatgtcctcaactcaggtgttggcggcccttagtcaactaagggtttgcgaaaattttccaaatgggttcctcgctaatctaaaataaatacatattaaaaatagtaataatggcagagtctcaataacatttatagccaataaccagggaaaaggaagggtaggcattcattttgagtgactttactattggaaactcctggacagttacagcattgctattaacacaattgtcactttggataaggtgtccaactgcatcacacagtattttggttctttaaagaagttaggggctgggcatgatggctcacacctgtaatcccagcattttgagaggccgaggcggacggatcatctgaggtcaggaattcaagaccagcccggccaacatggtgaaactccatctctactaaaaataccaaaaattagccaggcgtggtgacaggcgcctgtagtctcagctactcaggaggctgaggcaggagaattgtttgaacccaggaggcagaggttgcagtgagcccagattgtgccactgcactccagcctgggcagcagagtgagactccctctcaaaaaaaacaaaacaaaacaaaacaagacaaaacaaacaacaaaacaaatgaagtgagagaatttaaacagaaaggaagtgggaaaggtaaggtgaagaaagacttctggtttgagtgtattctcttaaaaagttcacaaaatcgctgaggtaataaacatttttccacatgcctcttttctgagattttgtccaccttctcctccagccatgaggtggggctcaaggagactcagcagcccctagtttatgctacaagatcctatctccctgccttcccctcatcctcactgccttgattcctggtcttttcaaggcctggcagttcaacatttccttgattctatgaaagacttctatagtcataaattcccattcccctttaaagaaaaagcaagcaagacctccaaggaaggatatattaaacatggatcttgtacccttttctgcaactcctttcatcagtgagatgatgataatactatagattagattgtggagaaaataggtatctatccatcccaagagtcaagagttttggagggatttttaaaggtaatccaggaacaaataggataggtactctgcatgttcccttgttctgctgatgaatgtcacaaaatacaaagtttacgaagcatttctatggacacccaaggacaccataaaaacagaaagccaagatacaaatactttgaaatactgtgaaaaggtcctacgttattagaggtattgataagaaaacaagatgttaagaaaagagtagaaatcacgatctctttagatccctagatgttttcttgtgtattaagtatgacattttttaaatccaggctggtttagttgtttttttttaattttactttaagttccaggatatgtgtgcagaacgtgcaggtttgttacataggtatacatgtgccatggtggtttgctgcacctattgacccgtcctctaagttctcttccctaaccctcccacccccatcaggccctggtgtgtgttgttcccctccctgtgtccatgtgttctcattgctcaactcccacttataaatgagaacatgcagtttggttttctgttcccgtgttagtttgctgaggatgacggcttccagcttcatccatgtcctgcaaaggacatgatctcattcctttttattttatggctgtatagtattccatggtgcatatgtaccacattttctttatccagtctatcattgatgggcatttgggttggttccatgacttcgagattgtaaatagtgctgcaataaacatacgtgtgcatgtacctttatagaatgatttatattcctttgagtatatacccagtaatggtattgctgggtcaaatggtatttctggttctagatccttgaggaatcaccacactgtcttcaacaatgattgaactaatttatatgcccaccaacagtgtaaaagcttcctatttctccacagtctggccagcatctattgtctcttgactttttaataatcaccattctgactggcatgagatggtatttcattgtggttttgatttgcatttctctaatgatcagtgatgttgagctttttttttttttttttttttgagacggagtctcgctctgtcgcccaggctggagtgcagtggcatgatctcggctcactgccggctccgcctcccgggctcacgccattctcctgcctcagcctccggagtagctgggactacaggcgcccaccaccacacccggagaattttttgtatttttagtggagacggggtttcaccgtgttagccagaatggtctcgatctcctgacctcgtgatgcacccacctcggcctcccaaagtgctgggattacaggcgtgagccactgtgcccggccgatgttgagcttttttacccgtgtgttggccacgtaaatgtcttcttttgagaagcgtctgttcatatcctttgcccactttctgatggggttttttcttgtaaatttgtttaagttccttgtaaattctggctattagacctttgtcagatgggtagattgcaaaaattttctcccattctgtaggctgcctgttcactccgatgatagtttctttcattgtgcagaagctctttagtttaattagatcccatttgtcaagagttctcttcttaaggtagtaaaactaaaattcagatcatctttccattgagtttgttttcccaaacctagggaaggagagcaggaactggtaatagtgcctgctgtttattttttcttaaatgtggcatgcaaagctgaatgatcttttaaagtacagaatataactgcaatgaattatttctgcaatacttccaactatttttcccatttctttgcaattaatgatagcatttttttggctatagcaaatgtttactaaagagcttcctggacgtttctttgcttagatttatttctaggaattatagtttcctgatagtaacttaaagcttgggaaattcccagtatgaattacttactgtcctggttcatttgaagcaataatcatttttataagacctgtgcagatgtgccatattttataatatacttgtgtcaatttccagacatatttttatgacattttaaaaatcatagtgggaatatcatataacaagaaaaacctacttgctggaatccttatctctatcgaattctgcaaactcaacttcttcagtgaatgacagttaatatctcagttcttttataactctttttcggcattatcatcatcttactaaaattcttgagaatgcactttgctgataattatgataaagaaagaccttcagctaaacagcaaaaaaatatataaagattttctgtctctcattctggaggcctactacatgtccacaacactatacatgaaaaaaagcccattaaagaatgcaaagtgctgaccagcctatcaaattatcatcatctctcctccaaagtgcaaggagaaatagtatccaggagaattgccacacagtgctcatgctttggtcataatctgatgttacctaaaatcattaattgcccaattttcttccaatacaaggtacagccaatgctgactttgaaagagatattatcattgtcatcacctagataaaaagaagagcctcctccactttctcttccactccctattcctcttttccttccttctcatttcccttctcttcctgaaaaattcagttcctacactattaagtaacacagagaaaggtaggtgtccacatcagaggaaagatggaaggcacagtggaaaggtaggaggtgtgtccatattggggcaggcctagtgtggcgtaccatagcctaagtgagagggcatcccttctggcatgatatgagagggttagaacccacacagggtgaagagggtgcccatgtggtgatggcagaggggaacaccccagcatgggatgtcagtatccaaacagaatgagagggcatccacatgcaagggtgacctagtgcagggggattagagtccaagaaggatgaaaagattattcccctgtagatgcagaccaggagagagtcagatatgaaaagggtgaagaggtgtctctgcagaaggacagcctagtgtggggtgacagagcctaagagggaaaaggaggacattaacagaagggaggggacgatagtggagaggagattgatagcatataagacgacttatcaaataagtatatatacaaagataacagaagccagactggaggatgaaggaagttacaataaactcatatttttaataactatagagatgtaaatatgtgtacacagtgatgtgaatatattcactccctggctgagaggatctgggagatatgacactccaaaagccatgagcataacaatacccaaatcttagcttctaatggcccactttccaataaaaggaaccaggccacttggagaaaaggttgattccagggctaaggcaggaaaagatgagtcctggaacattttatgatgccaaaagcaaggaaatgctcaaggaatggctcaaaaaaaaagtcagcctaaaagggatcctactaagtctgagataatttaagcatcaaaattaataatgatagcagtgcattataacctaggcaataaaacagcaaaccatgagtccacactgatataaataaatgaataaaagaaagtttgatgaggaatgggatatctgcataaatgtacctccacacaaaatagttattaaagggggaaaaaggtaattatatatatagaagtttgacaaccaccatcataagcaagtgattaaaatgaacattatcagcaacgggacagatcaaatcccatgccacctgacaggatacaatgaaaagaacagagcatccctctgtggcattcccaccaaaggtgcacaacctgggccaggcacggtggctcacgccagtaatcccagcactctggatggccgaggcaggcagataacttgaggtcaggagttagagaccagcctggtcaacatggtgaaaccccgtctctactaaaaatacaaaaattaggcgcatatttgtagtcccagctactcaggaggctgaggcacaagaatcgcttgaacccgggaggcagagcttgcagtgagccaaaattgcgccactgcactccagcctgggcgacaaagtgagactgcatctccgaaaacaaccaaacatcaacaacaaaaaaagtgcacaacctgaatgtaataataagaaaacagcaggtaaacccaaagtgagggacatcttataaaataactggcttattgtctttgtgtcaagatcacaaaagtcaaagaaagactgagaaattattcacactcaagaagactaaggaggtatgacaactaaatgcagtacatgattttgaacttaatcccaataaagacattattgggacagttggcaaaacttgaatgggatctgaggaataaatggctgtaatgtgacaaagttaattttcttattttagtgactgtattgtggttaggtcgaagaatgtccttgtctgtaggaaatacaaactaaagtattctggggtgattaggttgacaacttacttgcaaatggttcggggaaaaaaaaggttatttaaactatatttccagattttccataatatgtgattatttcaaaataaattttaattttaaaaataaaaatatttgacagtatgtagttctacctccaaacattaaagaattacctgaacctgactcatggtcggatttagatctgatgtatgatgggagatgagagccaaatgctgacaccagactgctcaaacgaaaaagctaaatttgtgagtttttatgccctagtaaaattagatactactgtatagttagctattatctcatgtaaatgatttttgtaagggcctagagagaagagtctattttccagcctccaaagcaccatcaccatactaaatgcatagtgtacacctcaagatatttccataccataaaaatatgtctcaaaatattttaatgcttttaaaaaggagaaaatagtaatgataggcttactaggaacccattaatctcatggattacagcacagcacatacaacttccgtggaacacaatttttttctgttcaagttatctttgtgaggaatgtacaagatagaaaacaaatactaaatctttggtgaccagtaccactcctaaaagcaaaaggaaaaaagcaatcctctgcctctgggatcagaggaagattggccaagcagtgtcactccctatggcctgtcttggtgcctacagttacaccattaaagatttaggttaagacagtgtaaacaaatgacttattataatgcaaatattccagagtttcccattcaataaaagatactcatgaaatatataattatgatttataattatgaataatttattgaatatctaaattatttattgcatagatattaatgcttagtaataataagcattttatttcctcctgtgtaataggcactgtgatagatattttatataaattatctttaaccattccaactctacaagatagatgttatcacctccactttataaataaggaaactgaagcccaaagaagttaaatcacctgcatagcgccaaatgtcctttcagttgcagagtctgcattcaaactcaagactcggaatttttccattacggttttttcttttcttagagattgggtcttgctctgttacccaggctggagtgcagtggtgtaatcatagttcacagcagcctcaaactcctgggctcaagcaatcctcccgcctcagcctcccaagtcacagggattacaggtacaagtcactccattacattctgcttcttctttcactatgtaatttactattctgaaaaatagaacctggcgcagtggctcacacctgtaatcccagcactttgggaggctgaggcgggcggatcacaagatcaggagatccagaacatcttggccaacatggtgaaacgccgtctctactaaaaatacaaaaattagctgggcatggtggtgcatgcctgtagtcccagctactctggaggctgaggcaggagaatcgcttgaacccaggaggcggaggttgcagtgagccgagatcacaccacggcactccagcctgggcgacaagggcgaaactccgtctcaaaaaaaaaaaaaaaagaaaaagaaaaaagaaaaatggagatctatggtatgagggaataaaatgccatataggaaagcttcttattggtacaggataaaactaaattatgagacttctgagtttggggtagaagaagccaaagaatgccttagaaccatgaaaggaagaaaggctaagcaaagggacataagggcacaggaagaggggatgagaaaggtctaaggacaaactgcctggttccccagttttcctacacagcctaacactagagttgacaaaagtccctgaattaataatgagctcagttaaaaacgacaggcttagatttattggcctgaaagagatggatcataaatgagggctgtgggctgggtgtggtggctgacgcctgtaatcccagcactttgggaggccgagacggatggatcacgaggtcaggaaatcgagaccatttggctaacacagtgaaatcccgtctctactaaaaatacaaaaaaaaatagcccggtgtggtggcgggcgcctgtagtcccggctactcgggaggctgaggcaggagaatggcgtgaaccctggaggcggcacttgcagtgagccaagatcgtgccactgcactccagcctgggcaaaagaccgagcctctgtctcaatcaatcaatcaatcaatcaatcaatcaatcaatgctgtggtgaacactgtactttccttctttgtgtgaaaggaatgaggacaaataaatcccacgtacatggtttagatgtttgttccctccaaatctcataccgaaatgtggttcccagtgttggaggtggggtctggtgggaggtgcttggatcatgggagtggacccctcatgaacggcttagcagcatccccttggtgatgactgagttctccaaatttacatgaaatctggttgtttaaaagtgtgtggcacctccctgctctctctcttgcccctggtctcaccattttatacactggctcacctttgccttctgccgtgattggaagcttcctgaggcctcacctgaagcagatgccagcaccatgcttccagtacagcctgcagaaccctgagccaattaaacctcttttctttataaattatccagcctcaggtatttctttatagcaacacaagaactgacacactcgcccatctggaaacatgggatggacaagttattaaaatacctttgaagacaatagaagttagacaatatcaagcacctagaattttgggggtaaaaaattccacactgggtttttgtgggggttgttctggttcaggtttttttctttttgcccaggctggagtacagtggcatgatcatagctcactgtagacttgaactcctgggctcaagcaatgcttctacctcatccccctgagtagctaggactataggtatgcgctaccacacccagctatttttatttttttattttctgtagaaacaggatcttattatgttgcccagcctggtcttgaactccttggctcaagcaatcctcccgcctcagcctcccagagtgctgggattacgggtgtgagtcaacacacctggactaacactgtatatagtgaaaataactgacaagggcatatttttaaaatgtctttaggtgatttactttaccactcagttcagtttactgttcatgtgctatcaagaaacaaatttaaagcaaaatactgccaataatatgaaactgataagcacacaaaaataattgagaactatgtaggaactgaaatatattactatataattttgtagaaaatgtactttccatttacatgttggaaatatattggtatattcatattttaacataagatatgcattgatccctatggcactaggaagcaatacagcacaattgaaagatatctgggatcagaaacacctgaatttgcttcttgaatctgcatgagtactgattataaaactactgactttgtaactctgggcaagttattcaatttttctaaccttttcacccataaataaaaatggggaagacattgcaagacttgtaaagattgaagaatataattttatgtaaaaaaagtggcctgtgtgatgtttacaacattgcttataataataataaagtcaaaaatcatccaagtatctatcattaagaaaatattaagtaacaacagtatatacaccagattagtggttctcaaattttagtgcacataagaatgttctagggggttgtaaaatgcatatttccaggccttacacttagaaattcttagaatactcagaaatcctggggtgggatcaggaaataacacgtttaacaaacaaccataggtgcttctgatggaggacatctatgaaaagtatgcagtagatggaatacgatgatgccattaaaaataactatgaagactttgaaatagcattgaaaaggtgtatgatatacccttaagtgaaaaattcaggatccaaacttgtacgctttatctgataactacattaaacatgcttaagaaaaaagttgtttttagcaataagattaaaggtaatttttgatcttttactcaaagttttaaatagtcatgctattattataaatgaatcactaacacattaaaattgaaaaaaaaaaacacattggatcctcatggccttcaggattaggctcaaactccttagggcaacacacaaggtccttctatctccagacttagctcttgtccatgctccatatcaaactacttataataccccaagctatattctatattttcacacactattattgaatatactgttccttctgcctgaaatgccctttctccaacttgtctggaaaattcctattcatcccacaagattcaagcactacctcctctctgcagtttcccctgaatactcctccaagtcaaattctgggtgcctccttcttgctcctagtattcctacagcattatttggtatttccattgctccatatatcaccctgtattttacctttttgctgatagatctatcccattattctgcaagtacatggggtaggtagagatgatctcatttagttttagaatccacaaagtactcagcaaatacttgttaaaataagtaaagacctattttttgttatcactgttcttagttatcagttttctaaaaaatcctgagtgccctgctggttagttggataacacttggctcaatgattaatgagctttgtctaatatatacatatatatatacacacacacgtagcataaaacaaacccatgaaaaatttttaagaaatagtttaaccattgtttgtaattcttcacgttctctgcttatgtcttcaaagtttctatcaaccttcaggatgacagaccactctggtcaatagccaaagcaggctaacaggaataactctgctctgggctcctccattgctggagtttacccagccaaagaacatccctgcagaattcttgctgcttcccccaaacacactcccactcactgccatctccgcactagcagtaaaatatctatataaaacagagataattctgtaagtaaatagagcagttttttagtatattcaaaacactagatactatatttagtatatttgtgtaatacataaaacatttcaaatgcagattactaactagaggtaccaaacaagaacctaaagtgactaatagtaattcaggccaaaaaaaaaaaaaagaaagaaaaatcaatgtggaagaatactaattgagatccaggtatcagaacttcaaatgctttccctgtaccgtaaaacataagttttaggaataacctggatgctgaagccaacttgcaacacaatttttttaaaaagaaaaacaaaatacattttttaacatttgaatctcaagccacattaggcattaaagctgtgatacaactttgttccatatctctgtcacctgtgatataataaatgtgtacagaaatacttttagtgcacacttcatagatactgtacttttttaaaaattgaagatttataggaaccatgtgtctaacaagtccatttttccaattaggccaatgtgctcagttcatgtctctgtgtcacatgttggtaattctcacaatatttcaaactgtttcattatttttatatctgttatgatcatctgtgaactgaataatgctgtgtgtgttctcaccactccaccaactggccattccatctctctccctctccttgggcctccctattccctcggatacaacaatattaaaattaggccaatgaataacccttcactgacctataagtgttcaagtgaaaggaagagtcacacgtttctcactttaaacgaaaagctagaaatgaataaacttagtgaggaaagcatgttaaaagtcgagacagactgaaagctaggcctcttatgcctaacagttagccaagctgcaaatgcaaaggaaaagttcatgaaggaaatgaaaagtgctactccagtgaacacatgaatgataagaaagccgaagagccttattgctgatatggagaaagtttgaggggtctggatagaagatcataacagcaacacaacattcccttaaggcaaagcctaatccagagcaaggccctaactctcttcaattccatcaagagctgatggagctggggaagctgcagaagaaaaatctgaaggtagcagaggttcagggggcttaaggaaaaaagccatctccatgacataaaatggcaaggtgaagtagttaaatgctgatgcagaagctgcagcaagttatccagaagatctagctaagataattgataaaggtgactacactaaacaacaaaatttcagtgtagatgaaacagccttctattggaagaagatgccatctaggactttcatagctaaagagaagtcactgcctggcttcaaagcttcaaaggacaggctctcttgttaggggttaatgtagctggtgactttaacttgaaaccaatgcttatttaccattccaaaaatcctagggcccttaaaaatgatgccaaatctactgtgcctgtgctctgcaagtggcacaacaaagcctggatgacagcacatctgtttgtagcatggtttactgaatattttaagcccaatgttgagacctaccactcacagaaaaaaagattcccttcaaaatattacagctcagtggcagtgcactagtcacacaagagctctgatggagatgtacaagagactagtgttgtttccatgcctgctaacacaacatccattctgtagcccagagattgaggagtaattttggctttcaagtcttcttatttaagaaatacattttgtaaggttatagctgccatacctagtggtagctatagaaccactaagaacatttgcgggccaggtgcagtggcccatgcctgtaatcccaacactttgggaggccaaggtgggaggatcacttgagcccagaagttcaagaccagtctgggcaacatagggaaaccctgtctctacaaaaaatttaaaaattatccaggcttggtagcacatgcctgtggtcccagctacacaggaggctgaaagcaaagaatcactgagtctgggaggtcaaggctgcagtgagcacagtgatcatgccactgcactccaggcctgggtgacagagtgagaccctatcacaaataaatagataaaacatttgtggttcatgggaggaggccaacattaacaggagttttggaagaagttgattctaactcttatgactgattttgagggattcatgatttcaacagaggaaggaactgcagatgtggtggaaatagcaagtgaaatagaagtgaagcctgaaaattggactaactgacaacaatctcatgataaaatttgaacagataaggagttgcttcttatggataagcaaagaaagtggtttcacgagtggaatcgactcctggtgaagacactgtgaacattgctgaaacatcaacaaaggatttataacataacataaataaagcagcagcaaggcttgagaggagtgactccagtgactccaattttgaaagttctaccatgggtaaaatgctatcaaacagcatcccatgctacggaaacatcttttgtgaaaggaacagtcaactaatgtgaaacttcattactgtctcatttaagaaattgccacagccatcccaaccttcagcaaccaccattctaatcagtcaccagccaacaacattgagacaagaccttctaccagcaaaaggattacaacttgctgaaggctcaaatgatcattagcatttttagcaatgaagtattttttaattacgtacattgttttgttagatataaggatgttgcacacttaacagtacaatatagtgtaaacataacttttatatgcactggataaccaaaaattttgtatgactcactttattgcagtggtctgaaaacaaatccacaatatgtctgagctatgcctgtacatctaagtaataacgtctgatataggcaaataatatatgtttatatctaaaatgggtttatataatccaataaaaaattctagagactaaatgagtagcaaaaagaaaatacttttctatcaccagccatatactctctcatttctcatgtctccagtcaaatcccttccccttcagcctttaagaaggaagaattagccaggcatggtggttcacacctataatcccagaactttgggaggccaagtcaggaggatggcttgatcccaggagttcgagaccaacccaggagttcaagaacagcaaggcaggaggatcacttgagccctcaacaacagaccccaacagacagggtttccctatgttgcccaagttggtcttgaactcctggattcaagtgatcctcctaccttggcctcccaaagagctgggattacgggcatgagccactgtgcctggcccacaaatgttcttaatggtgtctagcatggtcaatcctttccagaaggttttcaatttactttgcacagattcatcagaagaatcactatgtatggcaggagtttgaggaacagtgaggctctgtccttataaaaaaaaatcaaaaaattggttgggcatggtggcacatgctggtagtcccagctacttggggtctaagacatgagaatcacttgaccctggggggcaatgaggctgcagtaagctgtgattgcaccacagcaccccggcctgggtgacagagtgagaacttgtctccaaaaaaatggaagaattaccacctgtatccaacattctcttacgagcctggcaaaatccactccatttgttctgccagaagaggtcgatggctttactattttggcctaatgttttgttgcctctttaaatgaaaatacgaaaagagctgcttctttctaaaagctttaccaatcaattacaacttcactatgaattaactgtcaggtcccacaaacactttttggtggtaaagaaaggaaagaaaaggcactgggtccatgacgttagaggataaattaacattgaggtataagcattccctttcctctgcagcctcaccagcatctattgtctttcgacttttaaataacagccattctgactagtgtgagatgctatctctcactgtggttttgatttgcatttctctgataactagtgatgctgagcattttttatgtttgttggccacttgtatgtcttcttttgagaaatgtctgttcatgtactttactcattttttaatagagttacttgttttttgcttgttgacttaagttccctatagcttctggatattaggcctttgtcagatacacagattgcaaatatcttctcccattctgtaggttgtctgtcagtgtggaaggtagtacagagatttctcaaagaacctaaaattgctaccattcgacccagcaatcccattgctgtgtatatacccaaaagaaaataaatcattctaccaaaaagacacatgcattcatgttcattgctgtgctatgcacaatagcaaagacatggaatcaatctagatgcccatcaatggtagactggacaagaaaatgtggtacatatacaccatggaatactaggtagccataaaaaagaatgaatccatgtcctctgcagcaacatggatggagctggaggccataatcctaagaaaattaacacaggaacagaagaccaaataccacatgttctcacttataagtgggagctaaatataaagcatatgtggacataaataagggaacgaaagacacagtggactactagagggtggaaggggggtagattaaaaaacagcctattaggtactatgctcactacctaggtgacaggatccatgctccaaacctcagtgtcatgcaatatttccatgtaactaatctacatacatacttcctgtatctaaaatctgttgaaaattttttttaaatattcagataggctggaatctagagatgatgccagctggcacaaaaactggagccagggtgaacttgtagtaattagaaaaaaacgctttttttctgagatgtgattgaggagggttaaagggaatgtggtgtgggaaatagaaacaggaaaggaggttggctgtttatgctcacatccatcaatcaagatttgatccaatttgatcaaagaatggtaacaagtctaagcagtttgtttcagttcagttaactagaagtgattaaccacttcaaataaagctactctcataacacaatagaatccaaataactctactgcacagcttaatcaaagttccatttcacaactagatccatgaagacatgtcatttaataagaaacatgattcataagaatcagattcagagatgaacactctggacagtgcagtagaagaaacagagtgtcttagtctattttgtgttcctataagagagtacctgagactgggtagtttacaaacaatgtatgtttttgtgattcacatttctggatgctgggaagtaaaagagcatggtactagcatttgctcagcatttggtgaggaccttcttattgcatcatcccatggcagaaggcagaagggcaagcaagcatgggcaacagaaagaggaaattgggctgaactcattattttgtgaggagcctcccatgacacctaacccactcccacaataatggcattaatccattcatacatgcagagccctcatggcctaatcacctctaaaagatctcacctgtttgttttgtttttattttgagtagggtctcactctgtcacctaggctggagttcaggggcatgatcattgctcactgcagcctcaaactcctgggttcaagcaattctccccacccagcctctcaagtagttggggctacagacgtgcaatgccacacctggccattttgttttgttttgttttttatagagacagggtctcactatgttgcctaggctattcttgaacccctggcctcaagtgatactcccgtctcagcctcccaaagcctgcgattacaggtgtgagccaccacgtccagacagatcccatctcttcatactgtcacaatgacaaataaatttcaacatgagttttggagacaacactcaaatcatagcactgtggaaaacaaaatttatcctttggtcatattttttgatccatcttcaaatatcaattaaaagcctcatccagatttaacacaaatgtaaaatgtatttgatatcctactgacaccaaagaagaaaagtagactcttaagaaaagtttctagatctgtattacacaagaaaattcaatgagttttcaactggcattgtgcctctgcctgcccgtacggcttacataaccatgtcctcacatgcatgagaaagaactggaagatagaagcgtcttctttgtaaattcctttttcaaatataaaatattctcccatatcaacatatgatgagtaataaaaactcactgtattttaattaactaacatcattctgcaatatgtccaaaacggaaactaaagacactctaaaatgcattaagtgttaaatatcttcaggttccataggttgaaattagtcttttctaacctttgtctggcattatagtcagcttccatttctagttaaatactcaggaataatgttctatcataggcttctgatagaattttccaaaattacctcaaaattatttcagtatataactgaactaatcaaattgtttactgtcacctgaaaggttaagttgctaaagtcagcagaggcactaataaatattatatgcttctgccttaatgtcagtgaagacttgcatcagcctttgtcatctgtaagaaatcgagtcacacaagaaactgtgcaatggatggacaggttgagtagtagtcactggctggctgccctagttcactgctacacatcaccctcagtgttttgaaaagggagctgaaaaccctgctcagtggagaaagaggtcaataccaaaattcaccctcctttctccttactccccatcatgcagctggcactgttcactctggcagatacagctccctgaacataatggtgcaatcaccacttcaaacatcattactatctaaaatagataacccacttgcaacttgactatttttatagatataacattttcatggagcttaactgctctatttgtgatttattccatttaaccaatgcagtttccctgaaagtgagtttcttatatcagggtcccaataaccacaattgcccaaatagttgtgaaaattacagtacttcctagttgtctgttatctccctgtattcatcaccaaaatgacatgagctgaatcctaaatctgaaaaattataagctctctggtttttatgtttttggtgaccagaagattgttttgctccacttcttattgatctactttttcacatggggatcttaagaactgtattatttatttctgacaagaatttactaaatacaccttatataaaactcaactcttcgaggcattaagaaaatcaaataaattgaggcattaataaagttttatcactgtattaaaatacaaataattctctatcctatactcagcaaaaaattaattaaatatacattttaaatggaaattagttttgtttagaataaaaggtagttgtgccaaaggaagagaggtttttttttaagattttgcagctgtctcataaaagatatgttaaataaactgaaatttcacataaaatgtagaggaagaaaaggagggaggcaactcaattttagtgctctgatgagctcagatttctttaaggatgaaagggggtagtaagaggtataactgcaagcaaacacaaaaaaagaaatatatacttgtccaggaaaaatgctaatgtcctttttagctaagtttgaaaaagagaaaagaggtgtaacagttcactaatttcaccttcagttctggcagagtaaaaggaaaactgtgggtagttttaaaccacaagataattttctatgatatctaacaatgccaagaatctaattcttcccaacttttattttgcttctattttccctattgagaaccattttcaaatcagaagggataaacaaataacttcaggagattactgaaggtccaaacgagaccataagggacagtaagctgctttaaataagtatgcatatccagacccagaagaattagatgcaagagggtagaaggaatttttgccaatactaggaattaccaatggctcactgccagaaacaagccataataaagtagactgattttgatggaatttaaaggatagatcaaaagaatgccatacacttaaatacagtgtgaatttagaaaggcagtagataaaatacctcacaatattctcacaggaacaatggagagaaatagctgattgtcattgcgtggcttcaatcctggtagaaataccatgagtaaagactgttacttttaaatttatactaagttgaagagaggtgctttggggatatagcacagtgtgttgaatttaggttatagaaaacatgcttattacatctctggatgatacaggggagagaagttaatacgctgaaagacagactcaagagtcagaaagaagaaaaaaaagagtcaaaaagatatagagaaattacaaatacaacataaaacaaatcagataaaaaggaacaggaataatttaagctcaatcaacacttttaaaagtaccagaaaggggacctggcttcacaggtcattgaaaaaaaaaaataccaggaaattttaattgactgtatgttcaacatgagccaacaccattacatggcccagaaaatcttgacctgtaggtaggtcttagatcaataataaagagataataatttcattgtatcatgttttaatagctgctattttattttaattacataatacatattcattacagaacactgaaaataaagcccaaccacaattccaccactcaaagatgaatactatcttcattttggcatcttatcattccagacttcttaagcacattataagtgttcaaacaaacttattttttcttgcaaaaataagatcatactataaatgcttcttgtaacctgctgtccttggttttcttattcagccataatgttctactctggtcaagggacatctactgcattttgtgaatttctagtcaccatactttaagagggtcattgcaaaatttgagaatatgtaaagaaggaaagagagagtagagaaaagtatgaaaactaagttcttaacatctatgctgtcttgccatataaaaggttaacagagatgatagctcttccatgaaaaatacttataagaaaacaaaaatacatgcatctaaagaactatcctgcagatgaattagactgctttatattgacccatacagccaatctactaccaattgctgaaagtcacagggaagtggattttagctcaatgaaaagaaaaattttaaaataattacagctgtcaaaaatagaatgaatctagtcattggaaggtttaacagggctggaataactaacaggtaagaaatgttacagagaaaatttccgcactaggtgagaagttggaagaaagttccctccttatttgacgattctatgattgctatgggaaatttactcccagtccaataggaagcaaatctttagtcattaaggccttaaagaatacagtcaagtgctttagaggtgcatgaaaaatattaacactaacgatgaacacctatatgctaaatgttttgcattcattactttatacttcatttaatccttataatgatcttatatgataggtactattattactatttccactctgatagaatagtgaggcttagagaggtttttaaatttattcaatggcattcttacatttgctgaaaattgcagtgccacccaaaagcatacctgattccccattacatagttactgttgaaaggataatttcttattaccagtagataacaagtaatcagaagcatcttcagaaaagttcttgtctagtgaaccctcaaagggcagttgtgagatttttttaattagaaaaaaataccaaaatttaaggaatttcaaattattcttcatagcaaaaaatgttcagattggcctgtctaaattggccacatacctttaaacttttgtgaataaaacagattcaatgaatgagacttaaaatgttgtaaaacaaatctgaatcacagattttcaaatctttgccattattaattaagtgaccatgggcaagtccttaatcttatctttttattccttcatctgtgaaatgacaatggacctcctaaggctgacacaagaattgaatgagatgacacgtgtaagcacttagcatagggtctgacaccattattacacaacccaggtaataaagcaagcggggaaaaagtgccaaacatattctacagttccttctaaaacattaagaaatttcaaagtgtcattatgtttgacgggggacacattttccattatcctgccaataaatttctgatgacaatcatttttgaaataaagtgacaactaaataaaatgtgccttcttaggaatgtcattttatgcaaatgattgcccaaagaatacaatttcaactctcattttcttcagacactattcagtataagatggataaaagcaagtttaaaggttattggttttgtttgtgatttttacaacttggttcgaagtactctaataaacacatgttgtttacttttgttttctatgtgcaatctttgttgtagagctactactactactactacaccagcaaaagagaaaacctctcactcaagatatacactgtgggtcactattttgatactttagtgtccactaacattaaatacttggtgttttatccctaaaacttgacatctattctttaaaaaaaaaaaaaaaaatcacagctgggaaaggagtatttaaaggatgtttgcttttgagttttgtcacaaggagtgtttttaaaatacgatttatcacaataaaattaagtgaaattctcactgttctcaaataattcctcatgttttcccgaagaaattgtttattttgagaaaattctttcagcataccagtttttagacataatcatttttataactgatggatccacagcaaacgttgttattttacgtgtaacttaaaactgtaaagagataaattgctttcacataaactacatgtgactacaggcaattattagagctgcaatctgaaatatgcacacattgtctacctgtgtttgaaagagaagattatttaacaagggagtacacacaagtcatctctatgacctattgaaaaaatgtcccataaatattcattcttctgacatgaactatcattccaataaaatgtcactgtcaacgagtatatagaataacatatggggctttttaaaatcccatcgactatttttcaactcaatttatttcactgtaatagaaactttccattttcccttttagctagccctataattaattgcactgtctgaccaccacaacctatgagaacttgtgtaaagaacgcaatgtcatcacccaaaagtttctattaagcacttgtcaagggtagcatggaacagtttttaaaaaaccagggaaatcacttgggctttctaaaatttttacaactatagttgggttatccaagagatgttttaaggcgaagatatgaatgacaattgatgactccaaaaatacccaggataaattggatagccacgattttagaaactaaagagcttcccttgaattgtatctagtgaatactctccaggcttcctccctcccagttgatttcatttgtccatcaatacaacttttaatagtttctcaagtatggaaatcaaccccgctatttccaaggtactgctgaatgaagaccttgacattttttttaaatgtcatcttagaaagattctccaagcaataccagtctcacctacgacatcttcacgttaaaaggcctctaccgtactccatatacagtatcccaataccaacctggcatccttcatcctgagctataacaaccaagtttcactcagctatgtccaggtaactgaaagtattgctggggctgcctaacctgccccatcaagttttatacacaccctgtgctgaagacatctcaccagaaagaaggttcactcacttcattttgtgggatcataacccacggcacagcaaacgccttctgcaagagaaggtaggagccaccgaaggctgtggcttttgcagggtaattgcatgcacgcaagagattctctgccaatttcatttaactagacaaaaaaggctgcgttcaaagctgcaaatatgtaataaatgttgatggaaagcgggcggaacgtcgattttcttcaagcaacactagtacatgtacaagttctgcaccagggctcagaggaaaagtagcttactgacgcattgatggaaggctattttaaaattactcaaagaatctaaggcatcaatctgactgggaggctcatacctcctctccatacacgcagtctgttttcctacctaatttaagaatgaatcgctggcagccaccaggtgcaataaccgtgaggaggaggacgtatatccatcacaatgcataatgaggtgtgccaaccccggagctggtgcccgtccttaccttagcagattagacaggggcaggggtccggatccaccgcccaggatccctcctttcctgccagacaggagtttctccaccagagccacatttccagtgcgagcagcttccagcagctcctggtccttccccatagtctctcaccgactcccccacagagtccttgcccccctcgggtcctcctccccacccacccccactccccaaaatccagggccctcttcgccccaccctaaaataatgcaagagcttcagcacggagagctccctgcagccccaggcagggagcacgactctctcctcctcttcggggcgcagcttttacaatggggatcagaccatgtcttgaaagaggggctggccgagctgggagccgcgacgcgcccccacagccactcccctgaattcccaaggcctcgttcccgcgggtgcggcgtgagggggtggggactcgggggtgcttttgaggagcgggaggagggtggtgaggactgaggtcggaggaggaggaggaggcggcagagagagtcctagctggagcgggagcgcagggaacacccgcggtggcagcagcggcccgcgcgccctcgcgcccgacccgggctcgcctcggcttcctcggcggttacgcgggggcggcgtccgcggcggggaggagcgcggcggcggcggcggcggctcgtgcgctgtggcccgcgccgaggcagggcggtggggggcagccgcagcgggcgcgtgccgagggcggcggcggcggcgaggcctggcgcgcggggggcgtgtgcgcgcgggcaggtgcggcccctggtgcggcccgagttgggtggcgggctggcggggaggggccgggccggctgaggcggggcttcggccctgagattctcttcgttctcgtgggcggggaccctccctcctccactctccttggaagagcgttaaccgtgtgaggactggagttccccgggccgcgtcggctcctcctcggcccggcgggccccggcaacacgcctcgggtctgtcacgacgcctgaggaaaatcctccgtgacaggaatggggaggctggtgacactggggaggggccctttggccaccgcttccatcagagtctaggcaacttgaccggcatttcacccttccgctttacctccccaagagagcctgagatctgcccttggttagaaagaagaggctcgtttcgtcctagtttctgtggcactggccaccgagcagtttgcgactgtttcagtttttctggagtctttaatcagcccatattttagttgggctttggagatctgctgacttgtaagaataccaggaaaaaggctctcattgaaaatttatccacatctacactcgaaaaatataaatgggcatggattagagatccactttaatttgcatatatcatcagcaattcattgtgcatggttggcatgacttgttagatgctctccttggccgtggtggagaacgcgcgtttattttctattaaaacttcctgttacaccttgtgctttgcattgtccttggaatagacttcataaatgttcacttgttgataattgattggtaagaagaggacttaataggcactgtgcttacaacaacccagtgaactggatattattatatccattttagaaatgaggaaatagggctcaaatggttaattaaatttctcaagatgccacatggagtaagtggctgactcagaactagaccccagaacagactcactccagacaccatgtgcttcccaatatacgttcctgccccccatggaaaagcgaaatggacagacaataattattgcatgcatttgatgagtagttgctacataccagacactatgctaagtgctttccatgttctcattaagccttgcaacaatcgcatgagataggaccattttcatctctattttggagatgaagaaactgattacccgcaagataatagggatagaaagtaactgagccaaggctcaaatccggcactgtctgctgtaggcaaagattttcaataaataactgggggaaacttaaaaggcatttagagataaataacaagagtatattaaaacatttttatggaattcattgtgttctgagatttcatttcaatgattcaaaatattaggtaaattatggctatttattggaggtttcctgaagtatgtagattttggctagtgtagttttttaattcattttgattttgttttctgtgttagaatctgttttaataagataatctatgttataataatataatccctgacataatgggactagcagaccaatgaaagaaacgagataaggagccatcacattcattttgaaaatggcatagggaaatccttcttcctttttcctaatgttgccacctaagcaaaacacacctttcccagaatatactgtaagtattcaattggtcagaactgaaaatcacccacagttttcacaagcaacatttaatcatggatgagttggtgaccgcaggccccgagtcatcttatcgaaatcatgcagcccccacccccaatgggaaaaccattagtaatgatttactctaagaatcagttccacagttcgggcattctactgacatatgataatcaaagccaatttttcagcttcaaactctttggttttagtgacctcataactttgtttttctgtagacattgcagtgactgcacctcatagttttttgttgaagaggataaaggctttggctacatggggactaacatgcaaaataaaagtgaaaacattcttttaaaaatctacagaggccaaaataaatatccagatcttttaaacatccagatttcatcaagatgttttgcatctgtgaatagtgaaaagagtgatagaatcttgggaaccaattagacaatctctatctcagtgtgtgcataagtaaaatgaagaagttatgtcggatgccttccactggccttgccagccataatattctatgcctgtgatgaaacgtggtcttagtccattaagtcatttgcatcactgaagctagaaattaagtatggagatagatttgagatttctattctgtttttatttgatttgattttctgagacagagtctgactctgttgccaagactggagtgcagtggcacgatctcagctcactgcaacctctgctcccaggttcaagtgattctcaagcctcagcctccccagtagctgagattagaggcgcccaccaccacgcccggctaatttttgtatttttagtagagacaggatttcactatgttggtcaggctggtctcaaactcctgacctcaagtgatccacctgcctcggccaccctctattttgtttttaattataaaataaatatatattttttcgggtttttaaatctatctttgctattctcaatggacagtattaataatagcaaatgtaggccgggcatggtggctcatgccagtaatcccagcacttttgggaggccaaggtgggtggatcatgaggtcaggagatcgagaccatcctggctaacatggagaaaccccatttctactaaaaatactaaaaattagccgggcatggtggcgggcacctgtagtcccagctactcgggaggctgagccaggagaatggcgtaagcccaggaggtggagcttgcagtgagtggagatcgcgccactgcacttcagcctgggcgacagagcaagactctgtctcaaaaataaataaataaataaaataaaataaaataataataatagtacatgtgtattttgtgccaggaatgatactataccctttactttctctcattttatttaattctgaagtaacactgtaagaagatattataagtcctgcagaatctctgaatcccttatatttcaaattctgatataaatctacttctggatactttttggcaagaattattgctctaatatacacatactgcaagtcactcttctaggagttgattaataaaagaagggactaggggttgagattagaagggggaagtgaagcaaataccagtttttgtatagaagtgtttgcacacacacacaaaactctttggaaacattaaagaaattgaaggaccatgaatccagaccaatcttagaattatataccaaggtctgttttcagtgaagaagagaaaaagataatatcttataacatgaagttatcaacagagctgaaataagaagataaccctgtgatttatgaagtagatttactttctccatctcaagttctgaagttactctgcatcactagaactatgaagtcaacagcttcaggttacagaatgtgaaaatactagacatctggatagaagagcaggttcttgcttcctgcatgacattaaagttcttctccacatggccacatggcacaaactctgtccctcatcatcttcctgagggaacccaaacaccaagtgtattatatttacaatttttctgaagattcatggccatgaatgttgaaggccacagaacaccaatcacccatcttctccaagttataattagctgaacgcagacacaaggaatcaaagagtatctcattagcatatcatctttattacgagtcatataagggtctaatatcccacaaaatccctgctaaaactacactaaaaatgagacgagggcctacctctctgtgaatgtgcaccttgggacctacctgtggggaaaggtagatctgcaaatctaaatgtatatacccagccagactaatgcctatctcacagataaagtcagaggaatggagagaatgatcagtttccagggctgcctttggaaagcatgccgaaacagattcttaccccagaatctcaccatcttgggacagcaagcagaataaagcccactacccttcttagtgatccatgagacaggcaagagagaaagaaaaccagagctgagcctgtatcttgttttgaaagcaaggtagccccacccactagtaaagtggtcccaatggatagaagtagggaaagaaaccagaagtgttcactgtcttagaaagaggagcagagcctcctctcctctagggaaagtcagtgatgaggaataagagttcccccaggaccgtcacactacacaacattccatcaccatcctgctgattctaccattaactctctccgagccaccctgcctatgtgctactacctttgaaagcctatgtgccccacaggtgaccctgcacctggccagctgaaaaaatatagtcttgtatccacttcaaactattttcccaccaagagaatctacccaaaattcagataaatgatttttcaccatttctttttatttccccactgaggaaaatacctagcatcctgacaaacctattacacagtctctcagaggggccgctaagaagacacacaaacacattatccatttttggcatcttaactgatctccctgaaaggctaatcccaatctacctccttcttagactccatcctttccttcttctgcgcagtgatccacaaactttttcgtaaaaggccagagagtaaatattttcatctttgtgggcacacagtctctattgtactactaaattctgccattgtagcataaaagtagccatagacaatactgaaacaaattagtgtggctgtgatccaataaaatgtcatttatggatattgaaatttgatttgcaaaattttcataggttacaaaatattcttttgacttattttccaacaatttttagaaagcaaaatccattcttagttcactggccatacagactgtgggtgggatttgacccacgagccataagcctacagattgaagagtgacgtattccaaagcccttttggggatactgctttctcccttggtctgattgtttagacatgggggcagggggcagaatcaaattgttccccttaaggcatctcttccaccccagcctcagcagacagagaacctccccatcagcaaatcctctctaactctcctatatctcaagaaagacccttaggccaggtgcagtggctcacgcctataatcctagcactctgggagaccaaggcgggcagatcacctgaggtcaggagttcgagaccagcctgaccaacatagtgaaaccccgtctctactcaaaatacaaaaattagctaggtatggtgacatgcacctggagtcccagctacttgggagaccaaggcaggagaatcacttgaacccgggaggcagaggttgcagtgagccatgatcatgccactgcactccagcctgggtgacagagcgagactccgtctcaaaacaaaacaaaacaaaacaaaacaaaacaacaaaacaacgcaacaacaacaaaaaaccctttcttggggtctctatcatggtcacattactgagacttttgtattgtattatactggtgtgcccttctttaccatgaacagattggagaaggggcccccgctgagctgaaactcaacctatgaggagagggatgatgatgattcctgacatcagacaaggggccccacaggactaagacccagacctcttaggaggaatcaccggctgcttggtactagtgtctctgaggcaaagcaacaacgctggttctgcatattagaaaaactgcaaactggattcaaccgctgcttctggaacaaactgccactgccatgttgaagaagtgcagtctccctctcgcatcttttattggtagatcctcacagaggacaaggtggcaaagcagtaatatggtttgcaggttattataaaacagagtgatgagaatgggcttaaagttaagaggcagcagtgcaataaaaggcataaagccccctttaaaatcaggttaaaccagctgcatttcttgctaccatcatcactaaacttcacaaccagtgttttactcacaacttctgagaattcttgatttcctgtctccactcctaaggctcctggtcttctgtctccactcctacaactcatggaactcttggattctgtctcctgctctggcccagtaaataactctaaccagtacttggttccatgaaaaacccgatcattttctaaaaatctgaagagtgacacactgaataggaaaaactcaaactgtttctcctctgctctcacaccacaacaatcaacaccaaagacatctgtgaccaaatgtgtggagatttgcctccatcagtaagcaagcaatcagttctggagcggacaccaactgggtgtcctctaattcaattcaattctgacaccatctacctagagatagtgtcagatcccacaggttgagggctctgtccccaaggctgctcccctctttggatgccagtcacaaggccccagttgttttgtctgtgcttctgacccacctactgactacatatcagtgataccacccctccttgggttcaactaatttggtagagcaggtcaattaattggctggagtggctcacagaactcagagaaacacctccattttcccgtttattataaaagatatcacaaaggatacagatgaagagatgcgtagggtgaggtatgggagaaggggaaaggcgcttccatgacctccctcccggggtgcatcaccctcgaggaacctccatgtgtccagctatctggaaactctctgtgccctgtcctcttgggtcttttatggagatctcattggataagcatgactgaagcataaacaactgcacagaagtgattggacaaacaggatataatctaatactattagactgattggagaaacacagcagggcctgttcagattcttcttggccactctgcacagcagtccttcctcctgggtatggggcaggacctcttatcaaatgcggtcatatgaccttcaatcagttttactggagagtttctttatggaaagacagggggaaattagattactgccttggggagaaaaaggagcaggtgacaggagggcaggagaagctcatagagagagattctgtttgctaaggcctatttctgaggcctaaagcaccccgacattataaaaaaagattttaacaagggctttgggaattatgagccaggaacatgaatgaaaaaatatatgtgtgtgtgtgttatattgtatagatatcttacattgtttctcaaagaatttcaccaacccaaccacctgctaagactcattcgtctccagagctgtcttcatcaccctctgcctctgcccaaaggctcctgagtccagcagttgactttccctcccaacagagattccctgagaattatagcccagtggtagcccaacatgttccaaatgtttttctgggcagcattgtctttggattttgataaataaaatttttattattttattacatctgcagaaaggaatatataggcatctccttgaaacttcgaaagagattggttaaaagcagtctatgtacaacgtaccagaatctctggaacacatttaaagaagtgtgtacagggaaatttatagcactaaatgcccacaaaagaaagcagtaaagttctaaaattgacaccctaacatcacaattaaaagaactagagaagcaagagcaaacacattcaaaagctagcagaaggcaagaaataactaagatcagagcagaactgaaagagatagagacacaaaaaacccttcaaaaaatcaatgaatccaggagctgcttttttgaaaagatcaacaaaatggatagaccgctagcaagactaataacgaagaaaagagagaaggatcaaatagacgcaataaaaaatgataaaggggacatcaccaccgatcccacagaaatacaaactaccgtcagagaatactacaaacacctctacacaaacaaactagaaaatctagaagaaatggataaattcctggacacatacaccctcccaagactaaaccaggaagaagttgaatccctgaatacaccaataacaggctctgaaattgaggcaataattaatagcctactaaccaaaaaaagtccaggaccagatggattcacagccaaattctaccagaggtacaaaaaggagttggtaccattccttctgaaactattccaatcaatagaaaaagagggaatcctccctaactcattttatgaggccaacatcatcctgataccaaagcctggcagagacacaacataaaaaagagaatttttgaccaatatccctgatgaacatcgatgcagaaatcctcaataaaatactggcaaaccaaatccagcagcacatcaaaaagcttatccaccacagtcaagttggcttcatccctgggatgcaaggctggttcaacatacacaaatcaataaacgcaatccatcacataaacagaaccaatgacaaaaaccacatgattatctcaatagatgcagaaaaggcctttgacaaaattcaacagccttcatgctaaaaactctcaataaactaggtattgatagaacatatctcaaaataataagagctatttatgacaaacccacagccaatatcatacagaatgggcaaaactggaagcattccctttgaaaaccagcacaagagaaggataggatgccctctctcaccactcctattcaacatagtgttggaagttctggctgggacaatcaggtaagagaaagaaataaatggtattcaattaggaaatgaggaagtcaaattatctgtttacaggtgacatgattgtatatttagaaaacctcattgtctcagcttaaaatctccttaagctgattagcaagttcagcaaactctcaggatacaaaaccaatgtgcaaaaatcacaagcattcctatacaccattaacagacaaacagaaagccaaatcatgagtgaactcccattcataattgctacacagagaataaaataccaaggaacacaacttacaagggatgtgaaagacctcttcaaggagaactacaaaccactgctcaacaaaataaaagaggacacaaacaaatggaagaatattacatgctcatggataagaagaattaatatcgtgaaaatggccatactgcccaaagtaatttatagattcaatgccatccccaccaagctaccactgactttcttcacagaattggaaaaaactactttaaagttcatatggaaccaaaaaaagagcccgcatagccaagacaatcctaagcaaaaagaacaaagctggaggcatcatgctatctgacttcaaactatactacaaggctacagtaaccaaaacagcatggtactggtaccaaaacagatatatagaccaatggaacagaacagaagcctcagaaataacaccacacatctacaaccatctgatctttgacaaacctgagaaaaacaagcaatggggaaaggattccctatttaataaatggtgatgggaaaactggctagccatatgtagaaagctgaaactggatcccttccttacaccgtatacaaaaattaactcaagaaggattcaggacttaaacataagacctaacaccataaaaaccctagaagaaaacctaggca

SEQ ID NO: 491 - DNA, 28136 bp, Homo sapiens
ttggtatcaagacactcaggagccttggttggatatttagacatgcctggggcagataactgaatggccaaggatggacagcccatcggtccagcatctgatccattttcactgtcttcaaggcaggtggcaggtctttgcacagtgagatgtgaagtggattgaggggtgaggccagtggtgtcaccttgggatgaagaaatgcttgcccactagtccatcaggataggcttcttgaaagagtagcaatttcgggaacaatgtgacaggtgagacagagggtttggttataggaaacggttattgagcatgtgctgtgggctggtgcagctctagaaaataagggtgaagagtggtgacccctgccctgatcatgccattgcactccagcctgggcaataagagcgaaactccatctcaaaaaaaaaaaaaaaaaaaaaacccataaaatgtttttcaggttcattagtgttgtagcaagcatcagtatttctttcctttttatgaatgaataatatttcactgtgtggctatagcataatttgtttatagattgatggacatttaaattgtttctactttttggctattgtgaataatgttgctaagaacatgtgtgtacaagttactgtctgaacacctgattccaattctaggagtggaattgtgggatcacatgttaactctgtgtttaactttttaagcaacagcctgtacttctaattgcattacttaaattcaagcagtggtggtgagacaggggtaaagatgacatctgagagtacatactgttatttttcaatatttacaatttcttttcatctctttttctgaaagttgtttaaagtggaggagaataagctgagacgggccatcatctagtaaactgccccataggccgaataaactcctttgtactgtaagccccagcaggccagggatctttgtcagtttcaattcctgacatatttcaagtttagaacagtgaatggcatatggttggtgctcagcacatggctggtgctcaataaatatttgttgcatgaataaataaatacaatgaactgcctcaagtgtgctaaaatctcaagaaaacagacgtccatcaagtagaaccagaggagaatgggccgactttgtagccagaagtgcatggttagatatggtaaaggacttcccagagctatggggccctcagcccttggggaagcctcaacttcttcttttaacaccagccatgtgcaggtaattttacatatgtttatacggaagctctgagaggctgtggattccacagccaggcagcctagacggtggaacctgaatccaccccaggctgctggtcatgcaggccttgctcccactgtggggacagtggtccctccatcccaaggccaacgctcagccctaagaaggcctggggtgaggtcagcccaagggtacccaaggggccctcagaagagccgtggaaaatacatggtgcggccagaggaggaaggaaggatggcagcagagcatgcaaattggaagctgatatcgaattgcagcaaaatgagcagaggattagatgccccacctggacccaccccagagaataccaaggcttgggccggcccttgtgagaagctggcaggcccagtcccaggtggaagcctggcccctggcccgatgagcaggggcgatgaggcagggtggctgatcccaggcaggaagacaccactgatttgggtgaggccctccttcctgagccctccaccctcagcctgggcatcccacactcatagagctcctcctggttctggggaaggagcaggattagagccaagctgagaccctatcccaagttcctgccttcagagagtgcaggggagacggggataggaacacatccaaatgcccaggattctgagggggttgggggaaggggaagctgccttgactgagtaagtcagagaaggcttcctggaggagagcgaagggtgtggggctgggttgagatacaggaagatctgggtttgaattatagtttggctgcttcctagctgtttgatcttggacaaaactttcattcattctatattttttggagtgtctactccatgccaatcatgtgtgaaatgttgggataacaaaggcgaattcaatctggctctcgtcctcggagcttaagcaaatcatctggggtagcgtgacccatgctacgatggaggtggaatacggggctgcagggcggggccacaggacatagtgggcagcttaacctccttgagcctccctatccctaattcacgtgatggggtttgtaaccacttctcacatcgttgagagaaaagggtgagcctgactcagaggtgtggcaaaggaagggcagggcaggctttaaggacagggacagggctgtcagaggctgaggctagggaggggcaggaaggggtgtgaggcagggcggaagagagcagggccctgggcaggtgctgagccaggtcctgcaggtcacccagtcgcttgagtccacgaatgctggaggcaggcactggagagccagggtggttcagccgcagctcctctgagcagggagtcaaacaggtttgggtgacccttgtgagcaaggtcccggggcatcactaatttccacccccttctctggtaatgactctggtgcggcctggccctggcagtcacagctcctctctctccctatagggctgaaacagacaccagctctccaggaccagctggtaagagcttctccactgcccccgagccctgacaggaggactcccacagtgtgcatggaagcccagggagctcgggggctacagaggcaccattggctctggagcctgcagcccagacagccccctccagatgtaatgggggaaggagccagggactgggaggaattcagaggtcagaggaggagcagtatcaggagatactgccctcctgcaactcctcctcccagctgctctcccctcctgctagtgcccacaatggctcccagctgcctcctataaggaagctttattagcctgcagcctgtactcctccacgcagcagagctgacaggaccccattagtcagcttattcaacccttcccctggtgcacaaacccttgccaagcttttctggcattttgctcagcctgcttggaccctccaagcaggtaggaactcactgtttcacaaagcagtgttattagaaaggtttccctgaccctagccccccacatctaatctttctcaaatgtgggcagacttgttcctggccccttctcattccaccagtgcacacatgcacatgctccctctctccatccaagctccaggaatcaacctctaccctgaaccaggtccctgaggaccaccacgtggctgcaacacagcaggtgtggggcagggcacaagtgggcttaaggggggtataagggctggcagtttgctcattgattcactcaacaaacatgtactgagcacctctaaagggccagggcctgtgctaggcactgcggtgccatggtgagcaaatccagaaatggaccctgccctctaggagttcacagtccagaggagaagcccgatgctgaacagagaatcacatccgtgagcaacacaaaaggcaaggcaaaccctgggcagatgcccccgggactgtgtgttatgggcctacaggaagcctctcccaatgaaaaagcaatttttcagccagaacctccaccagtgtctttcaaactgtgagtggcaacccatttgtgggtcataaaatcaatttagtagttgtgacctgaattacttgttagtgaaatagagaggaatttacaacatcacacttaggaaatactgttttgtgaaatgttagtttcagttatctatctatctatctgtctgtctgagagatcatgtttattagttaagatattaaatgtatttcttactgcaggtctcaatcaaaaacctctgaaagccactggcctagagttagaggaagagttagccatgagaaatggtggtgacacaggttccaaaagaagaaacaataggtatcaggctcagagatgaaagggctagaaggaggacacaccaagttcaaggtctggcctttctcgagggcagtggggagccatgggaggttagcaagatcccatcttcttcatccctgggcctcaccccatgggcaggagggaaatggcaggaagttgtctttgtgtctccccaggagcctggacctgtggccttccctgcctccacctgggcctcaaccgtcacgaccacctggcctttgaggtagggtttggagaaggaagtcagcctattatcaggagaaggcttgaatttctatattcatagcttgtttctgtcacttactagccttgtgatcatgggcaacttgtctaatctctgtccctcagtttcctcctttgtaaaataggtctcatagaactcatccccaaaagtccttgtgaagatttagtttgtaagccagatgtctgcagacctccagtaaaagaatatgtttttggtattagtatgtatgtcccaaatattgcttggaatatgcttatacaaacaaaaatcatttgttttttatctgaaattcaaatttacctggatgtcctgtattttatctggaaaccctacacagaaatcaaatggctcacgctgtgtctcagagctgcaacgatccaacgccctccatccttcagaggctgtctgagtccggggacacaactcccaccctcctctcctgccagccgcggcccgtggctgctctcttcacttcgtcccgcttcgccccgactgtggatctacccgctcccttctccctcagtccccaaagcaccagactcacaggcctgctgtgtgacccacttttaccgacctttcggggagagtagagggcatttgtgactcagctcagagcaggaaacacatctcacgtcaactgtcagacagcgctgctccgaatcccatcacagtgctccagcagggggcgtcctcaccggccgcggccacagccacggctcaacccggcctagctcccagacaccctccttccaccgcctgttttccaccgtccccgcctgctctttcaagccagcagcaaacaacaccctaatccgtgtctttattattcaaagaccttaagcactctttcccacctcgttcccatcttgattatttcagggaatgaattagggattcacctttacaatcaaaaaagttctctcaaagccaggctactggagttctaattctgccttcccacttttactagctgtgaaatctcaggaaagttacttaacctctctctgtctcattttcctcatctttaaaaaacaggatgataatatttagctcctaagatggttgtgaggatttaagtgagctgatatatccaagaatgtctagaacagcgcgtggcagaatgggcattgcatatgggtttaatcttgtaactgccatgtttcaccaattctaaggtgtatctcgtttctcatcataagagctcttccgctcgtgtggcagctgggagtggccgtcattgcctgcgcatacctaaacttggtcaggtgagttccgtgccttcagcttaattgctgtttaaaatgtcttcaaaaaggttacactgtggtttagcatttaaacccagttactgtgtatgcagaaaggcgggcaaacagaagagtgtagcaagaattttatattagtgaagcagttatcattgaagaatgaccacagtttcatattttcttgcaaaacagcagccaagtgttttgtgagacctaagaaaggaagagccccataagtaaatggaactgttgtgttgttttattaccgagaaaagggcagaatgattgctagtcacacgtgaagcaagaaaaccccggcaataaagcttgcagaatgagtggctgaggcttgaaaataaatggtggaaacaatagtggacaatcttttaaagaatggcacattgccaatgctcctgatggcacagaaggtgacaccatgcagaaaatcaaggctctgagtcaaagagggtttcagaaaaattggactctgaatgtgaagaaatctggggactattttagccaatttgttttgcctataatttccttttatgcatgcaaaagagcaattctgactttaaagactgatatctaaataaatctaaaatatcttttttgtgtgtgtgtctgtgatacagtgtctcgccctttcacccaggctggagtgcagtagtgcaatctcagctcactgcaacttctgcctcccagtctcaagcaatcctcccacatcagccggactacaggtgcacaccaccatgcctagctaattttttgtgagtattttttgtaaagatagggtttcaccatgttgccagactggtctcaaactcctgggctcaagtgatccgcccaccttggcctctcaaagtgctgggattacaggcatgagccaccaagcccagcctataaaatacgcataacataaaatttaccatcttaactttttttttttttttgagacggattttcgctcttgttgcccaggctggagtgcagtggcatgatctcagctcactgcaacctccacctcctgggttcaagtgattctcctgcctcagcctccgagtagctgggattacaggcatgtgccaccacacccagctaattttgtatttttagtagagatggtgtttctccatgttggtcaggctggtctcaaacttccgacctcaggtgatccacccacctcggcctcccaaagtgctgggattacaggcgtgagccaccacgcctggccctcatcttaaccatttttaagtgcacagttcagtggcattaagcacattcacattgctgtgaattcatcagcaatttttgtcatgttctaattaatagtgcatgatagatgcatagacttcctaagaaacagtgtagtggccattgtagaaaaaatgcagccatccctgcaggtgagcagagctgccagccagaagcacagccaagccccgccagctttgatgagaacaccttcttcctccctggcatgaagggaaagtcaaatgcaaacacaggcatgagccgtgtcatcgttggccccttcccctcctcccagactaggggccagatcagaatgtgagtcctgactactattgtaagctgtgcggcaggtcatactctctctggaattcatgttctcatcatggaaactgaaatccacaggcaagatgatctctaagatcccattagcttctaaatgtatgattgtgtaactgaacaaccacacaagacacacaccacaaacatatgcaaattcgggttgggtctttgtgggctccaaggagaagctgtcacacctatcctggtgtattgggaagcaagagatttttacccgactgggttaggagtggttcttcccagaatcaagggtcagtaggccactctgtcaagatcgtgaataccttgaccaaaggagagaccagaaagggtgtgtggcccatccgagagcacacagcaactaaatggttgggtgtggatttagaagccactgtcacagcttcagttcacatgaggcccaaggagaaggttttccaggaacccctgagactcagtcctgaacttggccagttggggtggacagtatatccgaaggtcaggagaagtgatacatgaaaccacaaaagaaaggagtaggccaggcacggtggctcacgcctgtaatcccagcactttgggaggtcgaggcaggtggatcacaaggtcaggagtttgagaccagcctggccaatatggtgaaatcccatgtctactaaaaaaaaatacaaaaagtagtcgggcatggtggcatgtgcctgtaatcccagctactcaggaagctgaggcgacagaattgcttgaacctgggaggtggaagttgcagtgagctgagccactgcactccagcagtggggaaggcatgttccctgggtgggggcagaggcacaccccagccagacccctctgagtccttgtctcttcctatgtgcagagtctggaggtgggccccagatgccctttatatgacaggggttggggtccccctctccgtcgatcttctcccggaggacccagaatgcctgaagttgggagggatggctgagggaagagtgccagggcaccaggtgtctatgtgtcaggccaggagttaggcactggaaatacacaggagaacaaaccccacaggaatccctgctcttttggaacatcacttctgtatgggtaatttttattctttcttcctccccttcctcttccgctttctcttcctcctccttcataatagcaggagtcacgagtccccatatatatatgtatatgatacattctcagttgcaaaataccttcccgttcattatcttactgcattctcaaaacaactttatggggtaggcatccacactcccattgtccagacaaggaaactgaggcgcagaatgtggctcggtagtgtggggtgtggcagaaagctccagaccaggctccagtcccagctcagccactaacctgctggagcaccctagataagtcactcccctccctgggcctatactcacccctcctgcccaccccacatccccatgatacaacacaaagcgctccactccagtctccaatctctcccagatttctgttcctgcgactgtgacttgcccagggacctgctggacaggagctagggcagggtgcagaagcccgtccttctgtccccactctgagcctgaccctgctgtgaatccccaggagagggagcgaggctggagggattagggaagggccagtgagtggggctggggaaacttctagacttgaacgcctccaggaccccagtggccacagcagcactgatagcaggaggcagcactgcccagatgctgagctgagtgggcaccaaggccagagagctgcttatcaggcatcacagccgccccgagcctgcacagctcactgccccacagaaatgtctttctcctgtggccagagcggccctgagctcctcagggtttctaggacctgtcacagcttctgggaccccaacaaatgagtgtgcaaagacctgttctcctcaaagtgcaaataatactgtaagtaagggctgatattcattgaccacctactgtggacgaggcgctgctctgagcacttgacatacattgtttcattcaatccaaaccccaatccactaggtcagttttattctccccattttacagagaaagacaagaaaggttaagtcacatagatggaacaggctgatgccagaatggacaccctcagcttcctcagccgccccaggttgactccatcaccaagggccagggtcccagtgcccccaggctctaggagctgctgtttggctggggctcccaggagaaggtgaagcttaatgatttatgggtgattagctgcaagaatgcaagcacagaagacacaaacctttatgccttggaaatttgtcacaagccaaccagttgttttccatccctgtgaagcaggaataattggaggtctgacagaagaacttcccagttaccagaaggagcagcactcatgttctctcttagttttgtgtgaggtgttgcccctgccttggtcaacagtttgagtcagagagatgggggccgggcacaatccccaccagacgttcccattcacaagaccctgtgggggctgggagacgccctggggcagcagccctggggtaaccaagggaacaaacacggaaaaccagggacgtcagtccttatctggagctcattaaatggggaacattagtcagctgtgaaggccaagatagggtgataggcctgtgggtgggctgggatggggcatgggggcagaggccgccatggaggagaagaggtattggcctcaacgactccacctccccgccacgtgcccagatccgggatggaaggaccctataaatgcccacaacccagcctccccagaggccttgagaaagagagcgatagagtgcgagagcgagtgcccggagcatcctggccctgagacagctgggccagccccgcagggctctgcagcatgtgggagctccgctccatagccttctccagggctgtgttcgcagagttcctggccacactcctcttcgtcttctttggcctcggctctgccctcaactggccacaggccctgccctctgtgctacagattgccatggcgtttggcttgggtattggcaccctggtacaggctctgggccacataagcggggcccacatcaaccctgccgtgactgtggcctgcctggtgggctgccacgtctccgttctccgagccgccttctacgtggctgcccagctgctgggggctgtggccggagccgctctgctccatgagatcacgccagcagacatccgcggggacctggctgtcaatgctgtgagtagccacaactttgccatccacaaggggcaggtcctggggaatcccttgtaaaggatgagatgggagggatgggctctgggtgatgtagggagagagatggagacagaggcagagagagaggctggagccaggaacacagccaccataggagggtcaggatgaaaggagcaatgataccagagcaaagcaggatgcagacagactgctggcttcttccaccctgaccgtcgtgcaggaagagcctcatccaggtttctgttggactcaacgcctacattacagtgaagacagggctatacctcagcaggggttggtgtcccgagcagacatgctttccaagctgcggggagccttggagtgatcatcacagggttctcaagagagaagaggggcccagcatttcttctgctttgagggtttgcaggtcccgtggcaggtgctccttacaggccaggcacggacacaccacagccctgcaagcagcaatgggcatactcacttctccaaaccttgaggaggtccccggagcccataagctggctgctgattacatgatacaggcgctaactgggccccgtgggccctttgggagctgagggtggtgccacagtcccttcccccatgtcccacccacttcccctctcaagtctgtgtgggccctgtgaatccaaggcccatgaatgtggaggaatgacctgtgcccccaacagatcaacactcactctgtacccccatcctaagccaggacagtgagtgcctcttttgtgcttgtttccggtagttcccggccttttccatccttgagccactggacaagagtcctgatgtctttgatgagtcccgcacaatctctgtgggcgcccccttctctgcacaagtggcccttcctcatctgtgggacagaggtatcccaattagggaacttctctgctttgttttgttttgtttttgagatggagtctcactctattgcccaggctggagtgcaatggtacaatctcaactcactgcaacctccacctcaggccattctcttgcctcagcctcccatgggattacacgcctgtaatcccagctaatttttgtatttttagtagagacaggactcgccacgttggtaaggctggtttcaaactcctaacctcaagtgatccacccgcctcagcctcccaaagtgctggaattacaggcatgagccaccacacccagcctctgttctttaaagaggaaaatatgacaaggctgggggccaggggccaaggaaaggctaggtgggcaagcagaggagtgggctcatttcctctgagaacaaaattagttcagtttgcagcaagaagaggtccagttagactgaaaaaggaacttcctgagagcatgaccaggaagtccttctctaatagcagggcactgggagtgaaaggccatgggaaacatgcagtcctcctcctccatcatttcacaactgactggggccctcagaagagaaaggtctgggagggctcctccatgccacttctcagcatttaccaccttgaggacctggggagaaccctgcctggatggaatggggcagtggtgggaccaacttgctctgaggctaaggagagccagatgaccctcaagacaatcccaagtgtcctttgaggacactgagagccagcctggccaccaggaagttaatcattgacatgcacctgccctgtgccaggccagctatcatctcatcattggtacaacgctataagggaaattctgtggttccccctatggtgagtggcaaattgaggctcaacagcaattgatcaaagtcacagaaccaatatgtcatttctagtcctcccacagtcctccagaatccattttcttatcccatttcacagaaggagaaactgaggccaaattaagtagtcccatggcaagtcagaggcctccaaagtgtctgcttccaaagctcttttcactgtcctctagagactctgcattggacaacaataggagggattgaggttagaccctagagagacccaagggttctgacctgatgtctcggacccaggggtgggggttcagggcctggagaaagagcgtgggagctgagagctgtcactgttccacccagtgcagtgcccagccccagaaggcagggtgtagggtacagggtgacaaaacccaaggagaaatccagtgctgggtgcggcccagttatgaaatcacctctttactcagccccgagttctctccttacccaaggcagggtctgctgagaccatgggcagcctacatgggtgtggaggcattgtccaacacagctccagggcccttaccccaacctccataggatgtgcagggagcaaactaacagggcaaacctgaggcctgaaaggcagtggggaatagacaagggttagggaaagaggtagattccggactcatagcggaaaggggcacactaggactgtcccccagacccaagtccctagaccctgtctctgggagccatttaacctcaggaagaaagaccacaggcctctcattgcaccaaggtctgatggtctacagacagaggaaggtcttcctgctaaccggcccaaagcttcctgaggcagttgaaacctcttcccttcttgttctttgggaaacagaaattccggatctcagcattcttttcctctcatactgcaggctcccagcctcaggccccaatctaatgggctacagagtcagttttgctacctctggcggggggaccatgggcatcctgggggatcaggggctgcctttgggccagggcccaggaagaagggatcagtcgttgcagctaaggcgtctggcaagcccaggtgttccggctcccagcccagaggccccctggtgcctcgactgcaggtggacaggaagatggagccagagaggaaagtgggctcagtgttcccctacccgcctcttctctgtccccagctcagcaacagcacgacggctggccaggcggtgactgtggagctcttcctgacactgcagctggtgctctgcatcttcgcctccaccgatgagcgccgcggagagaacccgggcacccctgctctctccataggcttctctgtggccctgggccacctccttggggtaggtcatggccatgggttccagcctccctggaggaacagacacacagaccactccagagacagacacagagaccccaagagggacacatacacagaactctcaagaggaacagacaccccagaggtttgactcctagataccccagagggacagatatcactccagcccatctgtaaataaaacgtgatgttaattgtccatcacgtgggttccctttaggctgaggtcaagcactgcagtgcgggacaaggacttcctgccctgtcctcacctcccttctctctttgatgccctcctcccactgcagatccattacaccggctgctctatgaatcctgcccgctccctggctccagctgtcgtcactggcaaatttgatgaccactgggtaatggctgaaaccccctgccctccccttctctagaaacccattttagagggagaacaagagctggaatagcatgggatgggggctcagcagcggtaccccaaaccctccacactcctcctggtcctggggagccttgggttccacccctcagatctgatgccaaagactcagtttccacgtctgtgaatgaggatgacaacagcttacctcactggcttcttgggaacagtaagtgaggttaccggtgtaacccagataatgcagtgtctggcacttagaactctataagtggtagtatttagcacttatctggtgcttagtatgtggtgagccttgttctgagtgctttgcaaacattaactcagttttcacaaccaccccaggaggtagacattcttagagtgaaaggcacagagagggtaagtaacttgttgaagtgcacacagcacttaagtggtggaatcaggacacacacaggcagtggcttcagaattcgcacccttaaccccgcactgacaaggcttccccagcagctggcgttgtcgttgtaattacataaataagcattttactagattaatgtcggggaggagaggtgcggccgcagagtgtgccgccggggcctgcgggctccgcgtgccggtgccggcgcgggtgccaagccgccctctccgctcgcccccaggtcttctggatcggacccctggtgggcgccatcctgggctccctcctctacaactacgtgctgtttccgccagccaagagcctgtcggagcgcctggcagtgctgaagggcctggagccggacaccgattgggaggagcgcgaggtgcgacggcggcagtcggtggagctgcactcgccgcagagcctgccacggggtaccaaggcctgagggccgccagcggcctctacggccccgacggacgcttgtgaggcccgaggcagaagggcccaccccgtccctcctctcccgcaggtctgaagttggccccccagcgcagagtagctgcttcctggacgtgcgcgcccaggccagtgctgtgagcaggcggggaggaggctgccggagggagccctgagcctggcaggtcccctgccctgaggctgtgagcagctagtggtggcttctccagcctttttcagggaactgggaacttaggggactgagctggggagggaggcaggtgggtggtaagagggaaactctggagagcctgcacccaggtactgagtggggagtgtacagacccctgccttgggggttccgggaatgatgcaactggttttactagtgtgcaagtgtgttcatccccaagttctcttttgtcctcacatgcagagttgtgcatgcccctgagtgtgaacaggtttgcctacgttggtgcaagtgtgcatggctggggacttctcacttccccttgcaccccttcctccccaacctgcaataaatccgcttctcctgcagtggatgagtgtgggtgccagtcctcctcaggagaaggggaagggaaggaggccactttgagagggctgaagggagggccttgatttccagccgcaatctggctcctcctggaaaatttcccccacctgcagcgctgggccccaaggcttgccaagactcattgctggaggtagagaggtgtcaaccagagaacagctcccctagacatggcctctggaaaaaggaaatctttggtggccaaagatttcctttctgtggtgagggagaacctctccaaagaggaagcaggcatatgagtgcgcacgccttcacgtgtgtgtatgctgtgtgtgcccgggacccccgtctccaggggtgccccagacccagagattagcctcccacttcggcgcagaaaacaaaagccctttgtgggacccgggcctttgtcttgggtgaggggagatttgcacctagacacttcttgaaaggagacactcagtttcacaagtgagccctcttgcccagcacacacctatggctggctgggcaaggcgctcaggcatgcaaccatgggcaccaggcaatacccatccatcacccatctcactctccccagtcctcaggcagcagcttttccaccccaggaatctctgttccttctctgtctgcctctccacagcccgtgatcccctgcttctggctcctaccactggacagtcattgtggatagagcagcctgctgctctcaggaccagagaagggaaatgacttctccaggcagaggcagatctgagtctagaacccaggcttctaaatttctaggccagtactactgctctcaaaagagattaactgggattaagtgagatgacgcatgtaaagatgctgtgtaaactgtaattcttaataccattatcacgcattactagaatcatttcattatttctgcttcctgggggaaggatgcagaaggagtctgatgctcaacatcccttacctcctttcgttgatggccaaagcaaaggagagtcctgggagcccacaagatccaggcagaaggagatgggtttggggctggccccatcctggcccagcctcttaacctcttcttaccctgaatgtgtgccctatcttttctcccacctccttcctcctaccacccagccctatccattctctccttccctctccagcctgctgtataagtaacatgtgggtcataccttgaacccccctccgcccccatgctctctgtggcctccatgccttcaagacttctgtctgtatctatctcacactgcaccaagcacccactgtgcaccaggcactaagtctctagcctctttctcccttctgctcccatccaagaaagacagtgtataaggaacatctctgtaattgtgtcccctctcatctatgctctttcctgtcttccttgaccaaagctctctttgaggtccaaaaaaggctgccctgggccatatgtgctatggagaggactctcccaaacccccaatagctagtgacagccacttggcctcactaccagaagaagggtggagtcagaaaccaaagtgacctccagagctgtcctcctggcacctgagtgtccttgctctagaggttcaaaggcagcaaggcagtgagctatgagcccagcatggatgtgtctcaggcacctcatccccaccccacctcaccccaacaaactcctctagaagaagccaagaatttctctctatgtctgtttcactttttggattgcatctccccaaaaactaaatgtgaaatccctaccatttctagcctctattgcccagattggagtcagaggtcaaaaaaggattccaagtgatggaactccaggggtggagggaaattggcagttcctggcatctcttgtgtaccagctgctgtgctgggtgccttgcatgcacggacttatctgatcttcctcaaacttcagataggttagggaaggacaaaggcccccagccatgaagggttttgctatttccaaagcttccccttatcgtcccctgtgattatctcccaaccccgtgacaaaggtagagcaaatattgttcttcccattttacagattcagaaaccaaggctaagggactggtctaaagtctcacaggtagtatatggtggagccaacacttgaactcagacctttttacacaaaatcccatgatttttccactgagacaaatcctaggctcctgggaggccctggcagaagccagaacacatggctgggcctttccagcccaacccactgtcttgcagtggacggagagccttggcgagggcagcagggtagagaggacaaagaatgtggggctggtttctgccctttaagagcacccggtcagtcagagaacagagatcacacacaccaaaccagacagaggcagggcagcatggagacaggtagacagacctccaggtccctaagctggggacagagaaggttctgagctgtcccatactcccactttgtgccaaatgactttgcacctgcaaatggtgcttcaatgtcgttttgtatctttaagctgtgatgttgtatatatacaatgcctcccagctagactgtaagccctttggggacaagggctgcttccagttcttggatggcgttctcctatctaccttccttcaactgctctgcatataataagcactcaataaatgctcatttgccaataagtactgtttcttccacaacttggcagtggtaatagaaatacagcccaaggtaccagaagacaggcggagctccctaccacttctaccccagccctcaacttctcccagggaactcagaagtccccatatcaggagaggaggggaagggctctccctaagacattcaaattccccctgccacaaatggggagacccatcactcagctcacaaaggtcccgggcattcctctggagctgccagggcagggcctgagtgcttgggcaaagagaattccgagacataatgggagtttactgtgatgacttgaggacagagggactctagtggttagagagatggaagagcctaagacacaggccctaggaaacagaatcagctgccctgtgtgagtaaccttgacagatgaaatctccttctttggcctcaccaggcccactcctgatgaccaagtctatgtggcgacctgtggttcccatctcaggtcactgtgtgaccctaggcaagtgacctctgagtctgggtttcttcatgggtagcttggaatcaaatcacacagtggaggccaattataatctctaactttgtagattatattctgaatctctaaaatggcaagaacaaggtcttggcctttatagtccctcattagttcaaatcttcaggtcggagcttcccctggcagccaagcctcttgtgagcacttgtgaatcctttcattctgagatgctggagtttgagacctgtggactatgaagacagtgcctggggagagaggatgagaaagcaagtgaaagggtgcgaactggaggcaagttcagcagcaaaggagcctggcccccaatggcctctggggtcatcagggtcattgtccagcccaagtcccaggcccagaagaaaatcctgcgtacaactggcatgtacagctggcatgattggctggggacaaagcgctgggacccatggaagaaaggacagactgacctccggccttaagaggagagacctgggggaggagctgctccagcaggaaatgccagagctgggcaggaacaatagcggggtttctttagcccttgttttctttggcatcttagctgccacagagcccagagcccgctcctccaagtccttagcattcctgcaggctcctcccctcagccctgcctgacaaactgacagaggaggcacctgttctctacttcctctgcaccctcccgctggactcttccccctagcttagcaccacactaaaccctcaaggggcttttaaaattaacagtcacaacgtaaggagactttactgagccttactctgtgccaggcactgtgctaagggcttctctaacacacatggggatgggagtctttaatgcagctcctctcccgggatcctgggggtgggtcctccccctctaagccctagagagccctccagcctcgttctccacatgcccgacctggagtgggtgggaagagggagagggtggtgtgcgaggaggcagcaggtcacaaaggggttacaagctcagagggaagggggatgggaactggaagaaagtgtcacccagaccaggggtagaagaacttgactttggggagactgagaaagaccacatgtaagagagagagacatggaaaatgaggtagaaacagacagaaacaaagaaaggcacaaaaattaagaggcagaggaaaggtgaaaatagccaggagacagaaactgcaggatgagagaaatgaatagagagagacagagagactaagacagcaaaaggcaggaaggaaaaacagaaaatgagaaggtgtgagagagagagagatggagaggtggagaacagagagactgaaatgagaaagagacctctcggagagagaccgagaggaagaggctggcagagggagagggtcagagaccaaagacagagacaaaaagagaaatagggttttgcaaagactgactgacagaaacagatttcgaggggagagagatcaagaccaagtgagggtttgaaggagacttaggggaggtggaggaagagaaggagagtcttagatccagggtgaggggcttctagcaggaagagggaagacgccaagaccgcgcttgggaggtcagtggtgcgtctctaccccccctgctcccccactccaactcccagagtctcaaggcctcacgtcacacccccgtcccgtcccgtcgacaaggggaaccccggcctgggagagggcgcctccggggatccgttgcctagtccaggtactgcccagctaccgggcgtcgaggattgcgaagcgtcggggcaggctggcacggtgcccacttttcccaaaacgccagccttccaagcccagaagctcgcccggcccaggccgggagcggcccacgtcggacggccggaccgccctgcaggacccagcccggccgcccgcccccgccgccggcggtgagggaggtgagcggcgccgacctgcgggacgagcatcactccgacccagccgggggtgaggcgggtcaggatgctccggtcgcaggaggaaaaggaggagctggaccaaaagcccgaagagaagaaaaggggaaggccgcgcacggagcgcggtaaaggccggcggagctagacgccccgaggtcggagtgaagcgccgggaccgagccccgtctcccagggagtccggggcgcacggcaccgaggagagcgcgggagccaacctgggcgcatcatgcgcagggcccgggacgctgggccggtctacaccgccgcctgggtcacgtggcccggacgggccggcggctgccccggccggggggcgggggtcgcgccggggttgcgctggacgacggagagcggcgggcccgcagcggcctggagcctcccaacccgcgcgccgcgctggcccccgagcgtaggagccgccccctgcccccccgcgccggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccgggcccccgcggccaccatgaagaaggaggtgtgctccgtggccttcctcaaggccgtgttcgcagagttcttggccaccctcatcttcgtcttctttggcctgggctcggccctcaagtggccgtcggcgctgcctaccatcctgcagatcgcgctggcgtttggcctggccataggcacgctggcccaggccctgggacccgtgagcggcggccacatcaaccccgccatcaccctggccctcttggtgggcaaccagatctcgctgctccgggctttcttctacgtggcggcccagctggtgggcgccattgccggggctggcatcctctacggtgtggcaccgctcaatgcccggggcaatctggccgtcaacgcggtgagtgccctggggggggggtgggagcctcgaccctggggtgggctcaggaccaggcctcttaccccacctggaaaaaaggggtgccgcagagtgggccagcccacacccttcaccaggaaggcaagagcctcccaaggccaggaaggcaactctccaggctgatatgtgctcccttcctgcccacctcctctccccctcccctcatgctggcccaccctggtctctctccaatgcctgctacccctcctctcctgccagaaacttctgcctcctcctgtctcacctttgagctccaccttcctcctgggcccctcacctctcccatcacctcagtggagcggttgagtagaaccaccagagaaaagcgggctgtcatcacggctttgggtgaccctggcctgtctgtgcttcattgttctcagcgcctccatggggatggttgtgtctgccacagcaggtgtcaaggggctcacatttagaaaccgtagataggaaccccctaatgtggggccagtgcagagcagtttctgttgagtattggttccctctttccccaacctgtgctcctcccctcaaccccgcacccctgcctccctcccacctcctgcagccccagagtcagcccccaaccccatgcaaactgggttcattaatcaaacacagaggaggatttgcttggccattgtcaagctgtgagtcagccgcactggagagacgggtttaaggctggcactggcatggggccaggcacgggcaggaggccgggatggggtgtgaggcaggcaaaccgggcagctgcccacaggatggagggtaaatgccagcttatgggggctgggggttgggcagagccattgataggcccgtgtccaggaaaagctaccctgacgctctgccctttggccacaggcctgagcttcaagcctgtgcaaactatgaaatgtacagtgtctttaacaaatggcttcgctggggcgatgtccacaggacttggcttccaggtgccaaggtgctctaagtgtccctggaggccaaaagccctactccccgagcccctggctatacagccagaaggtggccggggtcctaacccgctatccccttgcagctcaacaacaacacaacgcagggccaggccatggtggtggagctgattctgaccttccagctggcactctgcatcttcgcctccactgactcccgccgcaccagccctgtgggctccccagccctgtccattggcctgtctgtcaccctgggccaccttgtcggagtgagcagtaccgacattgggctggggtgagggtggggcaggcactcaaggcaaataatggagccctggagcggagcccacttcagatggatgagtccagcagagtttaaggcctggatttagggctcctggactctggccctactgggccccagaattgatccccccaaaacctctgggctgaggaaagatgggagtaagtaggaggtgggatgggacaggaatcaaacccaacctcagagcagagaagagaggagggcgtagttaagggtccatggttaaccaagcagctgggatccttggagggagaggttgccagcctgagtttgagacctggctgagcccctggactgcagtgtaaccttgagagagtccagattctgtgggagtggaccaggatgttgcctttctctccaccgccctgtctctatccagatctacttcactggctgctccatgaacccagcccgctcttttggccctgcggtggtcatgaatcggttcagccccgctcactgggtgagtctgtcccttcccctggctccctggagatgagggcctggagacccagcagtggcagctcagagctcaccagacctggattctgtgggtctagagcttgggggtgggccacggagtggtggctgacagagaaagggacacagtaggggatgggattcagctagaggggcagaggtggctttgtatggcctgaaccgctggggacagggagtctgagtatctatccgcttatggaagaggctctactgaacctggaggtgcagaggggctctgtgtcaattcccttgaggatttggtgtccgtccccctcggtgtctgcgtgctggtcctctctgatgttttatttatctgtccctgttgagggggttgggagagtcttcctgtgggtctgtccctgtggacagtctgtctgccccccctttggaagctcatggtcactctctccagggtctgcttctatccctgcgtggaggggacacgcgctctgttcatccgtctctctgaggacccacgtgtcccctctgaaggtttatttgcttctctttccggtgtggttggagggagcctgtccctctgggaatctgtttgccttctttgagggtctaggtgtctgtggtccatgtctctgtccctgggagtggtgtgtcagtatattcgtccccgaggtgggaggaagtctttctccctgaaggtctggaagtctgcatgtctgtctcctctcagggtccgtgggtctgtcctctgtggggtggggggcatgtggtcttcaaggtctggggctcagcgccctgactcctgccctgtctccaccaggttttctgggtagggcccatcgtgggggcggtcctggctgccatcctttacttctacctgctcttccccaactccctgagcctgagtgagcgtgtggccatcatcaaaggcacgtatgagcctgacgaggactgggaggagcagcgggaagagcggaagaagaccatggagctgaccacccgctgaccagtgtcaggcaggggccagcccctcagcccctgagccaagggggaaaagaagaaaaagtacctaacacaagcttcctttttgcacaaccggtcctcttggctgaggaggaggagctggtcaccctggctgcacagttagagaggggagaaggaacccatgatgggactcctggggtaggggccaggggctggggtctgctggggacaggtctctctgggacagacctcagagattgtgaatgcagtgccaagctcacaggctgcaagggccaggccagaaaagggcgggcctgcagcctgcaccccccaccttccccaacccttcctcaagagctgaagggatcccagcccctaggtgggcagaggcagaccctccccagagctccttaggaagaagacagactggttcattgaatgccgccttatttatttctggtgaggatgcatgcgtggggctgctggtgtttagagtgggggctacccaataaatcactgatactcacgttccacctctgtctctcctcagagtgccttgagacactctggcccattgcctctcctctttgtcatcccacatcctccaccacgatctccacagggtaccaggggaccccaggacaagtgctctgtgggaagaaagggagactgtgaccatgggaggcccagagaatcagagagatgggaacagagcagggagagactgagagaagaccgaatatcaaaatagagctagaggccaggaaggaggggtcctcactgcagtcaccctccacccctccccctcagccatgtcaatcaagtccctgccacttgaggagggcttggctggcacttgaggggagtaccagggtgtgacaggcagggcggaggagtgagccaaccgcagcccctcgagatggcaagggggtgaccagccaggttccatcacagccctgggctcgtttctctgcaccttggtctttcaaaaaggtgtcctgctgggagcctgtgcccagagggagcagccccccgacccccccagaagccacatgtggcccagcccccttttccagggcttctcatgccttggcccaccagtgtccccaccgtcctctcctctgggcctgagctctgtcctagcctgctcttgtcccactgtcactgacactccttaggtaacctccttaaactctcagagcctccctctcttcatctgtaaaatggggataaaatatcactttcctcacaagatagttgtggggaccagatgagggcatgagatgcctgggaccagtcagctttctgtgaggaaaaggcggggggtcatgcagtgaacagctccgcatagcccagcttcgcagtgagcccagcctggagtcagtaactaccctcattccaatctggccgtgaaacttggggcaacataagctctctgagctttaaggaccttatctgcaaaacaggggtacttttcccgacctcatgtgctatgtgctgtcgtgaggagaaaatgagaccacgcctggaggtaaaacgcttgtacaaatggtcaggcgccttggagtgagtgctcagtatagtcgtgttaatagaaacccacacgtgcctgcctagtctgaggccccagccacatgcttctgccctcctgggggtgtctggacctgagcgcctgtccagcggggccaggagacggactgagaaggggtaggggaagctgtagttcttggccagcgagaggcagtcccaggggctggggtgaggagtggcagaccccccagccttctccacacttagagtctaagcatctacaagtgagaggtcagccactcatgtccgccccataggcttacagtaaacaccacgtggcattgcgtgtgagaaccccgggagcccagggaaggagcagccccccacccaccgtgtcccttcccacttcttccaacctgccccgggctgggggagccgggctgcaagtgccagctctggccagcagagggcgacgtcgtccaccgaatccacagcgtggcgcctcgtcgtccacaagtcctgggtctgggctctagccagatgggggtggagtggaggacacagggagtccctcatgcttgagtcccctggggccaccttgaggcagcctatcccaatgcatccccgccccgctatccgggtggggcgcagaagagaggggagcccttctccgctcagtctccaggagactcaggtacagacacagccatgaccaggaggatgggctcttcctccagcccaatgggggccacggcagggtggacagtggacccttgggagacaaacccgcgggggcaggcaaggcactaagtcagagggggctaccggccctgagcttcctgcaggttgcctcgcctggcccttgggcaggcttccagctagggcttggggctgacaagcgccgtggttggggcggtgtggccagcaggggtcgctgtgtctgcgtgtcggatcttgcaggagcggcaggtctgcgggctcacaaagtcccgtgcacacgcgcgcacacacactgaccccacacagtccggggctcgcggccacacactgacctcagtcgtgcccgagggctgcatgttccgggtgtgtgcgtctcctttcctccgcacgttcattcgaatgtgcagagccacatcagccctcctccagcattcgctcacagggccaccgccggccccaccgcgggcccagacctatgagcctggctccacgggttctcagaggcacacctgtgtgctgtccaacgcaagcacacacagtccccgtcacctctgctgcacctaaagatggaacccagggagagtctggattctcctgtgggaggctcccttccccttcctccctctcttcctctccccagggcctgccagttctcaccagctgggaggtggacaaggtgatatggggagagatggaagaggaccgggaggagaggtggagagcggacagaggggctggctgttgagatgggtggacaggaggaaggacatctgggaggaccaggtctctccgctcctcttggcctcatgtgtctccgtcatgtgtggatgaggacatcagacctccctacctttccaggttttgtggggatcactgagatgaggcacgggaagccatcttgaattccctccccatcagtttgtgttctccctccttttctctcccggtaccttcctccttcccctccccttcgccccccttactttccccaatctctaataggacttcagtcagagctgcattgacaggcagccctaggcagccagataaggaacctcggcaaaaggtttttgagcatgaatgagcttaaagcttggcactagagcccagtgctggctgggttcgggcacgtgctggctaggacaggaagccaggcctggagcaagccctggtcaatggctacctggcctcaggaggtgaaggaccttgtcccaggctgggcagaggtcaggagactcagccccgagctagctggggacaagggctgccactgcacttagcactttcaggctccaaggcccagggcaggtgctgaggtgcctgtcttggagccgccatgcagccccgtccccacagctgtctaacggcagggggcagggaagttacaatcctaatcattcacattttctgacttggaggccctctcctaggtatcagcacatttactcctaactacacacagggaggagggaatta

SEQ ID NO: 492 - DNA, 332949 bp, Homo sapiens
cactttgattctgggtgaaacctccagctttaacttgtgactttaagaaacaaaatatggaccaagtgccctggctcatgcttgtaatcccagcattttgggaggccaaggtgagaggactggttgagctcaggagttcaagaccagcctaggcaacacagcaagacggtgtctccacaaaaataaaaataaaaaaattaactgggtgtggggctgcatgcctgtagtctcagctactcagaaggctgaggcaggaggatcgcttgagcctgggaaggtcaaggctgcagtgagccatgattgagccactggactccagcctgggtgacagagccagaacccctccctttaaaaaaaaaaaaaagaaagtatgtttaagacacctatatcatttgctgagctcacgttcagtcatatatatctggcctggcttttttttttttttatcttcctatacttcctggggggaaacagtcataacaatctgattaagtgaggttatgcacaatatagaaagaccaaaaactattgaaataaggtaacaatgggacaacttctctaaatctgcttactactgaaaggatggccatgacactaaggtcctacagaatcacatagcttagccagcaaaggaagggtatgtgctcttatcagcaaggaatgatacccctatattcctggcaattcatatcaaaaataatttgccaagctacaccagacagagctaggacctttttttttttttttttttttttacataggtgggtagccttctataggccctttagcagttataaattgtacaaggtattattgtgaggctaaaaaaagttactgtattatgtatgtagcagtaatatttataaaatgttacctaagttgtagccttaaaagactcatttcaagtgtcttacttggttattaagtatcgcacactggcaaataatatgtaagaataagtgacaagaaagttcatgcagattctttatttaaatccaattttagttttttaaaaatagagagaaggtcttgctatgttgctcaggctggtctcgaactcctggtctcaagggacgctcctgcctcggcctctcaaagtgctgagattataggcatgagtggccccaccctacctcatgcagattctaatttaagataaaatatcacctgagaagtcccagaccctatatttgaactcagttttccgattaccctaaagaagggccttttagcctactctaattctatttttattttgctgattttccatcacttttactaatcaatgatttctgttgaaacttttatatactactccttaaattagaaacaattcagataaatgtatggttttatgcatatttgcttagcaactaacttgattctgaaaattggatttttttagcaagacagaaagaatgtttagtagaaaaagcactgatttgggagccaggaggcttaaagtctttattacactttaagaatgagctaaatgtataacttaaatcaagtgcattggcttaattattggaacctgagtaaagcatatgttttctctcaaatacgccctttcccttcagttcagtagggagtgggctaaaaaggaaaatctgaatgctaacatatatgtaaaacatgatgggaaactaccctctcccaccaaaacaatgcatggagtcgtgggttttaaataacagtaattattcatatgagactctacaccaaaaagggcacagaagtaattcatgtattactaatacccattgaacaactggaatatgcacagattagggcaaaactagcatttttttttttaaaggttatgctacactgcagtctgaagtagtatccttaaagttcaaattacacattgggcccacagataatacacaaaaactgatttgggataaattagcacaatgtatgatctctacaaaagcaagttctgggccaacacctacatacactcgctagaaactgcagcaaatacaggcagagcaagtaagcacaaaggagaacaggaagatggcagtgtaacctggctacaccattgcaaacattctgatgaatgccatccatgaacacaagcacacactactactcacaaaacggtaatacattcatatacatccccaggcattcccaattagtgaataattatatttgaagcctactttaaattaatatgggctgaccatggtgactcacgcctgtaatcccagcactttagaaggccaagatgggccaatggcttgggcatgcagattgcttgagctcaggagtttaagaccagcctgggcagcatagcaagacccctgtctctataaaaaaatacaaaaattagccaggtgtggtatggtgcgtgcacctgtagtcctagctattcaggaggtggaggtgcgagtgttgcttgagcctagggtgcagaggttgcgagccgagactgcgctactgcaccccagcctgggcaacagagtgagactccgcctcaaaaataaataaataaatacatcaactaatgtaatcccccatccatccattttcaatacatggcaaaccaaaaaaacagttacatgcatttaatctaaaattttctgtaagaatatattgtatgtagttctttagaaatagatttttgcttatttgccataatttttttaatttgatgaactgaagtggtattccttaactacaatttcaaaatgtttttccctacaggccaacaacccacaaaataaaatgctgcacctgaagcaatcctccaaacttactatctgtcattagcaaatagagctttaaccttttgggcatcacagggtctttaagatgcccgtgcctgctgagaacttctccctagaaaaatgcagtaaacacattccgtttcatagggctcctggacttgttgaacactatacataggccacaagtagaatatattgtccagctgggaatatactattatttcaaaagtctcttaggaattggcagcaagaagtgtatgtgcaatgggtacaaatccacccagggttttgtagttgtgatattactactatttttggtggcctcaactttaatggagcagaaaaacaactgaggttagcaaatagcagcgtaaaggatggattcagctcactgggaagaaaaaaaattcctgcataccctaaagaaacagaagcttcttttcagtttccagagaaccagaaggaccatcatttatttaacttctgattaactttgagtatgataagtaggaaatatctttaaatggggttaaaattaatagacattagaaacagaaactacactcttatttaagctatcagtaatcattaatggctaaatgttatgagtattgttaataagagggaaattcagttataaaaatatagcacaatactctaaaaatttcatctttgtttaaaatacttggaggcagtgtagttaaatgcaaaatattatgtcagttattttgtacacctgaaggactgtttataaatgtttctcatacattatcatgcaaagattattctagaatacttgagttctacatactacaaatcatgttaaagaatcatagcacctttaaaaaattgtttacactgaactgttggatagaatttcccttaatgtatagcaataagcttcaacaatttacagtggctcaggttgaatatctatttcgatgctatatatgaagagtttgatatgttttcagagaaaagcaaaagctaaataacttattattaagtcaacactactgactcatgtagttattaaggaaactatatatactttaatgaaacctaattattacacaattttacatttcagcttaattcctattttattgttttgccaacaagactgccaactccttaagcattacagctagtcaagaattaaatctgcattaaatacagaattaatttgtctttggggtttaattttttttaattaatagcaaagtgccatgtcaagaagagtcaatgtaccaaaaaattaaaacagaaaatcaaaattcattaaaacaatttgtttgctcagtagtatattttttttacattcactgaacattcccttgcctttcccataattaaaaagttaattattggaatcatattttttgtagatcccagttttcaaacaatgtgatttaaatgcttgttattaacattacaacactttgagtaacactgatcctaacactaaagtgatgctgttttgtacataattaaatttgttaccattctaaacagaattttaaatttaactctgtggtaaagaccctgcttaagtattaaaagttaggaaccctccagtctgaatatttttataactttttttgttttaagagacagagcctcgaactcctcggctcaaggggtcctcctgcctcagcctcctgagtagctgggactacaggtgtgtaccactgtgcccagcttcattataaccttttaaaggtagcagttaagtttcttgagggtcaagtcattctccctccccccatctcttgtccaaatattcaagaaatatttactcagtgatttagtaatctacatttagtaaacttacatttagtaagttacaaatatatttattactaaatatagattaccattaataaatagttccttggtttagtatgttctcttaaagttttcagaagctattaaatactataaacaaagtattaaaatactataaactgtgtataatgagcacagtttttagacaacttttcagtgatcaaaacagatgaaatgaataagaatggacaaatgtagcaaattaaacccataacagttttaaaaattctggattaaacaacccaaacaactaatgaaatcaactccccgtcaaaagcacatctgggaatgcttctccaaaaaatattattgtaattgactaaaatttaattttttagttgtcttattaaaaagtctttaattgaaaattatcacttaaaaatcaaactggatttaatgtacaaagcataatctccaatatctactgaaaataaatttttaaaaaaatcccacatttctgatttctctttaagagaaaaaaaaattaaaaaattccccaaagcttatcagattttttgggccaaatcatccagaaatctatctataaaagattcagagtatattcagggcattaaaattaccctactctgaagtagaataaactatttccttatcttttaaaagcttagttatcaacactgcttagaattaccatcagagtgtctgtattaagattaccctaatctgcagtagaataaactatttcctcgccttttaagagcttagttatcagtactccttagaatcaccctaagaatggaagggcttcatctaggatttgatattgtaatcaaattttcaaataagacaaattagtccacataaaaaagtatagcagtaggtacaggcaacagaagccatgaacgcattctcgaagctcgccaaggaatttttctctaaaatcatctttaaggaaatatcaatttaacttcaatagccttgtttaacgaatcaaactatttttttaaatcttagagtgacctaaaatcccaaaatttctccactgagttggcataccaattcctcaatttatttcagctgttgtaatcatacacctgataatgcttgatttgaaactgggtacagttttttaaggtttagttgaatgagggaatttttaatttatcacaatttcctgactaatatgaaaactgatggtaagaatgaaaaattcaaataaaataacataaacctctaattacggcgtgcagcgtttgcagttacaaaagcaacactacatttttcccatcataagcgctttgtcatcaaaacagtaaactatacaaattggattgcaacaatttccactgttattggtaattttttaataggaacactttccattaatgcttgaaaactacgaactacattttattttatatcttgtcaaattagttggagaatatctattgtaaagctgtcagcacatctctaacattactttgtcaggatccacctgctctatgctgcccactataggaaatgcaatatggtaataagaaatgtaatagaaggttactttagtacaatctcataaaaaacatactctgactctacttggatgctaaatgtggtgtttttgcaagagatacagactgattagtggcaatcaaatttattaactgtaaaggacatcaataagaacagacaggaccagaaattgtatcttggtgatccacatgccaggagtagcgcggcagaggatggagagtggaacttagcgattgaggcgcagcctgcagaaagctgcacttctgcactagagattaaataagagggtcaaaatcaacataaactaaaccctttttcaaagtcatgtaaacacaaatgattgctgcaactggaaaacaacattgaaaataaatgattcgtgtgatgcatatcgatttcaacaaacctttccttaaacctttaacgttactcttacaagcaaataccgttaatagcttacttctgtcttaatttttctaaccacaggaaaattgaaacataagtaatctgataaacatcaagttttacgttgatgcttttgaccacagggtatatacagtgttaagaatttaaattctatccatcagatatactttaggactccattttgaagatagcctcttctacagaaaagaaatttttaaaagtcaattctccagtttctcatcacatcttaatttttttaaaaaggcttttaaacactagtatcactccaagtctttagcctttgatacttgctctgaaaacacactatcgtatgtttgtgtatgtacacacacacacacaacagtgacttaaaagtggcaaccgcctcttgaaaagtaaaaatatgtcatccctccattctgcccttaaatgagaaataaagacaatagatttgcccactgcagactgggataccagaaaagacgttctaagtctcgcctgagacaatattaacctgctatcttaagtcccaacttggatgacttaaatttcagtgtacgtgcctccgttcccactcttgccccatcagctccatcagcatcgtcatccccggctcggatcccggccgcgacccgccagggccgccggagtccgcgaataccgcccgctcccagcaacgaagctccccggctcccggccgaccgcgagttcctggagcagcagcctccaaggttcccaaagcccacgattcaggcgagcggtgccgaccgggccgtggactgtggcattttaaaactacagaagtctcactgcacgactggcgcggccgaggtggcccaggagaccctccaagagattctggtcagctgccgggagcgtggaagagcaaccaaagccaccaaggcgccgcgccaagtccccggagcagtcacctcagctttccgttctccctctagttacaattactccacaggcttctggcgcttccttcgagaaaatgaaaaactaaaaacgcgtagaggtggtagaagtcgttggcattttccgtttaatgtgatcccccaggctccatcccttaagtggggtttccaaactcggatgcatcctcagcagaggttttccatgttgacagatctctcgcctcccacaaaatggggccggggaggcggccgcggtctcctctatgggcgccgccattttgtgaggcggcggcggcgcggcggcaggagcccggggtgtgtataatggttgaatagaatgaccccctccagggaatccccggcactgacggttacgtaaggggctgtgcgcaagtgcggcgtttagggaatccgcacagcccgggccacgcagctccgaggcccacatctccacttcccctaagaggaccgatgggggaagggacagctgaccgggtcttcctcgcagcagcctcacccctagtcttccgcggccggcgagcttctccacctccccgggccgggtctccgcccctcacaggcttccgagacactcactggccctgggttgtcaggatcttcctagccacaaccttattccgaccccacttaagagacaaactttagttgggaaataagtccgtttcctagagtgagcaccggaagcaagctgcactatattacataatttttcacctccaaagcaatgttcccattggaacgactacctgaaataacccatccagacccctactaccctgtgaccttgggttaggcagtgactttgcccgtggtggccgtcactaaaatgggaataataatacgtttcacgtactgtaatcttaattaacatttgtagcaaagagccggctccaacacccctcgtaaatgcaaatttaggtggtagtatttgttgagatgttttgactcatttaagcaaagggtttttttaaccttcaaaatattttaaacgaggattacatttaagacatttgaaagcaaggaaaaacgttttattcggtatttattttaaacgcagcaatcttgaagagaccttactataaaaatgtaaaccttaattattattgtcgaagttcgatagattgcttcccaaccagtttagttagtttgcataactttgctcatagaatactccagtttgatatgtgaagccaaccagcggcaagatgaattaagagcattactctatttccacagaactaggacagacagttcacattgtatttaacgtatagtttgctaaagttagcgtgtggataattcatagaaaatgtgctaaccaggccccaaaatactagcatacggctcataaaagccgattcctttagattttacaaaaacagaaggtaacaaattgactttattccgatctgtgaatgttgcgtagcgtgaggggctaccccggtgagcttcctttcccttcagagcgccacaccggttctgtcgggcgggcggggactccgaggcggcccttccaacagccgggccggggacgcgaacatcgcctccacccctaaccctggaacaaccggtagtggccgtttccccgcaccgcccccctttccgccggctttgtgtgcgtgtgaaatgtgcggcacattgcagacgaaccctaagcccggcgagtcgagtctattgttccccgcgaggatctgccggggcggtgtggagccaggcgcagtgccgcggccagccctcgggggtcgctgtgtggcactggctgccaggccgtggcggcggcagagagggaggctggcggggagggaagcaggcgggcggcgcgcagcggctcagctgccgccggtgcttctgcccggggacgccccggcctcagcggccgaggccgcgcgtgaatgtgtgcgagggccccgcggagccggggccgaaatacacgctgtcaccgcgctttccacaaaccaccacacagacctccccctccccacccccagccccgcctgccctagccccgccgccgccgccgccgaaactcttgggcctctggccgcccagacccctcaccatcggctcgccttgcccgtcgcccgctcgcgcgcccccggcagcagcaccatgttgaatcgcgtccccgggctgagctgcctcagccggcggcgctgagaggcgggcgagagccgggccacggggagggagggaaggaaggggtgggggccgcgctcgccccgcggcttcgcgcggatccggcagtcgcctgcccttctagtttcgctccgatttctttaaacttttttagaaattcccctccctccttccctcctctccccctggcctcctgctccctccttcccctcctcctcctcctccccctccctccctccctccctgcgccgccgccgccgccgccgccgccgccgccgccgccaccgccggcccatgactgagccccgccgccgccggccgaggaatgggctccgggctctggtaggaagcgctgggagcggggggcgcttttaaaacaccgatctgggttttttaaaaacctcctttgaaaaaataatggcaaactcgacggggaaggcgcctccggacgagcggagaaagggactcgctttcctggacgagctgcggcagttccaccacagcagagggtgagagcagaaccgggggggcagcgccggggcgagccggggcgaacggggctctcccgcccgggccgggcacggggtcccggctgacaagtgcggggctttttctctcccgcaggtcgccttttaaaaaaatccctgcggtgggtgggaaggagctggatcttcacggtctctacaccagagtcactactttaggcggattcgcgaaggtgagtggaagttttaatttgtatttccctctcgctggcctcctccaaaaagtctcctttgaccccggagtgggcgcttggggctgggggggtggcccgcgggggcaaaaggcgttcttttcgctcccagccggtggcacggaggcggacggcggcggggctgtttttggcctggtggctcgcgtgcgcgcggcgggcgcggggctccggcgggcgggcggcccggcgccggctcgcgccctgcccggtgcccggtcgggccggcggggtctgagcgccgcggcggggaatgcgggcgtgcggggcgccagcctgagccccgcgcccgccccgctcccgcgccgcccgcccgctcgctcgcgagtcagctctgccgccgctgccgctctagcacaggcggagacacacagagacacacagactctgagagcagttttcgtgcaactcaaaattagcgcgggcaggtttaacatcgataatcggctgcgaaataatcccggcagccgggggcacagcctcggccccgtcgccctcggtttatacagctaacaaaagaaaccaggacctgtctccaaatagccatcttaggcttcaaggctaggcagaagctgtaggcctcaaagaagggcctatggagatggatagatctgggagagggatcggaatcggccccagccccggccccccccccaacccgcggacgtcgctgtccggaactgtattgatccttttgaacttttttttttttttttttttttagtgtaaacggaccgcgttgagatttaaaagggggcgacagagggacttgcgattggttattgtccgggcttcaaaaacaaaacaaacccaccaaacccccccacccccaaacaaaacaagtggtattaaatacagggctctctggtgaaaacacagtgattcaagaagcccttgcttagtaactcttaccgatcgatccgaaacacccactgatgccttaggtatctacagatctctgtagaatgggtatttatttcatagttaggttaagattttcttagattgttcacgttcagacaactgtgcctgtgttttaccaggtttctgagaagaatcagtggggagaaattgttgaagagttcaactttcccagaagttgttctaacgctgcctttgctttaaaacagtattacttgcggtgagtagtagtgacttttccatagtatttggaaataagggacttatggagagatttgtttttagcaaaaacaaaagcaaaccttgcacaccaaacagttcttaagctcttgttcatttcagactgagacacatttaatataaataaagtgagattgtaggaaggtgaaagtcttcctcaccaatttcaggatcgtttacatttttcatacaaaatcattacaggtgacaccccagccccaatcttggtaaacattcttttgtgacattgttattcatcgcttgatacccactgaggggcagaaaggtgatgcttagtaaaagacttaagatagttaatgaaactttgtaacctttgggaaaatttttttctttgttttggaaactcctttagttttaaaaattctggctttaagaattttttttttttaatgaaacttcttgtttggaacagtgtcattgaataggtttttcagtagaatattcctacatggcataacatgttggtggcttaggtgaccaggattgttttgataattactttttgttgaatttccagtgacttaaattagtaatttaaattagataatttaaattattatatctttaggaaaatggggatactatgaaatgggatactataatctggattttctttcattctccctcttcttctttgactgcttattcggcaaagtttaatttcttattcagttggtatgtgatacagtctagatgatatattttgtgatttagcgtttttttttttgcctctagtttttcttctaggaatactttcatactgtaatttatcatgatgctgtgttttatttttaaagtgcttatcttagaggatcctaagttagttggtgttattaaaaactaaaatgatattctttgtatttattgctttttaatagtgatagtacaggcctttttttgtaaggtggcttctgcataatttgagttttgcatttattattgcttcagatgcactcagttattgtgtattacgttcagcattctgaaataggaaatgcagtaatcgcacaggtgtactttctattggctatcttagattgacttcaggcttgaagctggagttcgcagaactttgtggagtagttattgagttacacaggaagtctagaaaatattaaatatggttgtcatctattgtgtgtgtgtgatggcatttgtgtcagagtacattttaaattaaagggctaaatcaaaaagcaaaattaacctccaaaaccgttgagttagtagtggggtgagaaacaagagagttttatattcatcgtgacattcatttgctcatttctatttatgatattgagaggaacatgttaatacatattctggttttatgtttttatcagtttaaagcatttgaattttggactgtttgaaatacatatttttgaagttttgcttcatatttgttagattgattgacttaagttttataaccagaaagtactatagaatatacatgattcatgagatgtatatttttctgaagagtttacattcatactaatagttttagcataatcaaattaatatctaggcttccaattttttttaacaaaagttaattataaatattgtttttccagttgtcatttttatcttgggaggatatcattaattataggtactgtttttaactatatagtttcaacattgtaagtatttacatggtcttcagatcaaattgggctttttgctcttattagaagctgctttttgaactatgtccttagttaaacttgtttttcctccatatgtcactctctaggtttgtttttgcagggttgtagctaggctactaggaaaaaagttgaagcatttgttttggaaaataaaaccatgtgaagatttgcatggcttgtaaagaaatacaaaagaaatatgctggtcaaaacttaggtactaccaaccttgaaagaattttttcctggtggtctaatattgcacagtaagaggatatatatgatgctagcttttacaccttcctctgaaaaatcttaattggcagacaagatgccaagtaacagcaattctattacctacccataagattggctcttcatagtaagaaatagtaatcgagtgacttgataagttacctctttgctacgtcagattgaatatcatcattactgatgagcagataatgcagtgtgttttttaaattacaagtggaataattttttaatatgaactgctttttcatttgacctattgtaagactgtcattatatgtgttattcctcctttacaagtttaatatttgctcacattcccctgtaagtttgctattaattggatggatggctgttagcctagtgttttatgatatatcttcataatattacagataatttaaattaggaagagcaagctagtatgctggccatgtatattttaatagtgttttgttatttttgatacaaatattgacagtcattaaatatagacttgagtattaatggtctgccagacattaacttaattttctcaaatatacatttattcagttatagcttgtctacaaaaatttcttagagtctaaaattgaaaatgcaattgattattttaacattggcatttaatttttacaaatataagtgcctgcctgtatcaaagtttctcacctactccagaaatatatacacgtactgtgtacccacaaaaattaaaaattaaaaaaaagtaaagtgcttacagataatgtgtaaaagcagtctatttaaaaattggaggccaggtgcggtggctcacgcctgtaatctcagcactttgggaggccgaggcagacggattacctgaggtcaggagtttgagaccagcctggccaacatggtgaaaccccgtgtctaccaaaaatagaaaaattagcctggcatggtggctcatgcctgtaatcccagctacttgggaggctgatgcaggagaactgcttgagcccgggagtcggaggttgcagtgagcggagatcgtgctactgcactctagtctggccgacagagtgagactctttctcaaaaaaataaaataaaataaaataaataaattaaaaattggatactaatcatctgtgatgtttatgcactttattttcatgtagttccttttcttggcatgtacatctcaatgtgttccaccaatgtttattattaggatattcctatagtatgaaaggataaggtatagtttcccacattttgtagatggagatattaaagtgcaaaaaaaaaaaaaattaaatggcttagggaacatttcattaattggaccaaaatgttgtgttcatgacgtgttcaataatatttggaaattacttatggttaaatttatgcccaagtatctctttgcctaatgtgttccatatttacttggtggattttaattttttgttctgttttgttgttgaaattgggggacagtttgctggtcttatctgggttaagaatttgaagttttggtatgaagatttaggtaaatatttcaaatattttaaaattttgtttttgcttactgatgccaatattacagctatagtcaaggttaacttgatgtttcctttataaaacttgatttttttggaaagggggtgaaatatcttggacattaaaaatttattgtacaaaactatatgttactagttttctggcactgaaatattcatttctatttatatgtacctacctttagaatagtcagaaacttaattgtagagttatgtttaccatagtacattttcaatcgcattgtgaatttattctattttttttttcttggtgggtaaagctctttcttaaattacaccatttgagggagtttacatttgttagttaaattgaatgaatacactcatgtgttctctagttagtgtccaccatatagatcaattcttttaagagaaagccttaggtatataagcactgagtttgtaaattgctaaacggaactgaataaactgattgcccttcttattcaaggaaggaaaataaaagtatatggagattggaagacaaatatatcaataagttattcatgcatgtatttcaaatttaactttataaactgtatcgtgtgtgtgtgtgtgtgtgtgtgtgtgtgtgtgtgtgtgtgtagacaggggtcttgctttgttgcccatgcttgtcttgaatgcctggcttcaaggtatcctcccgcctcagccttccaaagtgctgggatacaaaagtgagccactgtgcctcagccttccaaagtgctcggatacaaaagtgagccactgagcctggcagtgtatccattttaaaaaacaaaaaacctgattttgatattttctgatattctgttacgtttttaaaggacatgcagacttgttgaaaggaagagcagaaagtggagaaagttgaaagacttatcaaagctcagctaggttagtgttatgtcttagaatccatgtttttagagcttaaattgcccaaagtagaaataaattgagttctttctaagacagatagttttcactgaggttacaaattttcctgaggatacaaaatgagaacattataattcccaaaaatgtttatatgctttttttttgcagttaaattttctaccttagctgttaactaaaaatgtccctgaatagaagcactctttcataatcctatctctgctttgttgtggattcagtattttcatagttgatcgtgtgaaatctataacgtctttgatagacaagtatattgtggccgggcgtggtggctcacgccctgtaatcccaacactttgggaggccaaggcaggcgaatcacaaggtcaggagaccaagaccagtctggctaacacagtgaaaccctgtctctactaaaaatacaaaaaattagctaggcgtggtggcatgcacctgtagtcccagctactcgggaggctgaggcaggagaatcacttgaactcgggaggcggagcttgcagtgagccgagatcgtgccactgcactccagcctgggtgacagagcgagactccgtctgaaaaaaaaaaaaaaagtatattgctactagatattttatattctcaaactgaatgaaattagaagttggaaaggaaggaaaaacacagttttaactgcatttcattagtcagtgagcaggtacttaatatatatttttaggtaaagtatttaaaagttttaattatattgtgaaggtgcttattgggtgttttccagacctactaaagtttaatgataaaaatggattttgtctgaattgggaaggacatagaggataaatggagcagacggatggggttgaggggattctccttttgctgctttgatcaccacagtctttggtattcagggccaactagagtttgtactctagaaacactagttttccagaaatgttaatatatttccatgaaaagaagacgaaatgaacttgagcaaaaggctaaacttgggttactttattgcaggacttcttagagactttattttgctaatgtgtattgtggatctctagacattttggggaaacattactacttctcttcccttccccatagtaaatagtgtttcaccagtgtttcaccccacagtaaatagtgtaacaccatcgccaaaactgcaattacttgtgcaccaacctaagagatgcacaactatacattttctactgtttaaactataatgtgataaaagaaataacaaacttttttctgttttaaaacataaatttcacttgtgcttggatactttctgtgtattcattatgttgtgaattgataattcatttgactaaatacattgcaataaactattgctggaatggaagtctcttagtgatgtccaggaatagctatcacattctgaattgttgaccaaaaatgatagacccatattccatgaatatctaagtcagcgtttacagggcttcactcccatcttactgccatagaaatttttggtggagccccagggagaatgtgctggttttgatgttttggctgctgccttccctctccccccgccctttttttccccattataccattgatttggagtaaaggggtcaatttgttctttagactgtcttaaattctggctttgattgctttcttttggtgtcaattaacttgttcctctatccctcatacatatttgctgaaaagtgatagatctaaaggttaataatattcagatttaatattttaggcatacttgataggtactgctgtgcttttcatcatatcatgaggcatataatgtttagttgtccccttttagtgatgctaagattgaacagtggttttaggtattaataatttgattaatatgtatttccaaaaagtgctccaggtgattcttaagtacactgaagtttgagaacagttgatctaagtattgtaatgaaaccaatttagttgctgagatgactagtttaacatggcatgaacatattggtcagggttacatccagaacaaaacctccaggtgacatctggtctaggggcacctgctcaagctgcacctgtcatctctgaccacagcttggacacacttatactttgtctctggactctagagaaggtaacaagggctccactttagttaagggaaaaaaagagtaaatgaactaccaaattctaacttatcctaagtgtgtttatgtaatttggattaaaaaaattaattaaaaataagtgttcctcacttattcctaattggagaactttctttacatatatgtatggtttttttttctcatagaactttactatattctttccaaatggggtaccatttgttttactgaatttactggatgcttgtttgtgaaaattttgttggtctgtcctggtatttcgtagtagagttaacatgtataaattcctgtgaaagtaataatactaacaataacctgttttgtttaatgtccaccagctttgtttttcaaaacattttcatatgggagattttatttatttatttttatttatttttgagacggagttgctctctgtcactcaggctggagtgcagtggcatgatcttggctcactgcaaccttcacctcctgggttccagtgattctcctgcctcagtctcccaggtagctggaattacaggcgtgtgccaccatacccggctaatttttgtattttagtagagatggggtttcagttggccaagctggtctacaaactcctgatctcaggtgatccacccatcttgacctcccaaagtgttgggattacaggcatgagccactgcacccggctggccggagattttatttttatcatttcaaatttgagaagtaattgtgttatttaatcttagaaaaaataacaactaggaaaaatattctttctttttttatgtataaaagcaagggaaaaaattctttatgccacccaaacttttttcttcctggggcatatgggctacttttttttttttttttttttttttttttttttttaaggctttaggttatatccaactcccagccttaagtgtcagccacagttgctagtcaggaaaggatattttacatattttcagaccctactttccctgcttcaccttcccattcccttccctgctgatagacctgctgtacattttacagagtgttgtctttttttttctttttgagacagtttcgctcttgttacccaggctagagtgcagtggtgtgatcttggctcactgcagcctccacctcttgggttcaagtgattctcctgcctcagcctcccaagtagctgggatgataggtgcccgccaccatgcccagctaattattttgtttttttgcttttttagtagaaatggggtttcaccatgttggccagggtggtctcaaactcctgacctcaggtgattcacctgctttggcctcccaaagtgctgagattacaggcgtgagccactgcgcccggccagagcattgtcttaattgtcttatagataatcctacattatccatagttgctattcatcttatgcaggtatattccatgttccaggtgtgcttggcttttatttgtatcagtaaataatttttaaaactaccatataattgggataaaatataaagttacttttttttttttttttttttttttgagacagcgtctggctctgtcgcccaggctggagtgcagaaagttactttttatgaagaattcaaataaagttgtgtaatctattgtttggataaacatcttattgtaaaatatggccaggtttcataattctggtctttctgagttcttactgtcatacttgataagtatttatatatagtggccagtagtcaattgctgtgtgcacaaagatgatctttattaaataatacgtatctttcatggtgaagtgtttttgggtgaaattttattctgtctctatgctagcccagcgattaattttaaataaataaaatgttaatataaacatacatgagatcagtgggaacattcttctattacaataggtcaaggaagagaccatagctagggccctgtccagaaaatacctaatttgtaatattttaaaaatgggatgaatttaactttttcagtagtaaggctcaggttgatcacactttccataatggttcatagattaagtgaatttgcaatacgcttgagctcagatcagaccacatagaacttcataaacagtagttagtggcttagagtaacttgtacctcccagtgtgcttgcaaataataggtagtctatcaagagttcttaagtggtttggtataatttgtagtttacaccattaaagagtcaaacttttgaatttctgagttgtctttttaggtagcctcatattgcaatgtagtaattcaatctagtagtaaaaatatatgtgatttttgatatagtccagttgagagagaaatggtgaatccattattttcttctttttttgccatgtttttccttttcaaaattgttaaatttcttttgctatctatatgtgaacttttgcttacacttcctgtagatcaaccaattaattgttttgccacatttggtttacatttttctttttatatgtgatggtgtgcacactcatacacacactatcacatataaaaagaaaaatataaagcaaatgtggcaagtgtgtgtgtgtgtttatatacacatacacacattatcactgtcgtttattcattggatattattacagtataatgtcttttatttatatgtgttatgacctaagagtaaaatcattcgctaatgtaacaatggacagttattacattcagaaaccttaacatggataaaattgtattctctattatgtagaccttaaatcaaattttaacagttgtcctaaagatgccttttatagcaatcatatcccccaaccccattcattatcttgtattgcatgtagttatcatatctgtagttcttcagcctttttgtgtcttttgtgatgttacattttgaactatacaggccaaaagtactataaagtttggagttgtctaatattttttcaggatttaagttaggcatttttggcaagagacatgtcatgtcactttgtctcattattgctgagattaaggtggtatcctcctgatttctccactgtaaagttaccattttctctttttgaattaataagtattctgtagcgacataccttgagaccatgaaactattttgcttaccatcaaacttttacccagtagttttaacatccactgatggtttgggcttgaatcagttattaatatgatacttgcatttatttgtgcttgaatcagttattaatatgatacaagcattttatgatgcttgttttctaactcttatcatttcttttacatttatttgtttttgagactgggtctcactctgtctcaaaacacccaggctggagtacagtgacacaaatcatggctcattgcagccttgaccttccagctcaagccatcctcccaccacagcctcccaagtacctgggactacaggcgcatgccaccctgcccagctagttttttgtagttttatagagatagggttgtgccattttgctcaggctggtctcaaacttctgggcttaagcaatccatttgcattggcctccaaagtgttaggattacaggcatgagccactgctcctggctccttttacatttctccttttacatatgggacatattttcattcttatttatttattagttaggtttttatgttatgcagtggttaaaatctatcattgttatgcattttgctgcttagatttggccagtgagagcccttttaagctggctcctttatctttttaacatgtgtctattattcttgagcccttcctttttgacaaaataagatcttccagggtctacttgtattttgcctacccagctctagaatcatctatttctctgaaaatcctcgttccatttaatgcggaatggtatatagaaaccaagatcgaggtgataggtgtgctcattgctactgggttattttttcttctagggccttttagagaacagaactggggaaaaaattattttgtctgtaaatacatttattttgaaaatcaggaggctatgctgatacttctaattgcactccatactagctagttcttttccttcttccattccgtgtatctcccttaaccttcagtaagaatcctagttctctacaatagtatatatgttcatcttctcagttctgcagtacatatagaatacttccagaagtgttatcccacaacaaacaacaaacctaccaagtagctacagatttgtttgaagttctttttgtgtttagactgaagatgtattgttaaaagtacagacatgcactgcataaagtgttttggtaaatgatggactgcatatatgactgtgttttcataagaatataatatttttactttaccttttctgtgtttagatatgtttagatacacaaatatttagcattgtattatacttgcttgcagtatttggtacagtaacatgctgtataggtatgtagcttagagcagcgggctatgccttatagcctaggtatgtagtagactatataccatctaggtttgtgtaagtgcgttttgtgatgtttgttgaattatgaaattcaacaaattttatttatgaatatgtaaaacacgtaagattaagcctagtttcccttcctaaaataaagctcattaaaaatatatattttgccttttttcacttcatatatcttgaaaaatcactaagttcatagaatcccattattatttttttaacagctgcataatgttcccatcgtgtagctatatcctagtttattcaaccagttccctacataatggcacttagattgtttccagtgttactgtagtaaataatgtcatctgaataatctgtaaatcttagtaactttatgcaaacctattttcagattgttgcagctgtgtctttagagctagttactaaagtggggattgaagcagcaatcaaagaataaatgcacatgtagttttgttaaatattgccagattccctttgtaggagagaacttttttgcacttctaccaacagtatatgaaaatacctgttttccacaactttgctctgttgtctggcttgttaaatttctctaatataggggattaagaaatggtatctcactatattttaattattgagacattacagcatgtttgtttgtttttttaaagagattgagttggctgggcatggtggctcatgcctgtaatcccagcactttggaaggccgaggtgggtggatcacaaggtcaggagctcgagaccagcctggccgagatagtgaaaccccatctctactaaaaaaataaaaaaaaaaaacatacaaaaattagccaggtgctgtggtgggtgcctgtcatcccagctactcgggaggctgaagcaggagaaaggcttgaacccaggaggtggaggttgtggtgagctgagattgcaccactgccctctagcctgggtgactgagcaagactctgtctcaaaaaaaaagagagacaaattttactgtgttgcccaggcttgagtgcagtggctattcacaggtgtagtcatagtatatgacagcattgaactcttactttcaagcaacgaactgcctcagcctcctgagtagctgagactacagacatgcaccactgtgcctagactttttaacatgttttcatctttgatagtgccaatcccatctcatagttcttttttacaaggttattctttaatgtttatttttccatgtgtactttagtatcagtttgttctagttccagaaaaaaaaagcttgttggtctttttatgggggttgcattaaatttataagttggaggactgattttgtgatgataccgagttgacctatcaaagagcaatggaagtctttccacttgttcacatctttttgtgtcattcagagcctaaagttttctttatatagggtttgaacatttctaaagtttattcttagggatattgttattgttgttgctattgaaaatgtggttttctgtttcatgttttcttgttatcatttatttatataaaagctgttgaacttttatattttctaacctgctgccttactaaattgttttatagttttgattttatgattgatttttttttcttttttttagaattttacctgtatacttggtgtgtcatctgcaaatagggattgttttactcttctaagttatgcatcaaattactttcttttgtctaattgcattggccagtatatccatgcaatgttaattagtagggaaaatggaaacatcttttctttgccttgttgctgaccttagtttgatgcttctgacatttcctcattaagatactgcctgttatatgttttgatgcaatcttaactattgactttaattttagtaatcctgtgatatatgaaagtattcatctatctgtttatttaatgagtggtattgttagacttagaaatcagatttagtgatttttttgtgttatctactacagtttagtatcttttttttaatccataggtattatctatatttaagagaggggctaatgatgaacattacatttttaaaattccatttttgcaccttatatttgaatatgagtgtttcttatgttccaagaatttaacacaaaaatacaagtcagctacagtgctgataaatttggaggaaaattatctttctttttctatctatgaaacagtttttgctcttttgttctttgctggccattgattacattacttgatatttaataataaggcaataatttaaattattgcttgatttttatattctcaagatgagaaataattattttagtcttacaagtcttcattataggttaatgaaccccctaaagaagaaaagcaaatttgtactttaatcacagtcagaaatcttatgtttgtttgcgtgaatccatttaaattcatcaatgctaaattaaatgtgttatgtttttacatagtatatttgatcctcacaattaatcataatttggttattgaaaaaatcttcctagttctgagaattgcttggaacatccctccttctttggccccctctttataaactatggaggttagcttaaatgtgtgtgtttgtgcaggcacgtgtgtgtgtaagcagcactctttagagttttaagcaaactgtttggtgatttattgatcagttcttgctcataaccagtcttataggaatttaccaagccttacatatttaaagggctaagttgaagtggatattagctattgtatacaaacttaatgttttgtagaagcccagtagtatagctttcagcacctgaaaatttagattcctaaagacaggagcaagaagtgtgtagttagctataattggatatggctactgaatttatttattgatttgtagtatcgtcagtcttaatactagaaaggattttaagaagatggtctagccctctgctttctggaagggtagaaataaggatacttttccaggtaggcctgcgtggggataattgacttgcctaagattattactactgaatgatggaagggaaaagtagaaaccaaatcagatctgcatttattacactaaccactccattctgttttaaaaggaataattttagaagactatcagagatttctttgctatataaaacggggcctttatttattattattatttttgagacaaagtctcactatgtcacccaggctagaatgcagtggcgcaatctcggctcactgcaacctccacctcctgggttcaagtgattctcatgtttcagtctcctgagtaggtgggactacaggcacacaacaacatgcctggctaatttttttgtacgtttagtagagacagggtttcgtcatttggccaggctgttctcgaactcctggcctcaagtgatctgcccgccttggcctcccaaagtgctgggattacaggcatgagccactgcgcctggcctggttttatgttaagatgattctgctgacttatactaagagagaaaaaacactttttactgcaaatattctttatattaaatattttactcgtaaaaacctaaacttacatatttgataaagcttatatatttgatagttgtttttttttttaaataaccaaggatactcatttaaaggttagtctagtacataattttttagatggagacctctactggaagtatgaagtaatagatagattctggtttgatttttttttttttttcctttggagacaggatcttgctctgccacccaggctggagaatgaagagtagtggtgcaatcatggttcactgcagcctcaaccttcttggcttaagagatcctcctacttcagcctccctagtaactaggactacaggtgtgtgccaccatacctggctgatgtgtaaagattttgtagagaccagggctttctgtgttgcccaggatggtttccaactcctggcctcaagtgatcctcctggcttggcctcccaaagtgttgggattgcagacctgagccacccacccagcctgattctattactgtaaatatctagacaaagggatggtagggagatatgttttaaaaacagtcaatgtaacatatgctaaagttttttttttaagtatttttcttatgaaactttaatagtatacttttggtttatgataccatgttgaatcttttaaaaagcagactattaagtttatatttttttagctaacatttatttaatttgccatgtgccgggcactgcaccaagtggtaactcattttctcttcacacctccctatgacatagatactgttaatatcctggtattatagatgagaaaacaggacaaaggtgtttaagaaccttgcccaggttcacacagtaagttctggatctagtattttttttttgagacggagtctcgctctgtcacccaggctggagtgcagtggcgcgatcgaggctcactgcaagctccgccttccgggttcacgccattctcctgcctcagcctcccgagtagctgggactacaggcgctcgccaccatgcccagctaatttttctttgtattttaggtagagatggggtttcaccgtgttagccaggatgttctcgaactcctgaccttgtgatccgcccgcctcagcctcccaaagtgttgggattacaggcgtgagccaccgtgcccggctggacctagtatttaaacctggaatctaggcatattatactgtcttcccccaattcacatgaatataattttattaaaaagtatttgaagataaggacttcaagggaataaaaatatgaaaatggttagggtagttgtgggattgtggctttttatttttatttaaaaaattctttaatgtatctttttgtaataacgtgtgtgttgctgtacagtttatagtttatttttacaaatatttatctcagtggatttttgcaacaactctaggaaataggtattatcctcttgtagatcagggaaaaagcctgtaagtaccattgctagtgcagaattagagtttagttttgtgagttatagtgtactgctcctagtttactatcagagtcttggggtcaaggattttttttttttaatggcaatgcactttttggcatctgatacattgtagctgaactgaattaggatctcctgtcacttggggagcttcttatgaactcaggtgggtatggtaggcctctcagcaagtgggaaatctaatttgggaaattctgaaagaattgaaaatttctaacttacagaattaatagtatagcatttcattcgtctgtccctaaagcttaacatttttttgtgtggttttattaaacaagcatcaagagtcagttgtagttgtagaatattaattaacattgtggtaaatgtgtcattttgtgcaattctatgcagtacttgaagttgtttttaagtaaaatagacactaatgtctccctatctgtcttcacaagctacaatatgagactagagagtcttgtgtagggtaagatttgagagagtaatacagacatgcctgagagatgctgtgggtttgattccagaccaccacattaatatatatgatagtaaaatgagagtgaattttttggtttcccagtgcacagacaagttatgtttatattatactgtagtatattaattgttcagtagcattatgtctcaaataacaatgtacggccaggtgtggtggctcaacgcctgtaggcccagcactttgtgaggctgaggcaggaggattgcttgaggccaggagtttgagacaacctaggcagtctcaagctgcctagtgagtttgagacgtagtgagaccctgtctctacaaaagaaaatgttttaagtagctggttatgatggtgcatatctgtggtcccagatacttgggaggctgaggtggaaggattgcttgagcctgggaggttgaggctgcagtgagccatgattgtgccactggactccatctagcctggacaatagaatgataccttgtctcaaaaaaaagaaaacaaaaatactttattgctgaaaagtgctgacaatcatctgagttttcagtgagtcataatctttttactggtgaaaggtcttgccttgatattgatggctgctgactgatcagggtggtggttactgaagattggggtggatgtggaaatttcttaagacaacaatgaagtttgctgcatcgatcaactctttctttcacgagaggtttctctgtagcatgtaatgctgtttggtagcaaattacccacagtagaacataatttgagtcagtcctcacaaaccctgccactgctttatcaactaaatttatatactgttctaaatcctttgttgtcatttcagcaatgttcacagcatcttcaccgagaatacattctatctcaataaaccattttctttgctcatccctgagaaggaactcctcattaattcaggttttatcatgagattgcagcagttcagtcacatcttcaggctccacttctaattctagttcttttgccatttgcacatctgcaatgacctcctccactgtaatcttgaagccctcaaagttatctacgaggattggaaacaatgtcttcaaaactgttaatgttcatattttaacctcctatgaatcacagatgttctcaatggcatctagaatggtgaatccttttcagaaggttttcagactactttgctcacttccatccagggaatcactgtggcagctataactgtacaaaatgtatttcttaagtaatagactagaaagtcaaaatgactccttgttccatgggctgtagaatggatgttgtgtcagcagcatgaaaacaacattcatctccttgtacatctccatcagacctcttgggtgaccattgtcagtgagcagtaatattttgaaagtgatctttttttttgagcagctggtttcaacactgagctcaaaacattcagtaaaccatgctgttaacagatgtactgtcatccaggctttgttgtttcatttatagagtacagacagagtagatttagcataattcttaaggacccttggattttcagaatggtcattgagcattggctttgacttaaagtcaccagctgcattagcccctaacaaaagagtcagcttttcccttgaagctttgaagccaggcattgacttttcctttctagctctgaaagtctcagatggcatcttcttccaatagaaggctttttcatctatgttgaaaatctgttgtttagtgtagccagttctatcatttaccttagctagatcttctggatatcctgctgtagattcactgtcaccacttgctgcttcaccttgcacttttatgttatgaagataacgtctttttgtaaacctcacaaaccaacaacctttgctagcttcagactttccttctgcagcttcctcacttctctcagtcttccttgaattgaagagagttacgaccttgttctggattaggctttggcttaaaggaatgtctggctggtttgatcttctgtctagaccactcagactttctacttaccagccataagggtgtttcactttatcatttgtgtgttccctggagtagcacttatttttcttcaaaactttccttttacattcacaacatagctaaatgtttagtgcaagaggtctagcttttggcatatcttggcttttgaaataccttcctcattaagcgtaatcatttctagcttttgatttaaagtgagagatatgcaactcttcctttcacttgaacgcttagaggccgttgtggcctaatttcaatatagttgtgtctcagggtatagggatgcccaaggagaagggagagaaatgggagaatgaccagtcagtggagtagtcagaacacacacagtatttattaagttgctttcttatgtgggtacagtttggggtgcccccaaacaaatagaatattagcatcaaagattactgatcagagatcaccataatggatataataataataatgaaaaagtttgaaatattgggagaattaccaaaatgtgacacagaactgtgaagtgagcacatggttttaaaaaatgatgccgatagacttgcttcaacttgttaaaccttcaattggttttaaaaaagataatatctggaaagcacaataaaatgaggcacaataaaatgaagtatgcctgtattgactttgttttaaactgatatgtgaggatccagggattttgcaaagtaactactatttttgaaaacatggatacgattaatacaaatgatgtgattacttggttggagacattttggagttgggaatgtttattattataatagataacatttattgaacacttattatttgccaggtactatgctcagcctgctttattttaatcccccaaactaccctataagaataccatcatcatcattttataatgaggaaactaagatttagaaaggttaagtaatttgtacaaggtgacccaagtacaaagtggtggggctagaatttgacccaggtcttctgcttccagagaccaaacttttaccagctatgtagaatactgctctttattcattaatttaatgaataataattgatcacgtatcttgtgctagactctatgcactggacatatatcaatgatgagaacagagaaaaattatttcccctttagagtgagggaaaggagacaaataagagtatgctagctaatagcacaaggagaaaaataaagcaaataaagggagatggcttttgcttgagtagggtgttaaatcgttagacaaactggactggaaaagtcttagcaagagttgaatacagacttaaaggagagaaaggagcaaaccaggtggatatttgggataagaatgaacaaacagcaagagagtatgcttggtatgttcaaagaacatttaggagcccattgtggctagcattagtgaccagaccagaggaaagcagtggagatgaatagatcagagaggtacaatctgggagcagatcttgtagggcctctggaagatctttgcatctactgaagccattggaggattttgagcaatgaagtgttatctggatttgtctggatgctttgttgtgtatagatgttgcatgctcaagggtagaaccaaagagtcttgatagaaggctgagaaaatacagttagttcttgctttatgactgggatacattctaagaaatgggttgtaaggtgatttcttcattgtttgaacaacgtagagtgtacttacacaaacctagctggtagagcctactacacacctaagctatatggtatggcctgttgctttaggctacaaacctgtacagcatgctacatactgaatactgtaggcaattgtaaccccatggtaagtatttgtgtatctaaacatagctaaacatataaaaggtacagtaaaaatatgatattataatcttatgggagcaccattgtatatatggtcattgacctaaatgtcattttgcagtgcatgactgtaatccagttgaaaaatgatagtttgtacgaccaaggttcatagctcttgagatggtaaaaagtattcatattttagatatatttctaaagtttcaaatataaaactttgaggactttaattagcagagacctcagatataacccattaggtgccaagttttatactttttcaattttaaacctaattttcttctgttatcaaagtctataatatgtgttaatagtacacaatttagaagatccatggagggaaaatatcaagcagtgtaatatcctagcatatgcagataaaattattgaacgccatgaacaaacatcttggcgtatttttttctagtcttttggcataggattgaaccttaataaatgctgtctaccataagctagctctctgtctcccctactaaaatcttagctccttaaaaacaggaactgtgttctttatttctctatcttaggtagagagcacggtgtctggttcatgataagtgctagtgctgcttgttttgtttgaattaattgtgccaaatactatatgggattcaatgatttatgtttagttagggaggaaacactcagtaggtacacttgtaaaataataaggctgagttttctgttttgtttttttaagagacagggtctggctctgttgcccaggctggagtgtaatggtataatcatagctcaccgtagccttgaattcctgagctcaagcagtccttctgcctcactctcctgagtagctaggactcagactcataccaccacacccagctgattttttgtagaggcaggatctcgctatgttgcccaggccagtaagcagtcctcctgccttggctttccaaaatgctggcattacaggcgtgagccactgtaccaggccaaggctgatttttcttaagcaaacataacagaaattaagctaaaacaaccactacagttatcttgagaggaagtcatcggggatactgttgttctgtaaagacatcatgtagtttactcttaagagtcagtttgagtcatgctataaagttttattaaatttgttcattaaaagtttttttccagctgggcgtggtggctcatgcctgtaatcccagcactttgggaggctgaggcgggcggatcacctgaggtcgggagttcaagacaaccagcctgaccaacatggagaaaccctgtctctactaaaaatacaaaattagctgggtgtggtggcgcatgcctgtaaccccagctactcgggaggctgaggcaggagaatcatttgaacccagaggcagaggttgcaggagaatcacttgaacccagaggcagaggttgcagtgagctaagattgtgccagtgcactccagcctgggcaacaagagcgaaactccatctcaaaaaaaaaaaaaagtgtttcccccctcatgatggtctgtagcgtagtgatttaggagttggctctggaggcacactatctgggttcagatttcaccttctccattcagtcagttttgtgaccttgggcaagttactctgcacagtttcacctgtaaaaagtagataataaagtgtgtaccttatagagttgttttgagtggtaaatacattagtatatgtagtgtctggtatatagtttaatctataaatgcaaatttttattattttctgctgatcctgtaattgatctaaaacataatccaggtttcttttttctttttttgagacaaggtctcgctctgtcgcccaggctggagtgcaatagtgcgattgcgtctcactgcaacctttggtcaagcgatcctcccacctcagcctcccgaatagctgggactacaggcacgtgccaccatgcctggctaatttttgtattttttgtagagacgaggtctccctgtgttgctcaggctggtctcgaactcctggactcaagcgatctgccctccttggccttccaaagtgctggaattataggcatgagcccccataacaacaacttgcttacccaccttatttgccaaatttagctcttagtgacttttgccattttcaacatgatgaagtactaagatttgtgatgcttctggctatatctgatgtcatttctaaagcaactactaaaaagttatttttaactaatagtatcattgaaatacatttatgatttcaacaaggtgattacttggaaaataatgttcattggaatgaatacattctggtttagttgtttcaaaaaacaaactgttgaatcttatagaagcatttcattcacttgaatgcataagtaatagtatcaggcaaaaaaataataaaaaaagagggctgagtgatgcaggtaagtgcttacatttcttcagtggctctctattgctaaagaagaaagtccaaatatattagtaggtcgtaaaaggcccttcattacttttccattcttaatctccttgccatacccttgcacatcttttgaagacagatactatgtctttttttctgttttaaagcttggttaatgaacagtcagtacacgttggtagaattagttagtagaattagatccagccatgctgatccatttatagttctccaagcatgccaagtttttctcacctttctgcctttgcatgtgccattttccctgtctggaattcctttccttttttcattgcctgacatactcctacctatctttgaaattgaacacaaatgtcaccttttctaaaaagccttttcttatctcatcaagcagcttgaagtagatccttctttataatcccactttcctcctcatttatatctctattacaaacactactataacaacttttttattgtctgtttcttctgtgaactgtgagcctgaggaggtagggacttagtattgtgtattttagtagccctaacatcataacacaatactaattagtgcataggagttacctaatgtgtggctaatagaatcaatgaatgaatgcttgcaaggataattggaaataagaaaagtaggaaatcacttttgtttgagatagagaggggcctatggaagagccctcaagcttgacattgaaagactggttggattcagatagaaacaataaaaaggaagatgggggactttttagatatgaggaaaatggaaaatgagagtctgtacagtgtattttaaacatgtaaatgaactctgctgcatcggaggcgttaacgcatgtgattggtggaatataagacctggaccaaaaattggttttagactgtggaggattttgaaaatcaaattaacatatttgagctttattctgcatatagtgaggatgtgagatttgggggaggttttgtagttgttatttgtttgttttttagcagaacactgttttgatgaaagtgatgttttgggaacattaatcttacattggtatgtgggataggtttgagataggaggaagtagtggcaggaatggcaaacacacctgcccagcttggtcagagaatgagattatttttatagaatattaagataaatgtgaactaatacttctttaaaaatactagacaaggaagtcacattcagaaagtacttcagaatctgtggtatctttaggcttatcgttgtaagtatcacttgtcattgaactgttgatttacagaagaacaggttaatagagaattctacttactaggaaattggataaactgttctatattttatttgagtgtaggtccaccattgttcataatcatgtaaaattttagattacatgtagcttattaattcagtttatcttcttcctctgtgctggaaggaactttttacaacttcatctctgagctcactttttttttaaacaagctctggaactcagcacttctctctgaataatttggcaacattgtcttctattcttctgaaccatgtgagatagagcctagtgggataagtatatctacaaatgacagaaacaggctgaacagaagatagatacacatatttgaaaccttcagagttctttagaatactttttgttttttcttgttacagagtctcactctgtcacccaggctggagtgcagtggcgtgaagtcggctcactgcaacctctgcctcccaggttcaagcgattttcgtgcctcagcctccggagtagctggaattacaggtgtgtgctgccacgcctggccaatttttgcatttttagtagagatggggtttcaccatgttggccaggctggtctcgaactcctggcctcaagtgatcctcctacctcagcctaccaaagtgctgggattacaggcatgagccaacgcgcccagcctagaatacattttctaactttggatattcctggacacacatttgtgtggctagtgcatgtggttaagaaaaagggactgttcaggaaagatacttgggagtggggagaattatctactgggatgtacttagcatcatatcttattaaaattcttctggaagggcttttttgttacttagaatcttattttaacattaagctgatttgatttggtttggacatttctatattttttccctttagaagtgatttttaaatagctatcacaaaggttgagactaataaaaattgcttccactctaactcaccttcaattaatatgcaaagaatatgtaactgacaacattgcaaccacaattagaggacagatattctcaaatgatgaaaatccagcatttagaatgaagttaatttttcccaaacttccctacctgtaacattcaaggcatgggtttgcttttgcttagaagagtggaggaggctgggcacagtggctcatgcctgtaatgccagcattttggcaggctgaggcgggaggattgcttgagctatgtgtggtggcatgcgcctttagtcctagctacttgagaggctgaggtgggaggatccctggagcctgggaggttgaggctgcagtaagctggcatagtgccactgcactccagcctggtcaacagaatgagactctgcctctaaaaaaagaaaaaaaagagcagaggcggttgtaatataaacaaaatgtggagctcttttcatggtattcacagcaagttcaggaatagtctccttgcaatgcaaggagtattcatctttgtaaactgcagcctgaattaagggaaaaatctcagcttgttcctttctctgaatcattattataaggaaaaggagtttaagctcctaatgaagtatcaaatcccctttcattgtacaattttggatgattgactaaggactggttttctttgcaaagatccctaggccagcattcccaaactgttaagtaggtggactgtggaaaatgtgttctgtacttaaatactatttggaaaaacagttaaacatcgttcttttctgcaacacttctcaaactaatatgcttataatgtatcttctgactgtccacagaatttcccaaacacatttgagcacatattgtcccatctcttcccactcctgacctcaccagcccctagcatacgtatcactcacagggtaaatgtgaagttttaggaaatgttgccgtcagtacacaaacttgctagataaaatggacccaactgggatagtcttgaaaaatgtttaacttactgagacagatgtgaaagcccattgcccttctagttctgggatgattgatcatgatcacagagagcttgattgagaaaaaaggagaagccaagttttagtggaatttatttagaatgcactagaagagtaaaaacagttaacattcattactagggcatagtagggtgccttgagaggagtcgtttaaaaaagtctgaagattatgaaccctgattagtgaattagcaaatatttcatacggttagttcttaggattagatttcaacacttcagtgcaaattcttcacacttttgtcatgtgaatgcagtttgagaatgcatttcaattagatctgtaagttgttgaattatcttttattcttgaactggtggaatagacatggtgcttgcttcaattatccgttaactccagtatttctctaaatatttgctgtccaatattttctaataaattcctttaggtgaatatgcaaagatcacaaaaatgaatagtcatttatgaattccctgtgaagacaaaaggattctttgagacaacaaagcgatttttcgagacaacaaagttttgtttctctggaacctaaataagcaggatgcttacagtttctcgacatattacatacttttttcttgagaaaaatgtaaaagataaataggtgggcattttttatgaaattattaatatggaaaacaaacattaaaggcatttcattaagtaagggtagatttagtccaacttcatagactttctaataactctatacaacaagcttgtccaacatgcagccccgtgggctgtatgaggcccaacacaagtttgtaaactttcttaaaacattatgacatttttttttgtgcgatcgattttttttttgtgcgacttttttttaagctcatcagcgattgttagtgttagttttatgtgtcgcctaaggcaattcttcttccagtgtgacctagggaagccaaaagattgaacacccctgctctacaagataatagttggtgttccaaatgttaggctacaggttttatagctgccccaaaaattaagtaacaatggcttaacaaatcttaaatttgtttctctctgatataacagtccaaacataaatagtctaggactgataatgtagctttgtggagcccttgggccttattctttcctatcctcctccttaatggtttccatctcatggtctaagatgcctgctgtagtacttgccagtacatcctccttccagctagcagggcagagtaaaagagagaagaagcactttttctaagggtacaccttgaaagttgtatatgtcttttctattcacattccactggtcagaaccttgttacacaagggagactgggaaatgtagtctttgagatttcacagaccattaataaaaattgatcatgtagtaagccttagagaacacctaaaaaagtcatatcagatatgtcctgctgaaacttctgttgtgataaaagacacgcacacacacacatatgtgtatgtatatattaatatatatatttatagggagaatagaggtatttagcaggctgttattaattattctgatatgcttttccaaatgctgaagtgttttctatgttttcacgtaaataatagattgtactttatagaaattactttttaagtatattgtattctagttctctgtaaatgagtaacttatgggtgtaagaattttcagtgtatgaagcattcagttccccaggatgtctgaatgtatattgagtttttaaattggtgatatgtatatgtgtatatgtgcacatataggaatataatgagataatattatttggcatgcagatacttgatgtacagactgtctatcaaaaatgtaatagcaaagtaatggtttattaaaatgagcacttttgattacagttgttttccatgaaagggaaaaatgatgacttagtgatgcagtggtccacttaaattgcaatatgatctaggagattttaggtcttcttcccaaattctcagttttaaaattgtaaaggtaattggtgtacttatcttattgaaatagaggaaaatatgtatattcagctatgtccgttcgtttttttagatctcatatctctcgtatgtaaacacatacctaggaattagttccatttagtgtaataatttttatagggagttccaactaaaattaaatttaggaaattttaattgcaccaattgattgattgattgagatggggtttcactttgtttcccaggctggtctcaatctcctgtgctcaagtgattctcccatctcagcctagtagctgggactacaggcatgcaagcgcgtgcctggcctaagtgcatataaaaataaggttgtacatttgggagattttatagtttaacaagcaccttttcatgtatatgatattatttgatagtatcttaagtatgttttaaatgattcttattttctgatcttttcaaattaatttctctttaggcttaagctagattttacatactttgacatgcattttcttttttgttaacgctgcatgaatagcaaagacatgaattttgtcattcatctcaaagtattataatcagaattttttctttaattaacagcttaatttccagatataatatttttaaagctctcttttggttgttgattttaatttattgctctatactttgtgtacagagtctgtatttcattgatttgggaaggtaattgaagtgtctctttgggctattatatggtcagtttttatgaatgttctgtgtaagctcaaaaagaatatattttatgtttattgtgatgtcacatacgtcatatgatatcagactttcaaagtggcatttttcaaattttgaggtttttaaattttttttgtcattttctgaaggcttgttaacaacgtctaattagaattgttaatctcttttgcacacagatttttagttgttttttctgcgtgtgtgtttttttggtgtttttgtgtttcttttgtgttttttgtgtttttttgtgtttttgcacacagatttttagttgttgcttatgtacattgagactgtatatatgtgtatctatacataagttgttgcttatgtatgttgaggctgtatatatgtgtatctgtgtatattcacatttgcttttttaccggtatatgtttccatttgtcttttattgcccttgcctttgaatttaaattcttttgatactatggtgggtttattttggttcatattttttaggtacctttttgtttctttatttttttcagctttgctggatcctggttttatttatttattttggatttttaacttaatttttaaatttaatttttatttagtttttagcgatagggtctggctctgttgcctgggctggagtgcagtggtgcgatcatagctcactggagcccgaatctcctggatttaagcagtccttccatgttggccccacaaagcactgggattacagatgtgagccattgttcctggcctggattgttgttttacacttaaactgagaatatgtcttctgagtttaacctattagaatttaatgtgattatttctatgttagaacttagctctgccattttatatcatatcccttcagtgtccaagttgaatctttctcttctcccttccttgcccaacaaattccaagaagtttagcatactctccacactgcacccctactttcttgaaatagggtgatgtgatgttttaattatttattcttatgaatacacttgttttaagataacaatacatcttctaaaattttttccttcccatattttgttgttttcttctggatatatttcttttttgactagattacatttttcaaatgttctttgaaagaaggtcttttttttgtggtaaacattgaggcattgtctgcctataatatgtttaccattcacaattaagtgataatttaccttgatttaaaattctaagcatggatttgtttttctacctcaatattttgaggatagggtaatgttttattgtcctcttcctgtcctggtggtgttctgaaatctggtatcagtttgaccctgctcttttttaggtgatgttgcccctgctcctcttgctagaagcttttaaaattttgtctttgaaaggcttacattttactccagtacatttaggtatggacttttttttttccttatcttttctccttagcactttaagccatttcaatctgagatttcatattgtgaattctgcaaaattctgtcattttttcaaattcttcttcgtttattttctttgcttatagaattccttttgggtagatatttacactaatactactttccccaccatattttaactagcgctttattcatctttttgtcgctttctgagaccctttggaacatttcctagattaattcttaaatcaactctgttcattttcttattcaaaccattttaaaattcttcattgcaataattatatatatttttacagccaatattttctttctcttaactgcttattcctgctttgtatttctgatattttttcatgtctgcctgaggctatttattatgactgtttaaagttttttttgattagttctgatttttcttgaatgaggttatttcttgtcagtatgtgtttccctttcccatattaatgcttcttaaatatctctttaatttttcccatttgctaaatcttctataatcataaaatgctggtatatttagagagtgagagatggacatacaccgagctcagccatacttggtgtttttctcacatgtggctctctcctgtttcttagggacacttgtccgtaggcactgcttacataagtagggcacctccctctctgctatcttgttttagtctggtatctcactgtcactgctgattaggttctacactaaagtagtgatagcataggcaataatctgcataagaaaattcagcctagtaaaaagtatacccaagtagaatttttaaccctagtttatacttcccatcagtgagtagactctggctttcatgtgctctgtgcatccctaaagatgccctaccattatcaatgtcttcaagtgttgttgaactggtttttgagatccagcaatgtttatattacctcagcgtcatctgtagagtgggattcataggaataagccagcataccagcagatggtgctagtctcttaacttttcagaaaccaaaacctatatcttacttctaaaggtaatagctataaatgattaaatttctttggaattctcagaacatcttagggtattaaagtggttttatgaagagataagagaacaagtttatctttaacaatttctgtctctttcctcatgcatcaaattgtgctattctggttacagtatatttaaaaaaccttttgtgatagaaatataactgacttttaaagtattgtgatctataacagctactatttattgggtgcttattgtgtcttggatactgtgctaagtgttttatgtatgtaatgttgggataagaccaggattatttctccaatgagaagttttaacttaataggtttataagaattgtgtattactattcttcaaaacaaaaattatgttcaatatagtttagtaatagtaaattccattaaagtcataaaatgtgaggcaaggtgcggtggctcacgcctgtaatcccagcactttgggaggccaaggcgggtggatcatgaggtcaggagtttgaggccagcctggccaacatagtgaaaccccgtctctactaaaaatacaaaaaattagccgggcgtggaggcaggcacctgtaatcccagctaccggggaggtggaggcaggagaatcacttgaacccaggaggcggaggttgcagtgagccaagaccgctccattccattccagcccaggtgacaatgtgagactcagactcaaaaaaaaaaaaggtcataaaatgttttgcctgtggaagagggaaataattggaggagattgttactgttgttattgttttcagacacaaagtctctgtcacccaggctgcagccttgaactctgctcaagggatcatcccacctcagcctcctgaatagctgggactacaaaaaaaaaaaaattttttttaaaatttttttgtagacacagggcttttctgtgttgctcagactagttttcagctcctggcctcaagcgatgccgccaccttggcctcccaaaatgttgggattacaggtgtgagccactgtgcctggctgattgttattgttgagggaactgagacctagagaatttgcaatttttatatcgttaatggtttttgtttgttttttggtttcagtgttatgtttgggatgattatacagagccatttaatttttagagtatttaatatttatagaaaattgcaaatagaaaggatcactgaaaagctgtttattcattgtgtgcttgtatgttttatattcagatgtaaaaacagaaaataaatgagaaataattcctgcttccttaagcagtttatgtgatcaccatttctcaactagtttttttttaatattagacttatctatggacgtaactactttttcatttaagactagtacacttaactattaaaattattttagtaattaacctttattttttattacataaaaaaggcaaattttctacccttatcttttgcttcctgattatagttatacttggtggtggaactcgaaacagtgattgtgtgaaagaacacagattagaaaattgctaactctatgttgttggagttgttttttttgcttgacattacttaagtagtgaaatcattcccccctttttattaaatataatttacacacagtaaaattcacccattttagtactgccttgcaagttttgacacatgcaaacagttgtgtaagaaccaccaaaatgaagatgtagaacagttgtgttacccctcacattcttctgtcccttgtagtcagtccagctctccatcttcagtctctggcaaccgctaatctgttttatacccttacaaatgtgctttttcaagaatgtgatataaatgaaataatactgtatgaagccttttaagcctggcttctttttcttagtacagtacatctgagatttatacatagtgcctctatcagaattcattcttttgtgttgttaagtagtgttctgttgtgtggatatactgaagattctttattcttttttagttgatgaataatttggttgcttccagtctttggtgattaaaaacactataaacattcgcatataagtttttcagaaattttcacttaatttgagtaaataccaaggagtaaaattgctgggttataccttaaatatttatttgatctcataagaaactgctaaactgtttttgagaatggctgaactattttgtgtttccattagcaatatgtgagttccagttgtccctcaaccttgctagcatttgatattgttaatttttaaattaattttagccattctaaaagatgtgtaataatatctcattgttcttttaatttacatttccctaaatgactaatgaatgtgaacatttttaatatatgtttttttccactgtatatattctttggtgaagtaactaagtatttgatctcatgcccatttctttattgggttgttttctttttcttttctttttttttgagacaaggtctctctctgtcacacaggctggagtgcagtggcacaatcttggctcattgcagcctcgactcctgtgctcaagtgatcctcccatgatagcctctcaagtagctgggactgcaggcacacgccaccaatcctggctaattaaaaagtaaactatttgtagagatggtgtctcatcatgttgctcaggctggtcttgaattcctgggctcaagtgatcctcctgccttagcctcctaaagtgttggaattagaggtttgaactactgaacctggcctcggtttttttttttttttaattgaattttgtgagttcttcaaaatattctgggtagaagtccttcatcaagtatgtgattcgcagatattttcacataaactgtgatttgtctttttattctctcttcagtaagcattattgagatatataattgatgtacagtaaactgaaaatgttctttgtacagtttagctttttgaattgtataaagtatacaatttggtaggtttcgacatgtgtatcctgtgaaactattaacacagtcaagctatgaatgtgaacatattcatcaccctcaaaagtcttttcttgcccctttttaacctctggctatccccaggcaaccactaatttgttagtttattttcataacaaattagtttgcattttctaggattttatataaatgaaatcatacaatttgtactcttttagtcaacaaaattattttgaaattgatccatgttgtttcatatagcaaagttcatttttattttattgctgagtagtattctattgtattgatacaccataatttgtttaggtatccacttcttgataggcatgtgagttatttccaatttttggttgttacaaataagaccacaatgaacatattgttttatgttatatattggatatgttaggcatatatttaactttttttttttttgagacagagtcttgctctgtcaccaagactggagtgcagtggcgcaatctcggctcactgcaacctctgcttcccaggttcaagcgattctcctgcctcagcctcctgagtaggtgggattacaggcgcccaccaccacacccgactaatttttctattttttagtagagatgggtttcattatattggccgagctggtcttgaactcctgacctcaagtgatctgcctgccttggcctcccaaagtgttgggattacaggcatgagccaccccacctggccaagtggattatattcttgaaaatgatggagagtagattttttattttatttatttatttattttgagacagaatcttgctctgtcaccctggctggagtgcagtggcgcaatcttggctcactgcaagctccgcctcctgggttcatgcccttctcctgcctcagcctcccgagtagctgggactacaggcacccaccaccacacctggctaattttttgtattttttagtagggacagggtttcaccgtgttagccaggatggtctcgatctcctgaccttgtgatccgcccacctcggcctcccagagtgctgggattacaggcgtgagccaccgcgcccagccggcatatatttaatttttaaagaagtagcttgtaatcctagctacttgggaggctgaggcaggagaatcacttgaacctgggaggcagagattgcggtgagccaagatcgcgccattgcactccagcctgggcaacaagagcgaaactctgtctcaaaacaaaacaaaaaacaacaacaataacaaacattttacattctcaccagcaatgtttgaaagttctggttgatccatgttgtcactcaacatggccaatctattttttgccatcctcataggtgtgtagtgatatcttactgtggctagaatttgcttttccttaatgactaatcatattgagtactgttatattcttatttgcattttttatatattctttggtgaagagcctgttcaagtcttttgtgcacctttgaaattgagttgttttccttgtattcaattttggagtcctttatgtattctgaatattacccaataagtgatttgcaaatattttctctcagtctatggcttgtgctttcattttctcgtgaaaaaaggaagaatttttagtttttataaagttgttttttttcaattttttttctttcaagattcatgcttttagttacttacatggttacttggaaataaaaatattttccatgctttgaataatcctgtaagtgaggaaataaatctctgaagactgggcaggaatggcaggtcaccacaaatagcaacaaacttaagctgggtggagtggcaggggcctgtaatcccagctccttgggaggtggaggcaggaggatcacttgagcctaggagttggagattagcttgggcaatatagcaagactctgtttcttgaaacaaaacaaaacaaaactctcagttctggggagaacgatggtgtgtggtatgggatgtatctgtggaactatagtttgtacatcttccttgttgaaggtatgaggaaaaaaatctacttcacactgttgctggtagttatctctgattgtggaagaggaatgcagtgaaggagatgcaataagaaatcattaagagacatttgagctatacatttagttgggacagtgcactttcaacaggacagcatgagtctttctgtagacccactttccggtgaaactggaaaaagcagtcatttggtctcgaaaaatggtcctaagaacatatagcaaatgaaaagacatttattcaagaatatctactaaaacttggtaagaacattgaatttctgtggtattgaaccaagacccactccttttcctctttcccagcttgctgagatagaaacttcactccagactggtgcagccaagaacacaagattacctgttcctttatttcctagttggagggtatctttctcaaaggaataggatatcaagatttttttttttagtggcctgttggtgaggtcaagttctggatgagtggggctgagaggcaggaactatttcttactcatggtacagaggctgtacctgtgtacagtaccactgagaatactgaaggcacagtcacccatgccccagcttgtaatccagcagttccacattgggagaggcaagttgagacccgaggctgttgccccaactccacaaagtgtttttgtcctctagctgggttgtcattcaaagagaagtgcaccattgttccccagctccagagatagagacttgcctagggggagaagtatgctgtaagacagagttctaaatctctttctaaagcaactaacttcatttgctggggagaagttcaggcctaagagtattcaaaaacaggagggtgcggtgagagacagttaggaggagattggtaggtgcagtggagataaataaactgtagaagggctagtttgctggagagaaccagggaaatgaagagctgggaggagtctttttggggtcagaacaaatctcaaacattggcccccgaaactattcctttaaaggaacccagatttgttttgattgacctgtgaagcaatttatgcttcagcacattgttgaaaacaatggagtaatcagccagcaattggtgatgcctaacaactggatgtggtcaaagaaagaggaaaagagtgccctgccaaaaccactgtcatttcatggtgactttgggactatccaaggctgtgcctcctgaggaggaacatgaggggcttcacacagaggggagattgggagaaatatgcttcactaaaacaatccagccagtgactaaagaaataacagtaacataccccagagtggggcaatcaatatccagagtggctataatatataaaatggtcagttcccaacaaaaaattgtgagatatgtaaagaacatcaaagaatgagctatacaccagaaaaaaagcaggcaacagaaactgcctgtaaaagtgaccagattttggaattaacttcaaatagccattgtaaatatgttcagagaagtaaataaaatcactattaagtaaagcaatgtatggtgacaattttttatcaaatagagaatgtcaataaagatacagaattattaaaaagaactaagtgggattctataattgaaaaatattaaggctgaaatgaagagttcactagagggactgagtcacagatttgtactggcagaagacagaattagttaatttaaagatagatcaacagagattatgcagtgtgaagagaaaaaaagcatggagaataatcaacagaacctcatagaaatgtgggacgccatgaagtgtaccaacgtacacataatggtaggaccaggagagaacagaaaagaacagaaaatggaagaaggactgaacatttttctttcattgccaaatttattcacaagtttattgaaaaacattaatctatatgtcttggaccctcagtgaactccaagtgaataaatgcagagagattcacagacacatcatggcataggttaaggataaggaggaaatcttgagagcagcaacataaaaacatgtcatcacttacaagtgaaccccaataaaattaataactgccttcttatcagaaagaatggaggccagaatgcagtgggataagatcaagggcttaaaggggaaaaaaccaaacaaacctgtcaaccaagaattctgtattcaggaaatctgtctttgaaaaataaaggcaaggccgggcgcggtggctcacacctgtaatcctaccactttgggaggctgagacgggtagatcacgaggtcaggagatcgagaccatcctggctaacacagtgaaaccccatctctactaaaaatacaaaaagtagccgggagtggtggtgggcgcctgtagtcccagctacccgggaggctgaggcaggagaatggcgtgaatacgggaggcagagattgcagtgagccgagatcgtgccactgcactccagcctgggcgacagagcgagactccatctcaaaaaaaaaaacaaaaaacaagaaggcaaaacaaaaatattcccagacagataaacaaaactcagagaatttgttgctagcagtcatgccttacaatgacacaggattttttttggcccctttgccagggtcacagcaggggggcaccctgtctacttgtcccacctgggctaagtctgacttgtgcaccagcacagcctgcagctagaccaggggtgtcccagctcacctgtgctatagcttgtacccacattcagtggttcccaagctcttgtcccccatccgagaagaatggggatacactgacagttgaagagtgaggaaggcggagaataattttattgaatgacagaacagctctcaccaaagagaggacacggaagtggtccctctctcagtgtggctgagtccagggtttttatggcctcagaataggggagtgtgtgctgattggtttcctagtatgcagagaaaggctaaagcagaggcaccactcagaggtgggcacagcagggtagaaaaccaattaggaaagagtaggtgtatgtaaaatagttgaagggtagagatcaatcagagaaaagtgcaccaaatgggaagacaggttctcaatccagtccatggatttgacttgtagcttggctttcaggctttaaactttctttggcttgggagtggggtttcaccagggaaccatccctatctgcctggcatttgactgcctcctgtcactaccaataagaagtactaaaggaagttacttggactgaaagccggcgatcccacatagtaatttaaatccacacacacaaaattgacaaaaagcaccaccagcgaaggtaattatataattataaaagatagtataaatgcatatttcttttccatttcttaattgatttaaaaagcaggctgggcgcagtggtgaaaccccatctctactaaaaatacaaaaattacccgggcgtggtggctcacgcctgtgatcccaactactcaggaggctgaggcaggagaatcgcttgagcccgggaggcggaggttgcagtcagctgagatcgtgccactgcactccacctgggcaacagattgagagtccatgtcaaaaaaaaaaaaaaaaagcaattgtgggctgggtatggtggctgaaacctgaaatcccagtaccttgggaagttgaggcaggtagatcaccagaggccaggagtttgagagcagcctgggcaacatagtaagactctgtttttacaaaaaaaaaaaaaaatttaaaactagttagccacagtgttgcatgcctgtagtcctagctgcttggtaggctgaggtgggaggattgcttgagctcaggagtttgaggctgcagtgagctatgattgtaccactgtacgctagcctgggcaacagagccagaccctgtcttaaagagcaaatgtgtaaaactatatatatatatatatagtctttgggaccatatacattaaaatgcaatatatttgccagttacagtgtgaggaaaatttgttggcacaaaactacttaactgaggaaatgactcttgatggtaatttgaagccacgggaacaaggagaaccagaaacagtaaaaaagagcaaactccctttgctctttttattctctcagcttttaaaaaagttgtaaaattatgtaaagtaataactataacaagtattgttcagcttataacatttatagatgtataaaacagtgatatcacaaaaaggaggaaaaggaaatagagctatataggagtaacatcttcacatctcagtgtgattaagttagcataaatctgaagctggatctgataagatgtatatgggaagccctagagcaaacatgaaggaaaatcaatgacaaaatgctacattaggaaatattgatgtaatgcaaaaagaaagcaataaagaaggaggaatggagaaacaaaaacatgagatacacacagaacaaaaagtagattagcaggtcaaaatctagttatatcaataatgacaattaatgtaaatggatcaaacagtcaattcagaagttagaatccaggtgtggtaaagtacacctgtagtcctagctactcaggaggctgagatgggaggattgcttgagcccagtagttaagagccagattgggtaacatagcaagaccctgtttacaaaaattttaaaaaggcagagactggagattgtcagactggataaaaaatacagaactcaactctatgctctctacaggagacacacttcagattcaaatatatggattgaaaataaaaggatgacaaaagatttattatgcaaattataaccataagaaagctggagtggctatattaatatcaggcaaaatagattttaaaacaaaaaaaagttactgaagctaaaaagggacattttatattcataaaaaaattgcagttcattaagaagacataataattgtaaattgtgaatatctgcatctaacaacaaagctccaaaatagtatgaagcaaaaactgataaagggagaaagaggcaatttaaaaataatggttgcagactttaatacccctctttcattaacggatagaacaacttggcagatgatcaacaaggaaatataagacttgaacagcattgtaagtcaaccagaccaaacagacactatccaagagtagcagaacactatccaacagtagcagaatatggatttttctgtagtgcaaacggaatattctctaggaaacaccatatgcaacactgtaaaagaaaccttattacatttaaaaagaaataatacaaagcatgttttcaaagcacaatagaatgaaatgagcaaccaacagaaagaaatttgggaaacttaaaaatatgtagaaatggaacatgttcctaaagtaactagtgagtgaaagaagaaatcagaagtaaagttggaaaatactatgagattaatgaaaatgaagaaataatatactaaacttatgggtgcagttaaggtagtgcttagaggaaaatctgtaattgtaaatgtctattaaaaaagaagaaaaatctcaaattgatacagccgtctaccttaagacactgaaaaaagagcaaacctaaacctaaagcaagcagagaaaggagataatgaaggttcaagaagaaattaatgaaataaaagaaaaactagttaaatcaaaattagttaaatcaaaagctgggtctttgaaaatatcaacaattttgccaaaatatttagctagattgtctaagaaaaaacaaaacacagattactagaattagaaatgaaagaggagacactgctaccaatcttacagaaataaaaaggagtgtaaaggaatagtagcagctgtatgccaataaattaaataacttagatgagatggacaactttctagaaagatacaaactaccaaaattgacttaaaaaaaaaagacaatgtaaatagacctataacaaataaagagattgagttaattattatttttttaagaagccacctacaaggtaaagcaaaggcccagatggtttaactagggaattctgccaaacattgaaaggaaaattagtacagattcttcaccaacttttgcaagaaatagacttagttggggacagatgtaccttcttacagcagttggtgtgggaatgggtaaccagagcactagggaaatagcagtaagttatttatcttcccctgtgactggagattaagatccttgctttgagtggaaacttttttttcatatatagtagcttcctgcattcaattatcttgtaactagtttataaaacttttaacttccttaaaagacattgtattgcctgagtgagggaaaccttttgaaggcagattattgattattgaatccgaatttatttaaaaattttaaataaaatgtttaaagtgtgtttataagattataccaaatactagttgtatttctaggttctaatataataatgttaatttaaagacattactaaattacttatattcaggtttttagttaacctaatttttagtgtgaaggtctgttacaagaataaaggacccttacatgttccttgaatcatttggtgtaaacttaaagagtataagctggggctgaattggctgatttttaaaaatcacttttccctggaaacttgtttatcatacctgtcaaagatcatttgtatgcgtctcacttgagtattagagatctttgaggttggtaggtcaacttttagcatctttttcccctttatgtgtatgtatgcatgtgtgtacatgtttgtgtgttgtgtttaatatgaattgtggcatacttttttaccatttgggatataaattatggcttcccatgagcgtcccaatatgcagcactggtgggactctaagagacgattcctccctccaaagtttctaaacgtttttgttaactattacaggaagtgagttcagactcctgttactgccaacacactaggcagccatgtacacatacaaaatgataataatagtggctaacatttgttgaatgcttgagttttatgaggcattgtggccagataattgttccatccaaaacttagattatttgtaaacattttcaatttactgctgttcttgattttgagctacggcagtagttctccataaggggtagttttgcttcacagagaacattgggcaatgtctggagatatttttgattgtcatagctggggagtgctgctggcatttagtgaatagtggctagggatactgctgaataatgtataatgctcaggatggtccccccataaagaagaattatccagcctgaaatgttaatagtgctgaggatgagaaaccctggcctggagtgattgtgcgttcatcctatgagccatgattcttgcaggtttgagggaaaatgatgctttcttttagtgtttggttgaactatattttcatgctagtactttaggacgtaagctgacaaccagaatgtctagctccagaaagtttgcagtgtttgccatctcagagaaaacctagaactatttttggatcattgccctctatgcctgacagagtcttccagaatgtctatttctatgtgcaatagggattttatctaagaggcttcattgctcttttatgcccttgggttttggttagggcatccttatcacatccaataagactccatctgaatccaggtgagaaaagaattttaagttttcaaattttttctctctcagaagtttctggattcttttttgaaaatttattcattactgttcttacaatttgatgcgttactagtttcatggaagggagaataacattacaaagcattttaaagctttgctatattggaactgtctgttttaaggcaggagaaacattaactcattagctcagccaatgtcatatgagctaagtagtttggtgaagtcatgattccactttaggtatgctctaaaataaaggcatactgtgttaattttactgccagatggatgcaaatagaatttagtttaaatatattaaggaactaatcttttcattttataagttattcaggatcatacttttttctgctttaagtactttattgctgttgcttatcttagtaatttctagctggtaaacttaacctttcgaagaatgttttaacctacgttgttgtaataattggtgaaaatccggtggtaccatatttctctgaaataatttacttccagtaactaattaatacaatgttaggcaagagagtatttgcttacatatatttagatatgtgtttctaattagagaacttttgacatgttacaatttttatttcaggcagtatacttcatgagactctacagcagtgattctctaactgaggttccccagaccagccggatcggcatcatctgggagcttgttagaaatgcaaatattcagacctactcagtcagaaactctggggttagggccaagcagtctgtttttaacaggtcctccaggtgattctgaaccttgctaaagtttaggaactgctctacagagagtgacttgttgaaataagttcacttgattttaatccagtatatttgtcttgttctccttttgttcaaactaccacattttaaacttgtattacttgtgggaagataaactgtccaaatttctggctgaactcaaatagctcacatgaagcgtttaaagaaagacagtttgagaaatattatttcaagggtcaggataggtgtttatataaatcactattttaaaaaagccctcaaaatatttaatttaaaatcctgtactgtgggagtatgattgtttggtactgaggagctgctgagttaaacagattcctgagacatgaaatcaaaggatttttttaaaaattcacatgcttctatagaaactttaaaaatcgaggctgggcatggtggatcatgcctataatcccagcactttgggaggccaaggcggacagatcgtttgagcccaggagttcgagaccagcctgggcaacatagtgagattccggctttttttttttttttttttttgagacagtcttgcggggtcgtccaggctagagtacagcgccgtgatctcggctcactgcaacctctgcctcccaggttcaagcaattcttgtgcctcagcctcccaagtagctggggttacaggcacacaccaccatgcccagctaatttatgtggtttttttttttaaagtagagatggggttttgccatgttggccaggctggtctcaaactcctggcctcaagtgatccacctgcctcggcttcccaaagtgctgggattacagacgtgacccattgtgcccaacctccatctctattttttaaataagatattttatataaaaaaggaaactttaaaaatggaaattaggatgataatatataagaagaggtagtatgctgaaaactgcaattatttaaagaaaagaagtctaaaaatatattctaaaagttcatagtatagtatatattgtatagagatgttcttttaaatagtggtagaaaagaattccagatttggatgcttataatagtactgttagtctatttgagaatttaattgtagtgtaataagtattaatgctctaattaatgtgttcataatgactgaattgccattgagatgatagtgtattgtgtataatatatagaagatacaatcacattaaatgtacagagctgtgctattatctatagcttgcaaatctttgggcctttcttcttaataatgcacaagcagtacattaatattgagatacttcaactggtgaccttaatttttctccgtgtaagtcaaattttttatatgcaggttatactactaaagtcttaacttgagtctatccctaattatctttcaatataggtgctacatattttattcttgctggtaaactaatttttattttatgttagtttagcttattatacattagcctttcttagcgttgtcgtagattatagggactaagtacagggactgttgtctttaaagtttatattttttatataaatatatattttatttttttatataaatatatattttatattttataaagtttatattatactcaacaagtagaattttaacaaactggactatttagtaattttactaataagaatggttaaaaccggccaggcccagtggctcacgcctgtaatcccagcactttgggaggctgaggcaggtggatcatctgaggtcaggagttctagaccagcctggccaacatggtgaaaccctgtctctactaaaaatacaaaaattagccgggtgtggtggcaggcgcccataatctcagcttctcaggggggccggggcagtggaatcgcttgaacccgggaggcagagttgcagtgagccgagattgcgccattgcgctccagcctgggggacaagagcgagacttctccaaaaaaaaaagaatgcttaaaagcccagtttatatgtgttccccccccaacccgcaagaaaatgccttattatagatctaggatatagatggcagagtagaggtaacctcttatggtgttaatttgctatttttcacttccaacttcagggtatctaacctcatcataactctgggtagaggccaggaatatatacatttcgtgtaaaaaagaatattcataagttgaatgtatgttagtacttagtgctgtttttgatatttgtgtgtatatagataggtagagaaggcagagagagaagtaataaaagactgcagagagagtaataataagaaaaagactataggtcctagatagatctatatttgctcggaagttatatacagtgtatgtagtttactacacagtgtatttacttaggttagtaagaaaatcagtgttttcagagtttctacttaatttttatttaaattaatttaaatttttaaataaatgacggttcatttacatattaattatacttcaaaaatcatataatattttatgtattaatctgaattaaaatctttggaaaataatgggctgtttttcatcctaaagctgatactggttaattatagaaaatctggaaacatctgaaaaagtatctggaagaaactgtaaatcccatgtgaacctaccactcaaaaataattacaattaatattttggtttatttcttcccagtcttttaaaaaataaatttttaaaattggcatcactcatatctttattagttttttaacctattataaacaataacttttccatatctttagtttttagataattttaataacttcatatttgtgtcataattttaacttctttttattgtcatacatttaagttacccttttgctttaatgttataaattttgtggtgaatcttcttgttcataaatgtatttataaatctgtaaatcttttatctgtgtctgattatttccttttatatttctagaggggtaattactaagtcaggaaatataaatgttttcaagattcttaatgtatattgccaagtagccatccagaaacactgatccaatttaacatccactagcagtatgtaaaatgtctataaaataatacttttgtcaccagttagtatcataattgcattttaaaaatctttactatttcatttgtgaaaaattgtactttgttctgtcaaatattgtcaaaatactgaaaatgttattttacattatagttttaagtggattaattgaacatttaaaaaacatacctggactttatcaatttaaattaaaatgtagtttagtagaacattgtcaacagccaggagatttggaaatatttggtcattgtaatggtaagaggatccattgggaatcaccattgattaatagactttcacttgaactttaggtcttgcctctgatcattatttggatttttagagtaattctcattagttttctgtcatcttttagttttgccaaatcaaaacttggcagttttattaaaataataatttattcaataatattattgaaataaagcagctttaaaagcaagagaaaattcatactgagaagtatttttctatagaaaaataaatccttgctcatttatcaaattttaggaatggctgttataatgtaggaatgtaagagcgctgctttgaaattagactttttagtaacttattaagattatgtcatttgcttacaatatttatattggataaattgtctaacttctaggcctcagtttccttatctattaaataagattaaaaacagtttcttacaaggattgtgaaagttaatacatgtaaagtacttacttagcagattgcctagtagttggtaaatgctaactacatgctggttatagtttagcagattttgatagacttattcattcaacaagtatttactaaccacttacagtgtgccacacactttgtagacattgctgatacaaactgacaatcatctgatggaacttacactgcagttagggatgagggggtagaatttatcttgaaaattaaaataaccataaacaagtgtttaaaaacttgggataaatgacttcatgggaataaatggccttatagttaaagaatgacttctgccttttgggggaggagtactttgcactgtttttgttttctgtataagttttattcatatgaaaagtgatgtgattagtatctgctttttttcatttgggaaactcaagctgatagaaaataaagcatctgatttttatatggtaatacatgttggaattaatgatactataataatttatctgagaagggaagaaggaattgcttttttggtaactaaacagcagagtacatttacattttaaagtaaattgatataaattattattattattattatttttggagacggagtcttgctcttattgcctaggctggggtgcaatggcgtgatctcggctcactgcaacctctgcctgccgggttcaagtgattctcctgcctcagccaacctagtcactgggattacaggtgcctgccaccacgcctggctaattttttgtatttttagtagtgatggggtttcactatgttggccaggctgttctcgaactcctgacctcaggcgatccacctgccttagcctcccaaagtgctgggattacaggcgtgagccactgcgcccggctgaaattattttctttgcttagctgttaaaattggcctccaaaattaaagaaaaatatagcatttacttttaagagtaatatttgtttttaaaattacttatgaagtagttttcaatctcactaaatcccccactcccataaaaacagagctgaaagaaatcatactacttatttatggctgcattacaaattaccctcaaacccagcacttaaaacaacaaacatttattatcttaaagtttctgtgagttctgaatctgggcacaatttagttctagcttagactctagctaagagtctgtcactgtcaatctgttgcaatcaagactgcagtcaatggttggcctgggtttcagtcatctcaaagtttgactagggaggagtctgctttcaaactcactcagtgattgttgacagaattaatttccttgtggcccattgaaatgagggcattggccaggcacatcaaattttatcaattgagtactcagtacttgcctagtataactaaacccttaaaatataacatgttgattatgttttggaataaaggtcagattatcattggtcattacttgctagccttccggtaagtaccaagtcttacaagagtaatggatatattttcgccaagttgaggaacctccacttttctgttataatttttcttggaagtactttacttggattggtttgaagggcttcaccataactctgcttttcaggcttttaaaaatggaagtgattgttgctgactgaatttcccagggctgtatttcaccaactgcctgtaagatatggataggtttgtaggtgggagtttaaggaaggatttgtgaatctgacaaaagctgcttattgtatcctatagattcacaatgcacattaacatactttaagtgctcttagctaaaggaacctgtttaaacccatatttctcagagttaattggtatggaatccttttatggtacagtatctattaagattttgaagaacaaatattttgtgggccagttgtgggagaacaattctagtacaagataaaacttgctgtttcctcagtaactgttaaatgaccagtaaaggggaggtataaaaagttaatataaaagttatagagaattaagggaaaaatttgaggatgaaggagggacactagtaagttttttttaaaaaagagagtagatttaaaaagatgacttgtgagaagggctataaattgaaattgtggaattggatttggcacatgctacaaaattttataaaaatagaatattcactagcaaatgtgtctagaaacaaagtagaaaacacaaatatacaacattaggtgtcagaagaatacatagctataaaaacggaggagattaaaaaaatgagaaacctgtaaagtaaaactaatactaataaatttaaacatctgaatcaagctgggcacggtggctcatgcctgtaatcccagcacactgggaggccgaggtggatggatcacctgaggtgaggagttaaagaccagactggtcaacatggtgaaaacccgtctctactgaaaatacaaaaattaggtgggcatgttgtcagatgcctgcaaccccagctactcaggagactggggcaggagaatcacttgaacccgggaggtggaggttgcagtgagccgagatcgcgccattacactccagcctgggcgacagagcgagactctgtctcaaaaaaatttttttgaatcaaaatttagtaattttaatgtgcttgatgtcatatatactaacaagtggcagaactaggacttgaactaaagtcctttttgtcaacagtgtctgtaggctgacctgttgggctctattgtttccctaatgaagagataggaaacctcagggaaaaaaacttaagaagtgaaaaatgggccgggtgcggtggttcatgcctgtaattctagcactttgggaggctgaggcgggtagatcacttgagctcaggagttcgagaccagcctgggcaacatggcaaagccctgtctctactaaaaatgcaaaataaataaataaataaaaattagccaggggtggtcgtgcgcacctgtaatcccaactactgaactacgggggaggctgaggcacgaaaattgcttgaacctgggaggcagaggttgcagtgagccaagatcacgccactttactccaccctggatgacagagtaagactctgtctccaaaaaaaaaagtgaaaaatgattctcatgattgaaaaaaaaatccaaagcttagaaaaggatggaaagtagtctgattaattttgtaataaaatctgaccaagattatgtcaaagtttaatctagaccagccttaattatgactatcaataactaaatatgaaattagctaattcagcagcactacagtgaaaaatatatcataacatgtagggggttatgttaggattattgaaaatcaggtgtgaaaaattttatggtcatctcagtaaatgaggaaaataaattgatagagtatttaatcagaaaacaaacattatgctcaatggtgaaatgttagagcagtggtccccaacctttttggcaccagggaacagttttgtggaagacagtttttccacagactgtggcagggggatggtttcaggatgatattaagtgcattacgttacatcattagattctcataatgagcatggaacctaaatcttttgcatgcgcagttcacagtagggttcacgctcctttgagaatctaatgccactgctgatctgacaggaggtggagcgcagtttcgctggcttgccactcacctcctgctgtgcagcccggttcctaacaggtcagttagtaccagtctgttgaaattgtgaaccattggctaaataaacttattttcattataaattacccaatctcaggtgttctgttttagcaacactaaacaaagacgagaaaattatcactacttttaagttaaataggaaagcaaagaaacaatgggaaaactattggacctaatgagagacttctataaagtggacagaatccaaaaatataaatatgcaaaaaagtttttatttaattttgtttagaatcagggtctcactgtgttgcctgggctggagtgcagtggcaagattgtagctcactgtagcctcaaactccggagctcaatcagtcctcccacctcagcctcctgagtagctgggactacaggtgtgtgctgctgtacctggctaatttgtttgttttatttttatttttatttatttagttatttatttttagagatgagggtcttgctgtgtggcccagactggtcttgaacacctggccccaagtgatcctcctgcttcagcctcctgagtctctggaattacagacacaagtcacagtatccagccaaatatgcaaaacttagtatctactattttaaaatatgataccagcaattccaattaaaattaataaaaaaagatccaacttataataatatctaagaataaacacaatgagaaacatgtaagacctatataagaaaaacttaaatgaagctgggggcggtggcctgggcaatgtggtgaaacaccatctctacaaaaaatacaaaaattagctgggtatggtcccagctactttcagggggctgaggcgggaagatcacttgagcccaggaggaggaggttgcactgagccgagatcgtgctactgcactccagcctgagtgacagagtgagaccttgtctcaagaaaagaaaaaattgtggaatatttaggttttgattaattctttgtaagatgagtatcttttgtatatatgtttgtttgatggttttgtttgtgattgtaatattcttgactaattccaggcagaccacatacgaagaaaatattatttatatttaaactcctgcctttctatagagagtcagtttacacacaaatattacttaattcccacagttgttattatccataatgttattccttttttcaggtggagaaattgtggatttaaaagtttgtgacttgcctaataccacacagctcgttaagaagctaatacttggagcctttatctttctgttataataaattatgaataaacagctgaaatctgtattagacataagaaaggagaaccttgttctaaccagagaatttcctatcagcctttcaggcgaagaagcctctcttcttattttcttatattctcttgccagagtagaggtgatggaaaataaggtaaagatagtaaattatagagacaggagcacagagtgccctaaagttaaacaagtttgaattctgattctatcacttaactagctttggcctcaggtaaattatttaccttcttcaaccctcagttttctacttactaaaaggttttagtaatacttacctcatagtgtttaataattggtaactaatatcatcatcatcatctttcattatattaaatgagaggattcggttaggattgatgttttccataagacgcacagaaatctttgcctctcctcctgtgatcagggagaatgattttacctgctgatttatgtggtagtgaaagagcaatgaactatgatttagaaggcctaagtacaacgcccctgggttagtggaaaaaaaaaccttacacaagttactacaggttaagtatccctaatccgaaaagctccaaaattggaaactttatgaatgccaacatgacacttaaaggaaatgctcattggagtattttgaattttcagattagagaagctcagtaggtaagcttaatgcaaacattcccaaaaaaacacaaaaacacccccccaaatccaaaaaaattcaaaatctgaaatagttttggtcctaagcattttggataaggaatactcaacctgtagtacttaggtcttatattttattacctttaaaatagaaatatcctaaaaaagatccagtgaaataatagatttactgtgtagggcagtggtccccaacctctgggccatggaccagtagtggtctgtgggaaaattgtcttccatgaaaccattccctgctgtcagaaatgttggggactgctgatgtaggctatagagagggtcatatttcaaaaaacctttatttaatgcccaatattgaatagctctgtgaaagaatactgtcaatctctaagggactgaaagttacagtcttttatatactgtgattcatatttataaatataattttaactgtacacattttttatctgcatatatagcttttttatttctggtctatcaatgaaaaacaaaggtagtaagtcctttgatccttttggttgcttaaagtagaggacaaatctagcccaatgttaagaatccttaagaaaactacatagaacagaaagggtatggatttatccttataagtatggtgactagtctttaagccaaaatttgaaatacacattctgacataatatgacaatatgatttaatatttgtaatcagtattgtcctataaaatatgaaagctatcactgtaaatgtggatgatattaacaaggatagtgcttttcagatcttttattctgtgggacctgtacaagtttggagagtagttgtgtaaggaaaggacctcttttgaaagggagaaattagtatagttatggaaaatagtatggaggttcctcaaaaaattgaaaatagaactactgtgtgatccagcgatccaactactggatatatgtccaaagggaaagaaatcagtatattgaagaggtatctgcatttccatgctcagtgtaccattattcacaatagccaagatatggaattaacaacccaagtgtccattgacagatgagtgcacggagaaaatgtgatatatatgcacagtgtaatactattcagccgtaaaaaagaacaaaatcctgtcatttgcaacagcatgggtgatcctggaggacgttaagtaaaatgagtcaggcacagaaacacaaatactgcatgagctcaattatatgtggaacctaaaaaggtcacactcataaaacaaaatagaatggtgatttccagaggctggaagttgtggagatgggggagatgtcggtcaaaggttacaaaattttatttaagagaaataagttccagagatctgtttcatatcatgctgactataattaattatgtattgtatacttgaaaataactaaaagtgtagagtttaagtgctttcaccacaaaaagtgataagtatgtgagatattgcaaatgttaatcagttcattttagccattccacaatgtatacctatttcttttcttttttttttttttttaaagacagggtctccctctgtcacccaggctggagcacggtggcacaatcgcggctcactatagcctcgacctcccaggctcaagtgatcctcctgcctcagcctcctatgtagctgggactgcaagcatgcaccaatatgtctgggataatttttgtttattattattattgtctttttggtagagatggggtttcactgtgttgcccaggctggtctcgaactcctgggcttaagtgatcctcccaccttcgcctcccaaagtgctgggattataggctgagcccctgtacctggacagacgtgtacatatacatatttcaaaacatgttgtataccataaatatatacaacatttatttgttgattaaaaaatagaaaatatatcactgctataatgcctttactaatcttatttttaaaattatttaactacctaaaccttatcttttctttaaactgtaaactttttaaatgaatagacataaaactaggctgttagtatatattatcctaattaagcttcagaataattatattaatatagggatccttatcctcattttacctgtgtgtcaaagtcactttgaatggacaaagctagaatttaggcaagatttaaggattcaaaggtcttctcttgttttcctaccctgcctattagaatatattttcactccttttgcttttctaatctggcaagcattcatagggcacattaagcattcattcattcttttctatttaaattgacggatagcattgtatgtttttgtcgtttacaacatactgttttgaagtatgtgtacattgtggaatggttaaacctagctaacaaatgcattacctcacatagttatcatttttataatattcaacatttaaacgtagaactttagagagatcatttgtctttgattctatattactttgtattgagaacatgagcattactattaatgctattaattgataattattgatgctatttttattcatattagcagctactagttattacatgcatagcaacttatgccttgctcagtacacagtcttctttacaacaaaccgattaggtagatattgtgtctgttttacattgaggattagataaattatcaaacctcaagatcatgtagctgataaatggcagcattgggattcagttccaagtttgatttcattatccatatttacactgtttaagcatactctatgaccctgatgtatctttattttataaagaaattgttaatgattacttttaaattcatacttatttacatgtatcagggaaatggtctatactttgattaggaagtagactacgatttgattaagaagtattatagctccctaccccctacccaggatatgggagtttataatactcctatagtgaaaaatttcaaggaaatttcttttgtattccccaaactgaaggtttctaccaccctttttgtttcccagcagtgagagatggaattctgaattctgaaaaaaataaaaattacttaaagcatttcaaactctgttcaagaactttggaaaataaatttaaacataatcttttatgagagtgtgaatagatgctcacctatccaaaagcagtttccttttaagatcatgtgtattaaataaatgtgctgaactgtttaacctaatgtataaaaaggacttttttgtcctgcagacttaatcagagtaatgcacgtcaaaatagaatctgttcatttgctcttaattaattcttctaacctgatgttcagacaagcctgataatctattatattattaactaatctgacaaacatttaataagggccttttataagggtcaaaatagtggataagtttatgagttctataaataggcagtgtggattcaaatcctggttgtaaaactcactaccttaagcttcagtttccttatctgtagaataatgacaaccagtgatgcccagcagaacatctcttccttcttagtcagatgtcccttgggagtagttgtgcaaggttaattctttgcctggtagaagactgtggtgcattttggattatattttgtctgtgagatcttaggttggttcttcagatgttagccttctactggggcaatatttctttttctgtgtttatttgttgttattgacttctaatataattgcattgttgtcaaaagatgtggtctgcgtgattgtagttctttgatatttgttgagactttcattatggtctagttttagttaaattttataaatattcttcatatgcttgaggataatatgtattctgtaatttaaatatatattaaattagccttgataaccatcctggtcttctgtagctttattaagtaatttttttggtctgcctgaactaccaatacataaaagaaatgtattaatctcccactacaatggatttgtcaattgctctgtgttattccagtaacttttgcttcagtattttgcggctattttactagtacttacaagtttttcggaagtatcatgtatttctggaaattgaaccttttatcattataatgtgacccttcttgaaccaagtaatatattttttaaagctattttgaaggctgggtgtagtggcttatgtctgtaatcctagcacttttggatgccgagatgggagggttgcttgaggccagaagttggagaacagtctgggcaacacagcaagctcctctctaccaaaaaaaccaaaacaaaacaaaacgattttgtcttttattaatagagcagctcacaatttatgtgattcgaatggaaatgatataaacttttccattcctttaattggaaccttcctctatacttataacttagatgtcctataaatagcgtatttttccatttttaaattattcagttctattatctatgaactttaaagtttattagtacttttattatttgcaaatagtggtatatttggacttgcttttactacctttaaatgttcatcttttttatatgatgcttaaaaataccttatgttttagttttttatagaatcaaagaattgtttctgtctcttttatgccttatggttctgtaactttaattttttacgtttatatttgtatgatatagattcaatatgttgtgttcttctagtttaaaaaacttggaatttggatttgaactaaatttggcaaaaactgacacctttataatattaagccttctaactcatgaaaattttaaattgtttatgtggttctctcagtactgttttatgattttctttgtaagggtcctgtacattgttctctgatttattcctagatacttaattgtatgttcttattttatgtttgctgttatatgtagaaatataacattgtatgcagcaatcttgctgaactcctttattaatggtaataaattagtaaatgtttctttaaattcttttgaatttcttacatgcggaatgctactgttcacaaatgtcaattttatttctttcataaaaactatcttggctagcatttctaggacactgttcaacacaagttgtggtggcaggcatctttgtggtgtttcatgttctaaaagaaaaacttccatcatttagatatgattttttttaataattccctttatcaaataaggaaattctgttcctactttgagaagaggtttttctttgttttcttttttatctatttattcgtcagtggacgcttgggctacttcttccttttgactattgtgaataatgctgttatgaacatgagtgtacaaataatcttttgagtccttgctttccatttatttaaaggtatttacccacaagtgaaattggtggattgtatggtaattctattattaattttttgaggaactgccatgctgtttcccatagtggctacaccattttatatttccaccagcagtgcacaagggttccagtttcttcactttcttgccagcacattttctgtgtgtgtgtgtgtgtgtgtgtgtgtgtggtagcagtcctaatggtatgaagtagtagctgtgtttccttttaattgaaaagagatactgaattttatcaaatacttttaattcatctattatatgatttgtcttccatattttttaatgtggcaaattacattttaaaaatgttaggccaaccttaaatcctggtataaactcaactttttcataaagttttatccttaatatatcttcttgtatttgatttggtaatattttgtttacagtgttacaactgtctattaatatgtgtgatttggcctttttttctgaaatgttcttatatcagggttctgatgaactcttctccttatttttggaaaagtatatgtaagattgttgattgattgattgattgtttgagaaagggtctcattctgtcatctaggctggagtgtagtggcccaatcacggctcactgcagtctggacctccctgggctcaggtgatcctcccactgcagcctcccaagtaggtgggactcacaggcgtgcatcactgtgcccggcccagattgtaatttatttctcaactatctgatataattcccaccagcaagaaagttgtctgcaatctagttttatttgtggaacagtttgtattacagattgaatttcttcagtaattatagcactagtcaaatattatagtggtagcaggaactataattaatgtcccctctttcattcttaacattggtaattagtgcactttcttttccacccccatcagtctcaccagaaagtaatcaattttattcgtgttttctgataaactactttgactatgttgattctctatattatattaattttctatttcattgatttctgcatttgccttttattcccttctattttaaaacccttttagagatggatgctcataattaattttcattcttgctttttaatatttttgtttttgggactgtacatttctgtcttaagtactgcttttagcttgttcccacaagttttgcatgttctagtttattatgattaggttaaaatgttttcctactttctacagtattaggattatttgtcctttgggttatttcaaaatacacttcttaatttccaaacatggaaggatttcctagtatttctgttattgttacctaatatgtactgtgatcagagagcatagtatatatgatcccaattgtttgcaatttatgactcaatatatggtaaatttttaaatatattctatctgtgcttaagtatgttgtgcattgtaacgcagagttcagtgctttgtatacagtatgtccattagttcaagtttgttaataatacagataaagctgtatccttactgtgttttcttggtttgtttcttcaattattaagagagataggttttaaaaattaaactatgacaattattaattatggacttgtcatttttttttagttgtgtcaattttgcattctatgttttggggctcttgttaggtcaaaggtgaaatgatatcttcctggtcaattgaatgttttttaaaatgagttaaatatagtattattataaaatttgctttatctttaatagaggtttttatgttaaagtgtgttatctgatattaatatagctatatcagccaatttggttaatatctacattttaaaatttcaaccttctggataaaaagcatatacttgaatttttaaaatgtaattggaggatctttttaaaaaaattgtttagtctgtttatatttaatatggctggtgatgtatttgggtttaagtcttattttgggccgggtgcagtggctcacgcctgtaatcccagcactttgggaggctgaggcaggtggatcacctgaggtcaggagttcgagaccagcctggctaacatggttgaaaccccatctctactaaaaatacaaaaattagccgggtatgctgttgggcacctataatcccagttacttgggaggctgagacaagagaaccgcttgaaccccggaagcagaggttgcagggagccaagattgcaccattgcactcaagcctggacaacaagagtgaacctccattaaaaaaaaaagacttattttgtatttttatctctctgctttttaatactttttttctcttttttatcttgtttgaattaactgaggaattttttcatctttattcttttttattaatttattatttacactcacccttgacctatcactgtctaatacttggtgcttttatccctttcccataaattgaaagacctaattgaaagaccttagagtactttatatatataactgcctttatgtaactgtgtgtgtgtgtgtgtgtgtatatgtattatatatatatgctatatatgtcataagcattgtatatttctattgtctatatttaaatcccagaggacaatatatatacatatatatctcagcaagatattctacatatttatatatacacacacacacacatatatatctcagcaagatattctacatatatatatatacactttttttttcttggctttttattacatctccatacctccatttagaaacttaatcttttagtgcaggtctgctggttttaaaaaaaaaagtcatttcttttttttaggaaatatttttattttttctattctttcctttttgaagcaaatgtcttctttttcctctgactacctttaataattgtttttgtctttggtttttgaaactatgttgtaagcagttatgaatttttaaaatcttgcctggggttttaatctgtgtttggtaatttcagcatctggagcagttttgagtgtgtttttatggaagtcccccttcgagggtatgttccaagacccccagtagatacctgaaactgcaggtaatatggaacccagttgccgtcaatcagaacacgtttctgttcatcttccacccatacacttaatgccttttctctcttaactaagcacttaccacacactgtggacataatgtttgcagtttgaggtgcaacagcaagactagcagtttatttttccttcttcacaattttagggatggaatatttgttctttccatagagctgagcaacctcagcgtatgattttttcttgttattaattttcaaaaattattggaaaatatgaagaaaacatcttgcataaatgacctacattggaaccctttgctctatctctttatttcatgcaatttctaataaattttgaagggatacacttatggaggcacaggtaagtgtataatttgctgaaataagactagtgagattcagacaaataggtcatcataggaggagtagacctggactcagcgttaggaaaactagtctttaggtcaggtctccagtagttagggctaattgcagcaccagggatagctcccggtgtgttcttttttgtaatggtgttaccctaatggtagagggcattcgtcttgcgtactttaattggttaaacaaccctagcttccccgatggtaacagatttttctttttcatttggccagagcattcagttttactgtctgaggtcagaaaacaaagtgtggttattaaataatgaatctaatttataaattatgtggtagaactgactctgaaaaagaattttctaatattctgtctacttagctattatttttgtcttgagtaacttagcatggtaatactttatgcccccagccccctcaggtttccagggcactttccccacaagtttctttcttttttccatttcactctaaaacatactatcttgtaattttccactcctgtcgttttttgtgtgtggaatttttatattctgcaaggttttttttttaaacatggaagagttcttagattattcaagaaatataaatacattttatgttttataataattttagaaataaattcagatatttatgaagggtgatatttagtatgggagtgtattatatcttttgcaccctccatgtgccagtatcaaagtcccatctagaacattgaccctgtaggggatcatttctacccattgtacaatcacctcaagtctactcctgttctcatgaggttgctactttctggctgatgatactacgccacaggagcctctggatattttatgataactctcttatagtatcagttttttcttgtggtactctgctctgctttcttcctccgtcttccttttctttttcttttttattttttttttagacggagtctcgctctgtcgcccaggctggagtgcagtggtgcgatctcggctcactgcaaagctccgcctcccgggttcacgccattctcctgcctcagcctcctgagtagctgggactacaggcgcccgccaccacgcctggttaatttttttttgtattttttactagagacggggtttcactgtgttagccaggatggtctcgatctcctgacctcgtgatccgcccgccttggcctcccaaagtgctgggattataggcgtgagcccccgcgcctggcctctctgttcttttcttttcctcctatcttgtttgttcttctcttctttattttcttttctttatatccctccttttcctttacttgcctttgctccccacttcctgtctcctccatcctcttttttccaaattaaaggctcttttcctatataacactactactgcctcaataaatgaccacatcccctctcttttattcctagaaaagctgttttaaagatttgttatttgtttaaattccctggtctccgctcctgtctactgtactcgttttagatatctttctaatgtactaagaaaatagaaactgacatttagatttctttttttaaaccactttctctaccacttaaaaaatgatttatatcttaactaagtttttctccttattcagaactcagaaggaataacttctgtttactcctttttccttgataaaattcaaaaatttttaatatatattttacatatattcacttacaaatatttaaatagaatcatactgtatgatttttttctaatttttacatagtatctaaaatatttttacatgttattaagtattcttttacaccactatttttacgggccacatggacttttcttgcataaaaacttagtatagtagttccctgttggatagttaggttgtttttcttccttataagcagtgacagtttgagtttttttggtaaatctttgaaactatatgtcatctatatataaatctataacgatgtctttgaatgaatctgtgaataacatgtttattttattttattttattttattttggagatgaagtattgctctgtcgtccaggctggagtgcagtagtgcaatctcggctcactgcaacctccgcctcctgggttcaagcagttcgcctgctttagtctccagagtagctgggattacaggcacatgccaccatgcccagctaatttttgtgattttagtaaagatggggtttaccacattggccaggctggtctcgaactcctaaccttaagtgatctgcccaccttggcctcccagagtgaatactgatgtgaaccattgcgcctggccaacatgtttattttctaagtgttatttggtaggagaaagatctctgagatcaaatgatactcatgtttttaatgcttttatagagaatattgttaaattatccttcagaaccgatataacactatgtatttctactctctgtatgagtttctgtttacctaaacctttgccaaaactggatattatagtttttcaaacacatttcacattttacatctgtgtttctcgtgtgcatcaaatattactttgttttaaaaaatcatgtcattgctcattttaaaaattataatatcaatcctttttataatgatttaaagtaatttaatatacatacatacacacacaaacacatagttttctaggctattgtttatcatttagtattgtgttatactttgcctaagtttttaaattttattttatttttattatttgtttatttcttgacactgagcctcactctgtggtccaggctggagtgcagtggcgtgatctcggctcactgcaacctctgcctcctggattcaagtgattctcctgcctcagcctcctgagtagctgagattacaggtgtgcaccaccatgcccagctaatttttatatttttagtagagatgggtttcgccatgttggctaggctggtcttgaactcctgatctcaggtgatccacctgccttggcctcccaaagtgctggcattacagttgtgagccaccactcccagccgtttttaaattttaatgagataaatatcttagtctttcttggagataatgatttctcatgctaagaagagccttccttgctctttaatattataaatatattgacacattttcttcttttttaaaaattttacatttaaatttcttactcacctggaatttgcttagtatggcatgaggtaaaaaaaattaattttttttgttttgcactaatgatttatcgcagaattaattattgaaaatgctattctttcttcacgtgtatatgaaatactagctttttatatcagagaattattgattcagctcttcattttgttttaaatattgtatcttttaatatattattttttaatttgatctttttattgaaaagtcatcaagcacattcttaaaaagaaaataaataatgtaaaggatgggaaagtctctactatgaggctaactgctattatagtttctttatttcattctaaaaatatatggttcatttgcaagcatatagctaatcttctttttattacctagatagaaatacaccatatacacagttgctctgtacccttttttactatgtgtcaccaaatacagatctaactaattttctcactttttacagctatatactaatccaacttaagaatctaaaacaatagtttattattgtttgaacgtgttttttttttccagtatttttttgtcaaaaactaccgtaatattctacatccttatcctattctttgctaacatgcaatgtaggataaatttctcgaagtggaatttattgtgtcatagactgtgacaagttacaaacaatgtaaatcagtcttggctaatttcagaagagatatttacaggaaatctggaaaaccaggaattagtctctcacctcctactgccactgctttgaataacctatgtttgttcttccctaaaaattcaaaatttcaggcaggagaatccatctggacaagggtgttatctgttcatgctttagctgcctggaagtggagagtaggctttttcaagcttttaggatttatagtttaagccagactctaatgcccatcagttaagcaagttcttctaaaagtaaggtacttgaatgtgggatatcaacaaacaagcaatacagttatcatttttggttgcttaatatctatatgcaacccttcttctcatacaaacatttgaagtaaacaatataagagctcttcaacgtagtaaattgtaatggttctacttatacctgtaaatactttattcattctctaaggggagacaacccaaaggctcataagttacttcttccatccagctttaaatccagaaactcttagtgttttcctctagaaatctcttttcttcagactgtaattatattcttataattacatataagtataattatatacttataattaagtgaaaaattgaggtactctccctaatatattaacctgggtattaaaataaaaatatacaagaagtaagtttttaataaagtgaaataaattctatttaaaattttattttaaccacataaaaagcttttataattttttaaaaaagtattttattattcttattgtttgtctctccccatgagactgttagcctcatggggatagcaatatgtgtctgctttgtttacacagtattctgagcatatgaaacaatgtctggcacatagtaagtgcttaataagtatttgttgaatgaattgtagtaggctttaaatcactttaatagtttgtcatgcattgattggaaggtttgtttttagattcagtttattttgatacttgcttttcctcagtggaagaacaatacatggatgaacatggaacaaatgcatcattatgtacacttaataaatcatgatcccttattttaaaatcccatctgtcagtggtgcacattttttttgttgaaatttatttattttcatcttgcccatcaatttttcttgcaaaatttgggtcagtgtaatatgtaaatctgttatatctttacaaagtagaaataatgcaactataaaggaagaagtaaagaggaaaatacaataaacctttgttgttataaaagcaatagttgggagtcaaaagatactactgaaagttgacatgccagatgacaaaataagagaatgggttaaggcattgcaaatgtgtaagtaccaaggtaatcaatataacaaaaacacagattttactaaataccaaaagatatagaaaacaaaatgaaagaacaaagcaacacattacataaattaccccatcatgactttagctaaaacccataaatttagttttattttcttttttttccccttcagacaaggtctcagtttgttgcccagcctggagtgtggtagcgcaatgatggatcactgcatcttctacttcccaggctcaagtgattctcccaccttagccctccgagtagctgggacaacaggtatgtgccaccacacctagccaatttttaaattttatgtagagatgggggtctcactatgttggccaggcagtctcgaactcctgggatcatgcagttcacccacctcagcttcccaaagtgatgggattacaggtgtgagcctctgtgcccagaaaatttaattttcgtactgaaaatagactcatagatagttaacaaaaaatataagtaataataaaattaaatagatacaataacgtggcagagtaaaccaaaaatggaataaaaacagaaacaagtgaattagtagttcaaatactataccatttatctgaagacacaaagaactgtaaaattcatattaaattctaggtttgtttactttaggattgagcaaatgtgcaattttattgagaataacatgagccagatttctcagtactggagaaaaaagtttaaaatatgaaaagagataactgtgatgttgaattgatattagagatgttgctatgattttatccttttagagataaagaaatttataaacgtgtgcatgcatttgtttatatttcttagttttgtataatggaaggtcctagaaataaagatacctctttaagcattgagcacacctagtgtccagataattggtttctaaataccattcatcactgaaaagcagtgtttattggggagaaagagggattctagggctgaagcagggaaaatacgagataagcctggaatatcttattgtgctataaatataaagtaagaaactgctaaaaaaaatgataaggacacatcaaaagtacataggagccagcttgaaagggatcccagtggccaaatctgggacactgtctaaaggatacagatgccaaatctaggataacttgagcatttgactgaataacgataggaatgtaatacccatgaagtaagaggagactctctgaatccatggtagtataaataatgagtaaataaacgagagaggatggaaagtactcacagtcgaatgccaactaataaatgttgaaggaataatggagttagaaaaattactttctcacgcctgtaatcccagcgctttgggaggctgaggtgggcggatcacgaggtcaggagatcgagaccatcctggctaacatggtgaaacctcatctctactaaaaatacaaaaaattagccacgcgcggtggtaggcgcccgtagtcgcagctacttggtaggctgaggcaggagaatggcgtgaacccgggaggtggagtttgcagtgagccgagatagcgccactgcagtccggcctgggcaaaagagtgagactccgtctcaaaaaaagaaaaaaaaaaaaagtaaaaaaagaaaaattactttcacagtgacttagtcgagaatcaatggatgctaaaactagcaggtacaaggttgaaaaggaacaggatatttagacttaaagtgtttttctgtaaattagtaatttctaaaaggaaaaggataacttcatagtgtgataacctagcaatcccaaccttaacaacaaagtaatcaaagtaaaagcgccaactgtgagacaaatagacatgatgtgcctcttaatatatacactagggtaacaattcacatctgtagtattccttcaaaaaatacattctctgtgtctaatttaattattaagacatatcaaataaacccgaattgcaggacattctgcaaaatcgccaccctatactcttgaaagatgtcaaggtcatgaaaaacaaggagaaaccacttgtttttaagtggttcacacacaaaaaatgtgtgtattggggggtgggggacagagagagagagaaagaatgagaataggataaggtaaatgaagcaacatataaacaattggtgtatctggatctggatgaaggataaatgaattctttgaatattgttgtaactttaaagtatgaatctgtatcagtataaaagttgtttttaaagggttcaagcctacagaaacttaagggaggtttttaaattatttggaaaatccttttttctggctcagtgtagatataagagttttgtttttcgtttggctcccccacccccacccacccccgagacgacagggtctctctctgttgccaaggctggagtgcagtggcacaatcacagctcactgcatcctcaaccttccgggcttaagtgatcctcttacctcatccttcccagtagctaggactacaggcgtgcaccaccactcttggctaattttttattttttgtagagttggagtctcactatggttgcccaggctggtctcaaaactcttgggctcaggtgatcctcacacccggcctcccaaagtgttggaattataggcatgaaccactgtgcctgccaaagagttttaatatgtgacatttgcacagtattttcagtcacaaaggcacatggtagagagaaaatactttttaaaaaacaccctttaaaaaatgttccatattgcgtgaatttcttttaaaagtaattactttctatttattgttagaatttcacctttattgtaacgggtagattgtctttattgccttgttttctaaattatctgctaggtaagatattgctcatcatctaatgttatcacaggaaagttagtaaagttgggcttttgagaagtaaggcatataactcttctcaagattggcatcacttataaataagcttcaagagtacttacaccaccaagaaacactgtgtggtaaagaaaaaaaaattttttttcgtgagtcaattcattatgtgatcataaaagtcacaaagtaaattttgctgtatgtctaaaaccttgtttactacattgaaatcatcttgtaacacttttggcattgccgactttcaacttctttgccacgttcgtctgcctgtgaatgacataataaatgattttcacatgtctaatcttaccccgtaatcttcccttcttttccccttcctttttccttttcttttcccgctatcctctcccctcattttcttttcttttccaattaaagcacctgcttattcattgtggctttaagtagaattaacatgtttttctgaaagtctttttttctaaaaaaaaattatttgcttatgagaacatatcttccatgttagagctttcctttaatgactcactaaaaagtagttctttgtgaattttgtttttgaaagagaatctagtaaataccataagctcagacatgttagaaacatctgtacttgaattcagctatatagaaacctcccacacagtgtaatttgctctaatccttgtttcttcaactcttcagtagtgttttcttatcattttccaacagtattttttttgccatatcttccatgtattaatttagccacttttatcatgagaaaatgaaaacatttgtcttcagtgatacagaagttagcttctgaaatgactggtaaatatttatcagtatccttgcttgaaataatatttcattttaaactttaacaaagtacttcaaattctggatacttagttgtaagcatattgcaaagcatcacgtaacaaaaagtacagcattaacctaggacaaggttaatcattgtgggggcatgtaaatttatagtttagatcttcttttggtaatatagaaatcttttggcctacttctttcatatcttattgcattttcattgtttttattgcatagtatggttgacaataggttcaggtgagaagcgtctactctgccactttattgtttagttttgtttgcattattcaaactggtttctttggaggaatctattaaatttagttgtcctttttgtgagagatggtttaattaaagttagataatacatctttaagttgacttaacctagacacacgcagacattagtaaatagaaaataacgaatgagtaaaggttccacttgtcaaaagctaacaaatgagtgacggttcctctcttatgcattccactttgtctgaagtaggatgagtaacatatggagtgcctgatatatgaagagagggagagaggagacagtgtcaatgcataaattaaatgtctttccctattggagtatcttatgtgtgtgccccactttgaaggacatttcttctacagaagcaagtactgttgtggctgaagttggcttgtgaagtcctgagaaggcctgtactggaaaaaggagttacattggaaattctctgaattgcacaacaaaggagtcataggagagatccaaaagtagaagtattctgagattcttcattaattaaattttttttccagcaaagcatgcggcttcattttattaaattccctttggcatcctttgtttacataatgtcatttttctttgatctacagatgagtttaattgttatgaaattttcaatattgaactatcactggacttccacaataaaatcttatagtcttgggttgtggtggttgtgtttaatgagtaaattagtttttctagtgtgtgcgtgtgtgtgcgtgtgtgtgtgtgtgtgtgtctgtatgtagtcttttttttaactgcaacttttatgaagtttatcagggttttactggattacgattttcagcatagcttccaatctttttctatagttggaaacattttacatagcaatggaaatgtctgttcttggaaagtttgaaataattgactactggttttttgatgttaaaaaaatttttaaattgtgaaatatatcatgcacacacaaaaaagcttaatacatcatctaaacccccacctccaaaaaatttaaccttactaatacctttgaagcctctgtagaatggcagactttagcttgtcctctaggtgataatcattatgttgcttttctttgtcacttactacatacttgtctgttgctacaaatatattcgattttttgcatgcttatgatcttcatataagtggaattataatgtattcttctgaaatgattttcttttacttaccattttgttgttgatggctgtttgtatgggtccatttcagtttgttaatttttactgccatatagtattttattgcctcaatatgccacagtatttttatctatgctttcctttatggatgtttgtgttgtttccagttggttttattttagggtgtatgcctcagagtggatttgctgcatgataggatagtctttattttctccttttttctgtatatttatatttgctgtcatttttatttccctatggtgattttgaaagtaatgatcctgactttaatttttgtgttaggcacttgaaaaaaattagaaaacagctgataacctatttaccttaatattaactgtgagaataaaccttttgttcagtcttcctatacaagtaacatacagagtagagctttaattcttactagttttcttctcccatttatgtggaaaagttcttgaaaattcagatgaggagtattgttttcaaattattttaatagttttatatctttatattcttaattaccaatcacaattgctttctcttgtgtatatataatggttattattgagactaatatctgagtttactttctgtacctattattagtcatctgtattgctacctaaccattccgacattttaaaaaattttccagctttattgaggtacaattgactaataaaattgtatgattttaaggtgtacaacatgatggtttggtatacatgttttgtgaaatgattaccacagttaagttagtttaacacatctatcaccttacctagttaccctttttgttttgtggtgagaacatctaagcaaatttcaaataaagtatataattcagtattgttacctaaaatccccatcctgtatattagatcttctgaacttattcatattgtagctgaatgtttgtacccattgaccagcatctccctttttcccctaccactttcccccttggtaatcaccattctgttctgtgtttctaaccatttcttaattttgtttcatctatcagactgtttgtttgtttgtttttgtctagagagccatgtggctttattctttctgagtctgcatatctgaaaatgaatttctgttgtcttaggtgagaaacataattgggtaggaaactcctgtgaaataacctttcttctcaaactctgttcattatcttctggcaattaatttttggagagaaatcagagcctgattcaaatgttctgtgtaattttttttttttggtgggggcgagatggtggttctggatagttctaagaatcttctctatttttgaagcttaaatctttgatcaagatgtatctgagtatttttcaattttctttacattttgcctggtgacccatgtacccggacaccctagccccagggaactttttgatgtttacatcctttcatgcctttcagttaaagacattcttctattacatcaatgattattgcttctgtttcatttattccggtctctcctataggactactggttttaaaattttttctgtgtttgagcttttatttatcatacatatctttcatttttgtccaccacttatttccattagtttatttcctttccatatagaacagtttctcaggcttactttgtacattaccgatgtgatctacattgtcaaatttactctttaatgctctctcatatctctctgtttttctctctcttttggaaatcctggaagagaaactttattatttttatggtttccaagctactgtactggatttttttgcctagtgttttcatcttgaagttatcacatcagtgtaggtccctgtcaccggatgacaccagtcattccgtgctggtgcttctcatagttgcttcacatccccttggtctttggactcattttgacaaagaagttacaagttgaagtttataaaggaccttgctttcttggaaaaccaactatttcaacccaactttcaataaatcttttaaaaaatagttgttactctctgggtccccttttgaaacacaccatcactttctgtagctcctcaggagctaagggaaatccaaattgaacttgcctttttaagtgtttgggcctaggatccaccagaccatattactttctcaagatgtgttttgtaagttggccttgtgaatccttgaagttgctttaaatgtatcagaatttatgaaagtttttaactgagaaattatgctaatacctctttatttttctctctaaagtttattgtaattggatttaaagggagaagtgaatatgagtccttgccctatcatctttttttgtaacatttcaaaaggttttgttaatatggaagtgtttctgtcatacagagttaattttttttccttgatccaagaatagtcaagagttttcttgattggtagtggtggtggttattgtttcagtttataagtattctaccaaaatatttacagatgaggttatatgatatctgagaattgctttaaaaaaatctgagagagatttggttgtcaagatgggtaactgtggttgtgataaaacaagattgaccataaattgatatctattgatagatactattgtgctagtctttatagttttgcctatgggtttggaatttcacataagaaaaaattagttctaattttacaagaatttgatttcttctaagaaaaaaatttcttgaattgcattgtggttagaaaatgtgccctatataacatataatcttaaatttattgtagttttctgtgtgaattgatacatgatcagttttaaaatttccattaagattctaaaaggaagtcattatgtgtccaataccatcttggtgatgatattcaagtcttctgtaacctaatttatttctttgtctacttaatctgtcagatattgtaagagatacattaaatttccccaaagtcactgtaatagtgctgatattatttgatgctgttttgaatgaactctttttcccccattatattggtcacatttaagctttctggattacaatatttcactagttttgagttaaatatgtaatgtactaggcagattactataggagctcagcaaatatttgtttgaataatatgttaactgttcaaagttatgtcatcgatttttgaggagaaagatgtgcagtctagcatttgtagtttaatgggtgaacacagtagatctgttgatatgtaaactcaaggtcatgttagggaattaaatcagaacacttgcactttgaaatgtaactttgtgttttagctgtgttctctggtttgttaatactttttagtttttagaagtataactgaaaaaccaaacaaactgaccttgtgcttatttattgagagggtgccaaaatctttttgcatctcagttggaaatatttaataatggcagtgagaacaagtactggtcttcaagccagggaaataaaaatttcaaaatcataacagcctaaatcataaatttctggggattggaattgtgcaaagaatctgtttggaagaatactgttagactattacaagggaccagaaatgatgtatttttaaaacctaatgaaactttgaattatatggggttttatatatataatatatatggtttattatgagtatatagtgttgtcagttcactccacatctcttacgttccattttgggtgttctgggagggacgagttcctgtttatagcctttctttactaacaatgttgctttctctcccggccgttattaaaaatgtgtgtttgcgtgcgtgtgtgtgtgtgtgtgtgtgtgtatgtgtgtgtgtgtgtgttgagacgaagttttgccctatcgtccaggcagctggagtgcagtggcacaatcttggctcactgtaacctcggcctcccagattcaaacaattcttgtacttcagccacctgagtagctgggattacaggcgtgcgccaccacatccagctaatttttgtatttcttagtagagatggcgttttgctgtgttggccatgctggcctcgaactcttggcctcaagagatactcccacctcacctcccaaagtgctgggattacaggcgtgagccactgcacccaccctaaaaaacacgtaaattttaaatctactgtactaaatgataacaacttatgaagagcatcctaaacctgttatttaatggtcttcattgttattttgattagataacaattattttataaagattatttatctgtagtctgttttaaccattccacaatgagttcaaacaattctaaaagattgtactatgtaaaatacctttatgaatactattatatccaagtgattttgtgtgacatatattatccttcatttgcagtaaagatgccacataaattttgagcacctgtttttccagtgtactttttatgtctacatttatatatatttttctttctgtgatacctgctttagcaatttaaaaagaatgagcttgattcatttacctacttaagtttgttgtgggtttatgctagagaatgactgccccttcttaatcatctttttgttctgttttgtgttcttagactgtaaattctgtctgcaagggacatactcagagtcaggttgaaatgtgtacacttgcctaccattttcaatgctcaaggattatatctgtgtatatgtctctgcttcagtatgttttatctacaaccataaagaaaaatattggattcattatctatcaagctacctgctaggaaagagtttcttgctcaaattaggcttatgtggggaacttggaagtaatggaaagggacagtttaattcttttccaggttcaaggatgtgaattattgtgtcttgtaaagctggaaggggaaaatgaggaatgataatgatttttcatgtcattagtttttatatttataaaattatagcttccattcatccctctttgaaatttaaggtttggtactaaaaataatacttccaggatactcttacatgttcattgatacccacctcccttacctcagctgtcttaaaaaagcagagggtaggtagctgccaagcttttaagtagctccaaatggactaagcacctgcctagatcaggaatggtagaaggattgatctgtaaaataatcacatgtagaacttttctttggtaaatgtaagtcattatatatcaatcagtttaacttcttatctgtgaagcatagtaacagctatgttagaatagtgttgtgtttgacatggtttcgaccagttgtttccctgttttaaaatcacatcttacttggaaatcttactataaactggtagatgatgaggtattatgaatttgaaaattcaatcctagttaatattaagattgattatactcagtaatggtgatacagtggggggatacactgtcttataaattggtcaaaatgtattaggcatagtacttttggattgcagtttggctatattgatgtttaaaatgatcatacctttctaatatcaagagaaaatattcaaacaagtgtacagattaagtttattaccaaaaaacaaaactgaaaataccctaaatgtattgctagagaactatttaaatttataatgtatcaataggatcaaatgctatacaaaagaatgttacaaaagaatgaggtagtgcagtatgtattggtatatttagacctctaaaatatattattaaataaagatattctcagaaaatatactcaggtttgcacatgaacctgttgttattgctgataagtgaatttgtagaggtcaagggttacagaatcttctaattttcatattgtttttataatgaccatgtataatttttacaaataaataaaggtactattcatctacatgtagttgtcatctgatattccctatttttatattgttatttgaatagtggtatggtcttttctgaaaatataaaaatacttttagaaccattgcattgaggccgggcgcggtggctcatgcctgtaatcccagcactttgggaggccgaggtgggtgggtcacgaggtcaggaaattgagaccatcctagctaacacggtgaaaccccgtctctacaaaaaatacaaaaaattagccgggtgtggtggcagtcgcctgtagtcccagctacctgggaggctgaggcaggagaatggcgtgatccctggaggcggagcttgcagtgagctgagatcgcaccactgcactccagcctgggcgacagagcgagactctgtctcaaaaaaaaaaaaaagaaccattgcattgagtttatctgcggtttatcttactctaaactggagttactgttctaatataagaggtttatggtatttttattaatttttttagattattgtttagaaaaggaaaacaaatatgtggtgagagttaaaaataagatataaatctatttttaaatgtttgctgtgctgtttttctgtttcagttacctagaaaagtacgagaaagttcatcattttggggaggatgatgatgaggtaccaccaggcaatccaaagccacagcttcctattggtgcaattccatcttcctacaattaccagcaacacagtgtgtcgggtaaatatcactgcaaattaacaggatatatgtccgcagttttgaattaggaaaatagacatcatccaatgagttagtcccttcctttgcacatgagaacacttaaggccttaaggtaatgcagctttcaaagattgacatctaattggtatcagagccctttctctcacaggttacttgagaattttagttgcaggaatttttagttataaaacactttcacttccaagtaatgatttttccttattgctctaactaatgatcagtttatcctaaatagtcactaaaataagaagaggaagatcctgttaggattcaggagaccaagaattttcttatagagtctattagattttctaacattaatgggatttccagcatcagaattctcagaaatgtttctgattattctattttcctgccatggtagcaggaagatttttttttcacttgtcatgcttgtaatggttatagaggaatccacagcttgaaaaaaatcaagttggaaaaaaatcagcgcgagtgttgatactctcttgagtggagtagacgggctccagttttcagtggctctggaggtcaggactgtgatgactaggaagagaggtctaaggagatacacatctttgtttttccactcactaacatttggcctaaaaaaaaaaagagatacttgtttttcaagctatgttctttataaaaattataattattctaaatatttattatcattattattatttactggtactagttctgtactcttacaggttatccttagatttatactgtctcatttgtggactatcatcagtatcatcaacttttttttcgtattatctattttcaaagtttcttaaaagttgaatttgacttcatatttcttccctaatcagtaatgactgaagaaatagaatcttcttttagaatctgcgatctccattagaagaggcttcatctgatgcttttgtataattggggtaggggtgaagcagggagtgccaacaaaacctagctttgtttttaatgaatagtttttactgcaagaaccaagagtaaaggagaatattttaagtcacctttagaaatgcttgctaatagtttatgctgataagataaaatggggtgacttgttaggtgatgtgctccttgtttctaaaaagagctaatgaccattatctaattcaaggatgttaaaaaagatactcctacatcgaatgagatgttgtgctaatgacctttaaagatcattttcaacttacaactctgtgtgatccctgtattacaataatagcagagctattaatccttgtaacttaaacagactttggtgtccgctactactgttcccaaacaaacacttttctatgtttggtcttgtttaaaatagatttttttcctgaatctgttttttcccattttctattgatctgctttgagaaagatcatgtgaaatatttttggtatttcggaagcctataatgaaagttactgatagagctacacaggttaaaggagtgatagaattgcttaacctgttgttaaaacaacccttttctgatatgctattatatgtgtgatttgttttaagagaatctgaacagttacattttatgtgtaacatgtgtaatgaagtcaggattggagattcatgaagaggaagaaactgggaactgatggggaacatcagattacagaatatctagttcatactgaaaaggggtagaatttcagggcagcatttatactttatgtttttctagaaagagccatagcaacatcatgacagtattctaaaaattgacatgattatcaatatataaagcaaataagtcattaatttttcttttaatgtgttattaaggaaaatagaataagctccgtgtgtgtgtgcgtgcatgtgttctaaaaaaaaaaaaaaaaccaccaaaatgaaattatctaatattagattgagagtatttaaagaaatttacttagaactttgagaagatatgtatttacatatttgatcatacagccttattccccttgtagctttgaataaatgtatttatccagagatacttttattgttgacattaagaaaagctgttctaaaatattttgaatggtagtataataaatttcagtggtcagtagtgctagaatatagaacatcgtacactgatagaatgtgggcctgaatttgcctttgaggatattgactacttttggccaataactttaagtggcaaaaaaaaatattgtgggttttgttgctttaagctttaagattcttcaacattggcatcaagtacatggtggtttttatcattcatttgcataggttttcatactgtttttgacattacatacctaatacttcagtttccttctttctctgtttttttccttggtattgattggatataatcatttctgcagaattattaggtggattattattattatgatgatttaatccaactcaatcattttaataaagtgaagccaagtacccggtccatttgcatttttggtacttaaattttcggtttcaagaaggaagatataaaaattttttattagctatatttgagtaaagattttctttaagcattgcatattctaacaagacatttggactacaacaatcactgccaatatagatggatagaatatattgtagaatttctacagtgtacataaacagcactccaggaacaactctccctttcttctaaattgaaaacaaagagaagtgactgcctcagattaaatttgtcagtagtgacccacttgtataaattttgaatcaagaatgttgaaaatatggacgggcgcggtgtctcacacctgtaattccagcactttgagagaccaaggctggtggatcacctgaggtcaggagtttgagaccagcctggccaacatggtgaaaccctgtttctactaaaaatacaaaaattggccaggtgtggtgtcgcatgcctgtaatcccagctactcaggaggctgaggcaggagaattgcttgaacccaggaggcggaggttatagtgagccgaaatccacagcactccagtagcctaggcgacagagcaaaactccatctcaaaaaaataataaacttccctcctcattccagttataaaattatagctactcaaccatatctccttgagggaatgaaaggaggatcttaaaattttataagcattttctcctacataattatcttaggaatctttaccaaggaatttttaattcgccaaatgattataataaattggtgctttcactgttatctgaactcccaaatgaagcagactttgctgttaatgtatgcagtctcctgtcaaatgaaagcaagcacatcatgcaacttgaaaatgatcctaaaatcatcactttactactaaatgtttaaatataattaaaggatatttcataattgttatgtttatcttactctaattgaagatgtctttgacagagtcattctggtaaggatgtattgaatggaatatctgtcattttacagtaggaaatagcacaattctaagatcatattgaaaacataaactttaggactgcgacagataaggaatacgggttccacatttttttctattcagatttacctgaaagctatgtggaatataaaaatgtaaattaattattgctaagacttggcttatcatcagtccagtttacagtgtagaatataaaaatctgctcctatattcatagaagtttcattactttttctccagatatttattttatgttacttatgagaaatttcatttataaggattatcaaaaatgaacaatatattcttattgtcaagctttaaatattgtaaacaatctgtgtcatagccattaaaaactgtgttgtggaatttcttcattatgttggagacactgctagaataggttagaattgaagaggtgtatctcttcaactgtctgcatttggaaatgaaattctttacttacatgatattcttctgtggtatgttgtgacagtagatttctacttgcatcctacttaaagagattgtgtgtgtgtgtgtgtgtgtgtttttaacttttaaaaatattcagatatttccgaaatattcttttgttattgttgttaagagacaggtctcacttcgtcgctcaggctggagtgcagtgacttaaccaaagctcactggaaactggacctcctgggctcaagcaatcctcccagctcagccttccaaacagctaggattacagcacacaccaccacaactagctaaatgttaaatttttggtagagacagcatctcattatattgcacaggctggtcttgaactcctggcctcatgtgatcttccttcctcagcctcccaaagtgttgggattataggcatgagccaccatgcccagcctgaaatattcttgaatgtttaaattttagttttttgccttttcccttaaacttgtgacagctttatttgaaaaaatgtacttgtgatatttgtctcaggacatagttgccaaggtctaaactgccccgttaggattcagttatttctaaaaatacaacattttttatatatgtgaattatgattatatagtatcttagtgttctgtaagcccgttttatcccatcttcaaagttttgtaaatgttttaaattaattctcctgtggaaaatcttagttgctttggtttaggcacaaaagcatgaaccataaaagtaaatatttgtaactcagacttcatcaaaattaaaatttctgtttaaagacacttaagaaaatgaaaagataagccactaacagggagaaaatatgtgcaaagcaaatatgaaacaaaggactcatttagagtatttagaactgacagtattaagtgctggccaggatggagagcaataggaactctttatattgctgatggaaatgcaagatgttacagccactttggaaaacagtttcacagtttgttacaaagttaaggatacacttatgtgtgactcagcaatcccacttctaggtatttatgccagagaaatgaaaaaaatatgtcccgacaaaatcctgtctatgtttctagcgagatttattagtactcaccaataattggaaacaatctaaacgtccctcaactagggaatggataaacaaactgtgtttagaaaggtatggactactgatgcacttatcaacatggatatgaatctcaagagcattttgctaaataaaagaaaccagacaacaaaagactatattgtgtgattccacttatttggcattttgaaataaaatgataggaaagtaaatttgatttgtagtacctagtggtaggggatggaattgagcatgagaaactttttgtagtgatagagatactctatatcttgactgtgatgattaaaactatacatctgtcaaaacttagaattgtagaactaaaattagcatgggttttactatgttaatgatattgcagtaatttggaagaagtccattgaaatgcaatagtaagaagtgtagattagtctgggcacagggctcatgcatgtaatgcagcactttgggaggccgcagccggagaattgcataaactcggtagattgagacaccagcccgggcaacatagggagacctctctctactaaaaataaaattagttgagcatagtggagccttcctgtagtcctagctactcaggaggctgaggtgggaggatcacttgagcttgggagattgaggctgcagtgagctatgaaagcgacattgcactccatcctgggcaacagagccagacatgtctcagaaaataaaaaaagtgcagctaggtcaattaaaatactgattcaaaaatattttggcaatgatggccaaatggtatgtacattttggtattttaataccttttcaagaatgtaattttaattagtaaacctaagaagttttaaaagttgaacgttttgaacctctaatcagtttatattttatatatatatatatttatattatattttatatatattatatatatatatttaaagctgtgttctgtattcaagggatattcaccataaaggtatctgatctttgatatacttaaggtattttttttctttgttagattatctgcgtcaaagttatgggctgtccatggactttaattcgccaaatgattataataaattggtgctttcactgttatctggactcccaaatgaagtggactttgctattaacgtatgcactctcctatcaaatgaaagcaagcacgtcatgcaacttgaaaaagatcctaaaatcatcactttactacttgctaatgccggggtgtttgacgacagtaagttttaagctgaatgtattatataattcttctgtaaaagttttttttttaaggtttttaaggagaaagtactttttgtttgtcaacataatagcattctttattttctgtttttatattatgcattatttaagataatgaatgtttggggggttttaaccttaaatatttgaatagtaattttgtctcagtgtttttgaagtaaaagtcctggtttttaagttggagtaatatatagatttcctgagttgagacgattgcttgctacaagattttgacaaagaaaactaggatctggaagaaattgttttctgaagtctattactgctaatgtgtggctataatttttaactaaaacattttaggtcaatgcatttgaaaatttgtcttctaaatcatcaacgtaaggcttatcaaaggcttcatatcatttttacttgtagggtttgctagttgtgggttttgataaatcaaattcttcatctcttctgaaattacctattaaggctagattatcacacagagcaaattactcagttttctcttgcagtttaataaagatttagaaataatattttgaaatctttccctgctcagtttttcttttgtaaaatatctgtgttagctgaagttattggtataaagttatttcttgctttccgactctccccaactccaaccccattttttgccagaagtatatcctattcaagaataaggtattgacatacatcaaaagtattttatcttttaggaaattatatatatagcacagtagcagagtctttgagagaacttgttataacattttatgactttttgtttttatctttagtgagatgtttgcaaaagaatttatttctctgcaatttgatttgggtcaagtagtgttttatttgggattatttaggtaggattctttgaaatttggcacatattttatattgaaaatgattttgaaattaaataaaagtaaaaattagtttcttaacttgcccaaaactattcttgattacatggatggggatgtgggaagaaagatggttagttctcagtttctgtcataactttgaagatataaatttgatggcttttcacatcacttttatattctttgatttccgttattctattttgatcttccaaatacaactttcagcatttattgtagaatggagttgaaaattgtttcacattttttagaaaccttaaaatgaagcctttgaaaagaatgtatattttcaaaccagaataattttaagtcttaacatttaatctttgaataggattacatgtaaataatttaagttgggtatatgatagaagtaatcttaccagtttgggtgctctaagacaagaccttgtttagacctaatttatcttcatgcattcttcaggcattttgtttgtttaaaagactaaattattgtgtagtataataatgcaaaaccgcattaatttagcaagtgccatttgggtatagtttctatcatttgaagtcacagaaagtttagttccacagtacatagggactttatgaagaccttatatttaaaacaatagttttatatgacaaaaataattcctttggagtttgaaggttgtagacatattttatttggttagactttgagaggcttcaatttgatttttagggcatgagattttaattgagagagaaatatagatgccacttcttttagaaagtagaatatttacatattttgtgtgtttgaagaagtataataaaaattctatgtgacaagaaatttcatttttcaattttatatttctgccctatattgttttcccagggatgttatttgcttggtgggttttttgtttgtttttttgggttttttttttttaagagacagaaccttgctctgtcccctaggctggaatgcagtgatgcagtcttggctcactgcaacctccgcctccaaggttcaagtgagtctcgtgccttagcctcccaagtagctaggactacgagtgagcaccaccacacctggctaatttttatatttttagtagagacagggtttcctcatgttggccaggccaatctcaaactcctgtcctcaagtgatctgcccgcctcggcctcccagagtgctgggattacaggtgtgagccaccatgcccggcccctagggaagttttttataaggatttttcaggacaaagaaaactttgtctgtctttagtggtgtgtgggcttcattttgctggttaagctgctacttatgtataaatttgatattttatgaaatgctttttgaggtcactgtagttaatttgtttattcaaaacatttacatctgttctttatattatttcctcacgaccctaaggtcagtagtaaaatcattagtaaatataatttatgtttaaaatgttgctgtttctcacccttttaaatattttgtaagatgaaaattcttattctagccagagtactttacaaactttattttactcaattttaactaaatattaggttcatacttaaaaggtaataagactgccaagagtccataaatctcttatgagagaaaacatacccacttgttatgcttgtcataacacgtccaataaggaagcttaagattttgtttttttaaagattaacgttcataacagctagtttttctgttaacagttgtcattatataattttcttttggtttctaaaagcagtaactttcattacggagctaatgtgatagttgataaaggattcacttaatttttaaggggaaaaatacattgtatcacagcttagacatttgaatcatactgctttatagtctgatcccatattgacaattcgagctagcagcatgaaggagaaaaaataacacaggatgtacttatctatgtgccttaagttttttggtggggaagtgagggccacatgtggatgagagacagagcgttattaagaagaagcttacgaaaacagatggtttgacttttcaaaagtcataaagttgttgataaagcaactttatcgagaaacacaagcgtgatgtaggcctcagaattttccttaaaggagatttatgggaattgtgggaattatttccatggagtgccttgctctctatgttttttgaagtgtgaattatgcaagtatttctgaaattaatatgaagattttaaatgataacctggaaatttaatagcaataacctcagtttgcttttttaagatttttcttctgtataaatgaaagccagtgtggagtaactcttaagtactcttcacttctttattatctgtataattattatgaaaaagagtctatattattaatttgtaggaacacaaattttctttaaatctaaaaacaatgtatttcaaaagaaattatcatgactatcatttactataaaataatttttagtacacaagatatattaagatgtagttttgttgtttttccaagcctattattaaataattaattgaaagaatttattgcattttattgaatgtactatttatttatttgttttttagctttaggatccttttccactgtatttggagaagaatggaaagagaagactgatagagacttcgttaaggtaaatcattttaattaaaatgttgattcattgagttacatgcagctaagccaacaatagatcagtggttgcttatttaatatacataatactacctatacttttatctttacctaatacatatgccatacacaacgattttaaagttgtgattgagttgagtgaaaaatcttttagaatacccacgaacagacataaaattttcattgatttctgtgaatagtaacaacaatagcagtaaacaattgaatgaccctcttctcaactgggattctgagaatgggtttcaggaagttttcgtttttatgtgtgttctgaaactatgcaattcagaaaggaatgaagggccagacctgccatcaaatcctcaaaaagaataggtgtaaaagattagtaagtgtccatctagaggaaaatttctgggaatatatttctgaaacaaaatatagttgtgaatttcaagtgagaaactacaaaaagacttgaacaaattgttttctcacttaacacttgtctaactttgctggctttcaaggaaatataggatgcttcttttatttactctccaagggtacattttatagtattactattaatagaacattattgtttaaacaccttttctttaaaactcatgagatacattcaagtatgattactcttcattcttgctgcaacttcagctaaaatttctaaatctatccactttgtttcttaaaagtagctctcttgggctgggtgtggtgtctcacacctgtaatcccagcaccttaggaggctgaggtgggaaaatcgcttgaagctaggagttcaagacaagcctgagcaacaaagcaagaccccatccctacaaaaaaaagtatatattttttacttcattatacaaaaatattaaagaattagctgggcgtggttgtgtgcgcctgtagtcccagctactagggaggttgaggtgggaggattgcttgcttgagcctgggaatttgaggctgcagtgagctataattgtgccactgcactctagtctgggtgacagagcaagacctgtctctaaaatcaaccgataaatcaataaaaataaataaaaaataaaatgatagcatggtgttttagggaactactttattttttattttcatttatttaatggtgtttgattaatcacttaaatattaaaaatcagttgtaaaaattttgatattgtccagacaaaatagactaagtcacagaacaaaaagagacaaaaaaggtaattatataatgaaacaagggatcaatacagcaaaaggatgtatgtaacaatcatatatgcactcaacactggaggccccagatgtataaagcaaatattagtagagctaaaaagagaccccaatacaattatagttcgggactttactcactttcagcattggacagatcatctagatagaaaatcagtaaagaaacatcagacttaatctgcactatagaccaaatggacctaatagacatttatagactattttatccaacaactgtagaatatacattcttctcatcagcacatggaacagtctctgggatagaccatatcgtatgccacaatacaatctcaacaaatgtttaaaaattgaaatagtatcaagtgtcttcttatatcgcaatggaataaaagtagaaatcaataataagaggaactttggaaactgtacagatgttaatacaagaaaattaacgtgctcctgaatgactattgggcatcaaggaagaagttaagaaggaaatttaaaatggaaacacaatatgccaaaacccattggatacagcagaagcagtcctaagagggaagcttatagcaatatatgcctacatcaaaaaagtagaaagatttcaaataaacaacctaatgatacaccttaaggaactagaaaagcaaaccaaaccaaacccaaaattagtagaggaaagaaattctaaagatcagaccagaactaattgaaatggagacgaaaaagacaaaggatcaacaaaacaaaaagttgttttttgataagataaacaaaattgagaaaccactagctagaatagctaagaaaaaagagagaagactcaaataaagtcagaaacataaaaggagacattacagctgatactacagaaatataaaggatcattagagactatgctgaaatattatgctaatgaattggaaaacctagaaaaaatggataaatacttggacacatacaacccatcaagattgaaccaggaagtaatggcctcaccagaccaataaagagtaacaagattgaatcagtaataaaaagtttctcaatgaagaaaagcccaggaccggatggcttatggctgaattcttccaaacttataaagaagaaccaacaccagttcttctctaactattccaaaaatctgaaggggagagaactctccttaactcattctttgaggccaatactactctgataccaaaaccaggcaagtacacaacagaaaaagaaaactggaggtcagtatctgtgacgaacatagatgcaaaagtcctcaacaaaatgctagcaaaccaaatccaacaacatatcaaaaagacagtgcaccatcattaagctggatttatcccagggatgtaaggatgcaaatcaataaatgtgatacatcacatcaacagaatgaaggacaaaaatatgatcatctcagttgtagatttgtcatacgtggcttttattgttttgaggtatgtttcttctatgcctaatttcttgaaaatttttatcaagaagaaatgttaaattttatcaaatgctttttttgcatcttttgagataatcatcataccaaataggggaaaaactgaaagcttttccttgaaaaactgaaataagatgaggacactcacttgcaccactctcattcaacattgtattggaagtcctagccaaaggaatcaagcaagagaaaggaataaaacttcagtaaagttgcaggatacatttcttaaaaaaaagacttacaaatggccaaaatatatatgaaaaattgctcaacatcactaatcatcaggaaaatgtaaatgagaaccacaatgagatatcatctcaccccagttagaatggctgttgtcagaaaggcagcaaaataacaaatgctggtaataatgtggataaaagggaactcatacactgttgatgggaaagtaagtaatatagccattatggaaaacggtatcccactactgggtatttatccaaaggagaggaaatagtatatcaaaggaatacctgtgccgtcaatgtgcattgcagcattattcacaatagccaagatatgaaattgactgaagtatccagtaacaggtgaatgaataaagttatatatatacatatatatatatatatgtatatataaaatgaaatactattcagccctaaaaggaatgaaaatgtgctatttttgtagcaatgtggttggaactggaggtcattatgttcaatgaaaacctaggcacagagtgagaaatatttcatgttctcactcgtatgtgggagccaaacttgttgatattttggaggtagagtagattggtggttaccagaggctaggaagggtcagagggtgatgtacaaagagaggttggttaatgagtacaaatacctagttagaaagaataaataataaattctagtgttttataggacagtagcatgactatagttatcaatagtttatatttcaaaatagtaagaagagaagatttgaaatgctcccaacacaaagaaatgataaatatatgaggtgatgcatatcccaaataccattatttgattattacacattgtatgcatgtattaaaatatcacaggtaccccataagtacatacagttgttatatgtccataaaatttgttattgagctatcttgcaaatttgtattaaaagggagtcattttaggaaatggtaactgttaagtagatttttctagtggcattttagcttttctttattgctagtctttaggtttaactaacaaaaactgctaatgataagcttcaactaatcaaaaactttattctttagcagtctattttaagtattataaattgtctttaatgcatcaagacttacttgacaattttagaggacaagttaggaggattggttgagcccaagagttcaagactagcctgggcaatataatgagacctcgtctctacaaagaaaaaaaataattagttgggcatcgtggtgcatgattgtagttccagctacttgggaggctgaggcagaaggattgcttgagctctggagttagacactgtagtgagctatgattgtaccactgcactccaccatgagtaacagagtgagaccctgtctttaaggggaaaaaaaaaagactttctggaaactttcatgtagatcagtatgatttattgaattttttgtagattttagatgtttaaatagttagaaaatccttacaggcttggtttctaacgtatattcccactagggcatttttcttttataatggaactttttctttacctaagaagagataaaattaaagagttatagttaggcatttagcatcaatggcttatataaaaataattttatattaagtattagttgtcatgtagatttgtttttctatcataaacatatttttacttgaattaaaagttaatatagactatatattaaacactttacgtagttctctttatcatttttctgtttacacagtttttttacaaaacagttccactgtaaagtatttcaacaaataggaacctataatgtctcttcagagatgtatacatgaattttattttaacgagctggtaatatttgaattaatagttaaatagtgggaaaagagagagagagagaaatgttttcctggttttacagaggttagtctttattttttatttatttatttttctttgagacagtcttactcttatcacccaggctagagtccagtggtgccattgtagttcattgcaatgtcctcggcccaagggatcctcctgcctcaggctcccaagtagctaagattacagactcctgccaccatgcttggctaacttattttttatttttttgtagagatagagtcttgatatgttcctcaaggtagtctcaaactcctgttctcaagcagtcctcctgcctcggcctcccagagtgctgggattataagcatgaaccaccctgtctgctcccttatagaagtaattgatgcatgctgtggaaaagctagaatttacagcaaagggcagatattaaaaccattattaatcacacccattcagaaataaacaccattaatatccttatatacatctatcgagtcttttctatgcatattatttaaagcaaaagttttattcagaatttaatttgtaacctgttcttttcacttattacaatgttagattttcttctcatccttaatgtttagtattttaatggctacttcattcatattacacatttcataattcatgtaaataatccatattttcagaaatttagattgtttccatttcttcttattatcaacctacctgggatgtacgtactcacatccaggcccacaagtataaaaaacgttttttcttaagttaactccaagacaaatttgcaagtcaaagagtatactagatccttcacaagaagtataccatcttaactgaattttgtggtaaagttacacttttcatattgttatccagaattaagtttgtagcccaaaatagctaggcctattgctacataaaatattgtataattagttaaaatgtttatgacatttatctgataatatctgataagaattatcggattaatagctttaagtcaccttatttcagagaaaaaaatacttgaactaatttatttggtaaaatattttgtacattaattcatttatttaaaaaatatttactattttctgtgtgccaatacttttccagacactgggaaaacaaggtctcccctctcagcaaatttccattctatgataggaaaacagacaataaaagtaaacaatgttatttgaggcttttgcaagtattgtgaagaaaataaagcaagacaatgtgatagagagttataagacatgtgagtgtatggtaacgttagataatatgaccagaaaggcttccctcaggaggtaatatctgatgatttttagtaggtttgaatgataataggtgaccagcactgcagaggaagagtctttctgacagagggaatagcaaatgcaaatgttctgaggtaagaacaaatttagtttgaggtatagaaagtatgcttatgtgcaggaccatggtaaacaaaaggaaaagtagtagcagacaaatgtgcctgtttcagctgtgaatatgcagttaacagaaaattttaattaatgacaaaagatatgttaatcgtattattatatgtattaaaactaagcttcaggatgcattgactttgtaatttaatatattatcttttttggactcctataagtactttttaaattataacacatacttagtgtatatgtataacacatacataagtatacacctcaagatgtgtttataaagtgaatacactcatgtaatcgttacccagatgaagaattagaacattatcaacacctctgaagtacgcctattcattccccctttcagtcacttcttcattcactcccttatctgttaacctttcttccttattctacttctctttttttcttttgttcaacatcatgtttgtgaaagtttcatgcatatcgttgcaagtatttgtatttcattcatttctattgttgtataatgttacattgcatgaatatgcagcaatttgttctactgtaaaaagcaataaggatttagttatttccaggttggacacaaataattttgctatgaagggttttatatatgcattttggtaaatatatgcatgcatttttgttgggtaattgacctaggagtgttaattgctaggtcatagggtatgcatatctgtattcagctttggtagatactaccaaacatgtttcaaagcagttgtacagttttaccttctcagcagtagtatgtcggttccagttcctcgttgttgacagtatttggtattgtcagtctctttcattttaactattacagtgagtgtgcattgttactgtagcttggttttaatttacattttttcttgtttgatgagaactagaatacctttggcaattttgatagcttcttttaggcagtgcctatattttgtccatttttaaataattatctttttgatttgtaagagttttttttctatattttggataaaatttctttttaagatgttggaaatattttctctctagcttgccttttcattcttgaatggtgtcttttgatgaacttacataacttaattttaatgtagtttaacatcaatttttctggaagttggccattttttagttctagttacaaaattttgccaaccatgaggtcaaaaacagaatgtgtttttttctgttttacttttcacacttagatctataatttttattgtgtttttgtgtatgtggtataagccaggagtaaagatttggtttttttccctcatatggatacccacttgaacctacaatatttgttttaaaaactgtgttgcagtatcaccattgtcataaatccaccaatcatatatgtatagatctttttctagattctttttcattggtttatttgccccgttagggcttgaaagtaccagatttttagtcaagaaactgaaattcttcctactacatttcagtaaaaatttgtgttttctaattagagaaaatatttattttcctatttttatgtgtagctcattgctaaaaatgttatttttgtttttatacctctatgcaatttaaaaccccagaaagcagatcttttaatcttatttttctgtcctcattctttcttgtgtatttcatctcccttctgagtatgtgtttttttcacagtataacacatctttaactagatctttcaatgaagatattttattgataaaattctgagttttataattgtccttatttttgtccatgttccatttatagattgtagattataagttatatttttattgtattattgtcattctgttgttttttgcgttttcttctaggttatcttgtctttatttttgtccatgttccatttatagattgtagattataagttatatttttcttgtattattgtcattctattgttttctgccttttcttctaggttatctttcttcttcttttttttttttttttaatcaatttctgaccttctcttaattctgagcagcattctgggtaatttccttaggcttgttccttaatcattttcagctgtgcctaatatgctgcttgacttatttgttaaatttctattttagtgatcatgttttaatttctagaaattctctccatcctattttagatttgcccttttgatcttcttttttatgtttttaataattttgaagatttttaaaaatcttttaataaattaatttgaattatataaatatatagaaacaaaatatataaatatataatatgtaaattaaaaattaaatacacttgattgttctaatatctaaagctgttgtgactaattttacttattccatggtggaatattcccttctgttttataatattggttacaaatttcagcagaccagtttttgtagggtttttgtacagattggattgaaagttcattcttccactactctattgcaattgccaatcatctacagagaaatactggttcagaatgactgtattaatttcttcattgattttcgggtaactcgagtagttactaaaaccaaatcaatggagattggggagtaggccagtggtacaaaatttggggcattatttttaacccaaaactacggtagagacagtcaagcccttttgcctccttttctttgaaggtattagatcttcaaagttttcaccatgatacagagctgcattcctaattccccacttcataaactgacccagggtcctatattctgtcctcactacactgcatcaagagcgaaaccatttggttatagaattatatacttttttttttaactccagaaaattagtgatgaaagtgtaaattgcacaaagtgtttaaataaatacccagtcacaatggggagtggcagttatcagtataatcactaatcacatgaaatcaagaaaacacaaatggctgggcacggtggctcacgcctataatcccaacactttgactttgggaagctcaggtgggcagatcatttgaggtcaggagtttgagaccagcctggccaacatggcaaaagcccatctctactaaaaatacaaaaaaattagctgggcattttggcgggcacctgcaatcccagctactcaggaggctgaggcaggagaatcacttgagcccaggaggcagaggttgcagtgagccgagatcatgccactagtgacagaacgagactctgtcaaaaaaaaaaaaaaaggcattagaagaaaacacaaatataattgaggaagattagatgtttcctgctgttgtatgtgttttcattaatttctgcttttcatatatctttctattgctgcactttttctaacttgttaggaattagagctggtgcttacacgattgattgttgtttttatttttttaatatgtacattctaatacatacaattaagaccacaaaattacctctaagcacagcttaactttattctaccaatttgatatgtcatgcgttcattacaactgagtatcttctcatttccactgtgatttcctctacgtgggttatttatttaagtttttaattgttatggatatgtagtaggttcatatatttagggatacaggagatattttgaaataggtatacagtgtttaatgatcacatcagggtaaatggggtattcttcacctcaaacatcatttctttgtgctataaacattccacttatacatttttagttatttttaaacatactataaattattgtagtcactctgttttgctatcagatactaaatcttattcattctgtccagctatatttttgtacctattaaccattcctactttgccccagcctctggtaaccatcattctactctccatctccatgagttcagttcagttgttctacaatttcctgagatgtgaatgttgaaatcatcaactgtaattatgaatgtttatatatcctttcagttctgtcagtttttaccttacgtcttttgaacctctgttgttagttgcatacacatttacagttgatatattttcatgatgaattaacttttaaaaaacattatgtatgaaacttagctacagctttcttattatgttgtcataatatatttttcccatctttatagtttttttctgtgtttttatacatagcgtttctttagataccatatagttagcacttattttcctcctccccacagtctgccttttctgtgatttctgcctttaagtcagtgcattaagcccatttacactttaggaaattaatgatgtagttgagtttaggctctcaacttttatttatctaaaaattttattttgccttcatgtttcaaggatatttttgatgcatataaaactgtaggttttagggttttgtctgagcactttaaagatagcattcttattgacaagaagtcaacttttttcttattgctcttgtatatgtattgtagactctcactacttttaatatgttctctttattactgatatttaatttggttatgatatgccttgcagtttcattgcttattttacttggggttcatttagtttcttggatctgtggtttggtatcttacgtaaaatttggagagtttttcacaatcacttcttccaatatttttctttcccctcttgttttttttgttttgtttgttttagagacagggtcttgcttcgctacccaggctggagtgcagtggtacaattatagctcactgcaaccttgaacacgtgagttcaagcaatcctcctgcctcagcctcccaagtagctgggactataggcatccaccaccacacccagacccctcttcttttcctggtactacatttacagtctggtctctgaatccatgggttctgcatccatagatttaaccaatcacagattgaaaatatttggggaaaaaagcaatttaaaaaacagtaaaaagtaataaaactaaaaaattaaaagaagacagtgcaacaactatttacttcacgttacactgtattaggtatactgtatttaaagtacacaggaggatgtttgtaggttatatgcaaatactatactgctataccattttatatgaggaacttgagcatgtggaaaatttgatatctttggagagtcctagaaccagtccccacagatactgagggatgactgaatatgtatattagatcatgggggtgttccacaggtcactgaagctcttttcagtatttttagaccttttttgttttctgtgtacttaattgtggatattttctattgttatgcattcatcttttctagttaagcaaatcttgtatattttctttatttgcagatacagatggtccccaagttatgataaacttagtttttttgactttactatggttttattgggggtattaaatgcattacgatgttttagacttactatgggtttattgggacataaccccatcataagtcaaggaacatctgtattacattttccagctcaagaaattttatttgattgtcctatattatccatttatttgctaattatgttcatatttttatatcactgaacatacttaatagttttttaatgtcattgttaattttcttgttatctttgttatttcactatcttatttttcttgaaactgatttttgtcttggttatgggtcctcatttctttgtaggtgtggtaattttttattagatgtgagtgttgtgtgagtgtgacattgttgagtgtctgaactttggcatttttccagaatgttgaactttgttttagcaggctgttagttcatatatggattatcagagtagggttgttttaaagctttatgacatatgtagattagcctttactctagggcttgtttattccttctacttaggtatgacattttgggaatttctcctgaaagagctaggtgtatatgagttttctctattctaggaattgtttaattacagcctcttataattgttctctccagttttttgactagcattgtggagtttgagcatacatctgtgtaacttaatacttagcaatgaactcaaagtatatgtatgtagattcatggagctctttctctgcataactcttcccttattgaaaatttgctctcatattctagcctccttagctttgctgtgctctgttcagtgttttcagcttagcaatcactatgatatcttgggtttctcttccttatgctttagtctagaattaatgtccaaataaaaataccagtcaatcattggaataacctcatttgtttctcttgttcagtgattacagtcttgcattaccttttttccaatctctgaaaacagttttttcatacatgttgggttttggtaggatgactactccagtaccatactccatatggcctaaataaatagtcacttgaaagtatttttctaaattttaaatttaccttttttttttttctaccccatgactttttgaaagtgttttaatttggcttaaccacagttacctttatcatttattcttccttagattgtagataatgagcttttctgttttttatttgtcagaaaatgtttttatgtcactttcattcttgaggaacagtttcactatttaaaaaattctatgttggcaggctgggtacagtggctcacgcctgtaatcccatgtaatcccagcactttgggaggccgagatgggcggatcacctgaggttaggacttcacgaccagcctgaccaacatggtgaaaccccatctctcctaaaagtacaaaaattagttgggcatggtggcacgcacctataatcccagctacttgggaggttgaggcagaatcgcttgaacctgggaggcaaaggttgcagtgagctgagatcacgccattgcactctagcctgggtgatagagcgagattccgtctcaatgaaaagaaatacgttggcagatattttcttccatcattttgaaaatatcccattgtgatttttctctttgttcttcaggagttttatgatgacgtttccacagcttttttctttttttatctttcttggagtttgtagtgcttctgaaatatataggttaacatttttcagttattttagaataattttctgcccttacattgtcacatattctgtctgcccattctttctcttcttcaggaactccaattatttgtatgttagaacttttcactgtgtgccttatgtctcatacactttttttctcttcatccttttgtctctttatacttcaaacttatttacttgccctctcttcttgctcataaattcactcttgggttgtatctaatcagttcttaaacatatccactgaattcttaattttagttatgtttttcagttgtagaatttctttttagttctttcatatagttttaattcctttgccaaaatttttagttttttatttctttgaacttactattcattgtcattttaagttttgtgtctgatatctttaatatctgaattcttgtggcccttctttcttggttattgaacattgtcttttaaaaaaatgtgcctacttcttttttattgctaccaaacattgtttgtcatagattttttgtgcaatggatttctttgatgatcacatgaagccagtaagcctttttccaactaatggttttaaatgcctaagaactttgattccaaaaaaaaaacccagttgttttgaaatatacacataatgtcacagatactgctaatattactatagttcattgcttaatattcagagttgaagaaattctaaagaaatgtcagatttccaggccgggcgctgtggctcatgcctgtaatcccagcactttgggaggcagaggcaggcggatcacaaggtcaagagattgagaccatcctggccaacatggtgaaaccccatctctactaaaaatacaaaaattagttgggcgtggtggcgcgtgcctataattccagctactcgggaggctgaggtaggggaatcacttgaacccgggaggtggaggttgcagtgagccgagatggtgccattgcactccagcctgggtgaaaagagcgaaactccatctcaaaaaaaaaaacaaaaacaaaaaagaaatgtcaaatttccagtagtgtttaatgtacatagagatgtcatttttcccccatccaagttcacagatttctgatttctttcacagtccctttagtcgtctgtggccctcaggttaaaaagccctaaacataaaaagatgcctttttatataagtatctgaaactatagacaatcaaatatttacatcaaagaattaattccctagaatgtagcaatatccacatgaactaaaaataagtagaaacattattttcatattgtgtgactattttttaaaacttatttttaaatttaattttgagatggggtctcactcttccgcccaggctggagtgcagtggcacaatcacagctccctgcagccttcaattccaggcctcaagtgatcctcctgcctcagcctcccaagtagctgggacttcaggcacatgccaccactcctggctaatgttttaaattttctagtttgtagagatggggtgtctctttgctgcccaggcaggtctcaaactcccagctgcaagtaatcctcccatcttggcctcttaaagtgctgggattacaggcatgagccaccatacctagcctgtgtgtgactatttctaaagcaatagaatagttgtttcaaatcatggagaattaaataatttatcattacagttttggaaagacatcgttgatgataatgaagttcgtgacctcatttctgacagaaacaagtctcatggtaagttagtgaaagcaaaatttttcaaaacctttgaagtattaataaatgaaatattaagtgaaatatgtattttctattgtagaaggtacatcaggagaatggatttgggagtctttatttcatccacctcgaaagctgggcattaacgatattgaaggacagcgggtacttcagattgcagtgattttgagaaatctttcctttgaggagggcaatgttaagctcttggcagctaatcgtacctgtcttcgtttcctattactttctgcacatagtcattttatttctttaaggcaattaggccttgacacattaggaaatattgcagctgaggtaagcatgtgactgtaccttaaactagtttttatagttagcaacatttatgttacaattttaggatgtggcattttatagttgccatatttatagactattaaatgcttacatgtattagttgctaaaaatggtgatgtagaagtatcacatacttttatggaaaaaagtatttgaaatgatgctttaaattcagaaatggctatttttacaataacattttttaacgttatgcaacattgtcctgtttattttttatttttattaaatttgaagtatacaactctggaagaagcatagctcaataatagtgttgtttctttttccagcttttactggaccctgttgatttcaaaactactcatctgatgtttcatactgttacaaaatgtctaatgtcaagggatagatttttaaagatgagaggtgagttttcactgaagtatttactttctaaagtaaacaaactatcatttcttagtaatacatatttgtatgtttttcaggcatggaaattttgggaaatctttgcaaagcagaagataatggtgttttaatttgtgaatatgtggatcaggattcctacagagagatcatttgtcatctcactttacctgatgtgctgcttgtaatctcaacactcgaggtgctatacatgctcacggaaatgggagatgttgcttgcacaaaaattgcaaaagtagaaaagagcataggtaagactggaccaaaaaacacttattttctttattgagtaaaagtgtttaatatggtactgtacaaaaccctcaatttatatttgaggtttagtgttttattttgaagagtcattacctcctcaggcatacttgtttccattattctttattatgctttaaattcagtgatggctatttttacaataattacattctttaacgttatgcaacattgtcttgtttattttttatttttattaaatttgaaatatacaactctggaagaagcgtagctcaatgagcaagaagcatctataatttagaaaccaggattacatggctatcagtaattcctatttcttctcttaatttctgttgttacgtattaaatttgaaatggacaaaactgctatatctaacttatctgagagcaggtctttctgtttcatatggccagctactactgttaaacaattaaagctaagtgaaatatgtttccttctgttcctagaagttgctggtagtgctgcaatctttaaaaatcattgaagtcacctccataagagctatcagttttaaatatacttactaacacatgccatgttaacgttttacttggtgattaaaatgatatctttcttaggtataataaatattaaaatcagagttaataaagattcagcttgaaaactgttcttattgagaagttaatgtgtcacttttcatatcagtgattcttaaatctggctacacatcagaatcacttgagaatcttttcaagtatatagatatccactgctgggcatggtggctcacacctgtaatcccagcactttgggaggccaaggcaggaaaatcacctgagcacagttcaagattaccctgggcaacatagtgagatctcatctgtacgaaaaataaataaaattaaccagatgtagtggtgcatgcctgtagttcccagctgcttgggaggctgatgtgggaggatcacttgagcctgggaggttgaggctgcagtgagctgtgatcgtgccagcactccagcctgggtgacagaacaagatcctttctcaaaaaaaaatatatagatagatagatagatatagatatagatatccagctcccactccagagctattaaatcagtcttcagagattgagcctaaaaatgttttgtttttttttttttttgagacagaatctcactctgtcgcccaggctggagtgcagtggcctgatcttggctcactgcaagctccgcctcctgggttcatgccattctcctgcctcagccttccgagtagctgggactacaggcaccatgcccggctaattttttttttttgtatttttagtagagatggggcttcaccatgttagccaggatgatctcaatctcctgatctcatgatccgcccgcctccgcctcccaaagtgctgggattacaggtgtgagccgccacgcccagcctaaaaatctttttttttaaagatgcacaggtaattctgatgtactgtgattcatggactagcatttattcacattgataagtattctgtacaacatgtgttcaccagtgatggcattcatttataatattattgactaataactattgctttttatttattttagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccaggttagtgttttcacatattctttttcagtgtggttacgagtgtataagatttgatcctaagaataaatttcaatgtgcagtatagagaactgatattttacagtatagtaggccaaagtggaatttggatatgtactctaatttcttagatattatacattccaggagtagcaggatcaaggtgagctcataggaagaatagtataataggaaaattaagttcggcaggatttagagtaatgtgatgaattagatattcataattacgatagctataagtgccccaataggcatattatttgtgattttggtcatgggaaattgacatgccaggaatagattattcatatattaccttatgattttctcaggtgatcatcaggacgcgtaagtataatacttctaatgtccttaagtgttggaaccaacaccacagaatcaacagcctaggagaagacacatgcacatatgtatacacacacttacaagcatgtatacctgcatttatgcacctttcctagtgtctcttagctcaattctgtttagctcaactgtaattatagtacagacatgtctaataaccagacttcagtccttgaactccttccactggctcattatgagtcatcattttttatattttaccacccttaacctttttttggagtgctttctctaccttggtttatactaaaaatacatatttcatctcacctacccttccatttcctatcctctcacctcctgctgtccccaagacacttaatctttctttatattttttgaatggaggatgctcgtgttctcaattgatcttaattctcactttgcaattaatacagaggctgtgtagaatgaatttcttcaattttttactccttcagttacaaacttattagcatctggactcattttcctttagcttctgctcatttcagaaagagatgctaatttcttctgaaacttactctgaatatcagtctttcccatctccatgttcccatatcttaaatctctttttatttactcactttttcctttcagctagaaatgcgtttaggtctcttatcctccctcgctagccccaaaccaaaaatttcattatccttaatctttagccatcacatccattcatcagatcttgttgagtcttcctaaatacctggccttttcaattgccaatgcttatgaatgagattgaactctcatcatctctagctatctgttctcacgttcattcatggtcccaatttgtcttctactccaacttgtagtatgaaaattatgtactctatgcaaagtatgtaataagtatcacatatttcattgatttccattatgtccttctgaagtgtatagatttgtgtcatatgttcactcaactaacttggatccacctaacaaaagtggacaaataacagaaggcacaaaatagataattttgactgccagtctattcaatgagctttcaactacaggtaatagatgttaaacagccgatttatattggggaatctttggtcagaatattaatggtttctcaaccttgagaaagaaatgaaactgttcatattgctagttaagtgggaggtgggaatgttttttaccatcaaagaagaaactaaagattaaattaattgagggacataaaggagcagtgttagagaaattgataaaatgtcagtgaatactcaagggtgatttgatgaagactattttttgctgcatggttagcctttgaccttcacagttcttttgacctcagcaaatgaacctacttctcaatctaaaatttggtcctcatttggcaaatgaatgaatttaaacattgagaatttgtggcttattcatttatgtagtaattaattcattcatagagatgggactagactgctcaggattgaaaagagttaattttcagctggagagcactttattacttgtgctctccctgaatgacaactttaaattgtttgattggttatcctttgtggtttagctattgcctgcatagtttaatgctgctttttttggaattaccatctttaaactttttgctcacttccctcaatccctctgaaaacttttataaccttttacccatttttaggttaacatctaaatctctatcataatttaaatagttgcaaagtatgtattgtcttgatgtatattaaactacatttttaaaagaaaataattacagtgctttttgtatgcagtggaatcttgataccatcattcattttttaaaatacacaaactctttaacatcagaaattttataatattcctctttcaccttgaacttgtattccagtatcctcacaagagttttatcctaatataatacattttatgtttgagattcttttttattcatcaccctgtcaatactttttagttacaaaatagacatttttaaagtttttcaattccttgttattctttaaagctctaaattttaaaaatttcatttggccaggcactgtggcttacacctataatcccagcactttgggaggctgaggcagaaggatcactggaggccaggagtttgagaccagcctggcaacatagtgagattccatctctacaaaatcaggaaaaaaattagctgagcatggtgatgcatgcgtgtagtcccagcttgggcccagggagtcaaaggctgtagtgagctatgaatgtgtcactggatccaccttaggcagtagagcaagaacctggtctatctcaaaaaaaaaaaaaaatacgtatatgtatatacatatatacacatacacacacatatgtgtgtgtatatatatacacacatgtatatgtatatatatacacacatgtatatgtatatatgtgtatatatacacacacatatataaaacacacatacatatattttatcattacaggttttattaataaatggtacatcaaatagtaaatacattgtaaatttttataaataattattaaacaaggccgggcacagtggctcatgcctataatcccagcactttgggaggccaaggcgggcagatcttgaggtcaagagattgagaccatcctggccaacatggtgaaaccccatctctactaaaaatacaaaaattatctgggcatgatggtgtgcgcctgtagtcccagctactcaggaggctgaggcaggagaattgcttgaaccagggaggcagaggttgcagtgagccgagatcatgccactgcactccagcttggtgacagaccaagactccatctcaaaaaaaaaaaaaattattaaacaaaaatttacttgaaatgtatctcttaataagatgaataggactctcccctctaattctctagatgctattaattcagtatatctctcaatgactattacttactgctagaatgaaactggaatttagcatcagtagtatccctgtttccctttttatagatgtaaattgaaaaatctagtttgcattattaaatagatgaagatagaatttacagttctttgaacttcagaattatccaaaaagtattaaacttattttttacaatcatctgaaaacttgagttctcctttgttttgttgaaatcaaagaattagcaagtacctgactgcaagaatatttgtggctcagtcattagaggccttttttttttaagtttctggaaaatatatcaaaaagatattaacaagatatgagtataaattatacttgttactgttttacttaggtatcttgtgtaacctgatatattcaagaagttttagcacagtggttctcaaaccttaggtacatcagaatcatgtgatagacttattaaagatttctgggctacattccctgagtttctggatcaggtgggacctgagatgttttcttctttttttttttttttctaaagacagcgtctcactcttgcccaggctggagtgctatctcagctcactgcaacttctaccacctgggctcaagactatcctcccacctcagcctcctgagtaactgggactacaggtggccaccaccacacccagctaatttttgtatttttttaatagagatgagatttcaccatgttgcccaggctggtcacagaattttcatttttatcaagttctcatgagatgcagatgctgcagtccagggactgtatttttaggattactgggttgggaaaattgaaatattgttcatttcaagaccgttacaatgtatttgatgtttaggtgctttttatcatatacttcaaatatatttttgtgaaaaccttgacactgcagatttacctcagttgatttttcggaaaatgtctgccacgtaacctagtaaagatagtttttattaacaaaagtctcttgcttaatcaggctctttttgttacttagaaaaagtccaatgttgtttttcaattcaagaaagtatgttagtatgttagtgtgacgcgttctttccttcagaattttaacagttgaatttgccatgagttcgtaatctgaatgaaataaaataccaccaccttctatactttttctttctttctctctttcttttttttgagaaagggtctcactcggtcacccagactgcagtgcaggggcgccatcagaacctggctcactgtagtgttgagctcgggagctcaatcgatccccctacctcaggctcctgagtagttggtactacaagtacatgccaccaagtctggctaaggacggggtttcactatgttgcccaggcagtctcaaactcctgggatcaagcaattcacccacttcggcctcccaaagtgctggaattacaggcatgagccaccatgcctggcccacctttgatatttctttaaaatattttctgtactttgtttacacaggattctgcctaagaagtaatgcattctttgacagtagttaaggaggcaagggcattaagcagaattatcattactctacaatttatctgaatttagaacaaaccaaggggccagaatacccaatttctaatgcccaactttgccctcaattgtaatatgtaaaatactggtattgacaggaagctataccaataataccttggttaagaggcttcatggatactaatgtttctaattctctctttagtgttccacgttacactataacaataataatagtagctagcgtttatatagtgcttactttgtgctaggcattattttaagtgacttgcacataatctaatccttatagcaacatacgaggttagtgtactgttactttcctccattgtatggacagagttattttgctcatagttacacagctagctagtgagtgatggaattctctggctctggatttatgcatttaaccataatgcataatcctgcagagctatcaaagatgggtgagaattaagtcatttgattccaaaatgagagaaaaaattatcaaagaggaggtgatattctcatgcaaagcagttttaggaagaatacataagaaagttgagtatctggaaattgattcaaagtataagcaccttcatttagaatgtcttcaggtatcctgagggcagtgctcctcagtttgtggctactttttatagtaattatgtttccagtttaaattcccatttgtgattttattcctctttctacattgtttataaagacttctcatgatttcaacgtaatttctagtgtttcatgaaattgattgctaattcattcaggaaatttcagtctaagtagggtatgctctttcatagtagagatgataaagggaggaagatttctacacagtttcaggccctagaaagtattttctgtattaatatcgtcaacttagaaggggaagaaaagataagctaggattgccaacaggaaaaattatttttgttctaactgttgcattatctcaaggagcatataatagtatggcctctaaaatgtgacagacctggattcaaatccaacacttttaaaagaagtccttccaagtatacccagctctgctatctccaccgtgttcctggctgaacttaatctctgagctttagttttctgatctgtaaaataggtataattaaacttagacttaaaagattaaaatatataatgtaaatataaatggatttatacagagtatatgtttattaaatggctacaattagctgttacctcaaagaaagcatggggcattcatcaaaggttatgattgcctcagatcattcacacatttggctgtactatggagcttgcctagttccaataattttaaaatgcatttgttctgtttgagggttctgagaagctttgctaaaatatcatctgaaaaaaattgtgtataatctgtgtgcttaaaaactacattgccgtgtcacatagcaagttttctaaaaacctacaaagtaatgctgatcaatagtgaaaaaaggataattaatttttatttacaaatatatgattcagacttataatttataatatgactttatacttttcatgttttccttagttcctttgtataacataggggagaagaaaaggtaacatacatcatttttctacagatctcttcaacatgttagaaaataataggtgatttactcatttattcattgaccttgaaacttttagaatatgtcatagatgcaactttagaaagtatgtgtcttaagattaatagctagtacatttgtatacaaccaggttgcctctttcaggaaaaaagtataattcaaatttattattacaacagatatcttctttttttcttccccagaaaaattatggaaatccttttttgaatatgggactttaaattagttcagcttttgttcactgtattccaaaaattttatatatgccacttacagagttattaatcttttaaattagggagtgaagccataatttcagctgcgttctgcttccgtagctaaacggaaagatgctcaacttacgtgttgaactgtatgaccctgggccagttttttaaatcactttgagtctcagttttcttatctgtacctacctcacagaagaattaagtaagcagatattgtaaagtatttagttcagtgtcttgcccatgggaataacagaggttatattaactaaatcatccatattaattgttattattttaatgattgtgaggttaaacaaaatagttcatatgaatcctctaagacagtgcctggtatgatatgtgctccattatatattaggtttgttctcaaatgtgtatactttcatatgtttatacaccttttaaaaaggtattcattgtgttaatgggttcaatatccataaaaaaaagtatggcaaatagtgactaacttttaagaaatgatgtagctaatgtatttttttctttagcttccagagcagttgtagcgcagcatgttgctccacctccaggaatagtggaaatagatagtgagaagtttgcttgtcagtggtaagtggtttatttctattaaggatttatccttgggaggagtaaagcaaagaaaaaaaggaaatgtattctacagacatccagaatgttttgttctgtattcctttttagttagagtagaatatcatttacacaaagaaaggacactttaaaatccccttgtatattggaataatttgaaagaaaaatattcatcagaattttcagaattaaaatagtatgactagaatgtcattaaattacaccatttaacttttttcagagtaaaatttgtgttaaaaagttatctttcactttgtagaaagtacagtttgtcaggttacaaaatttgttcttctaaaattaacattttgttaaaactgaattggactgaccttaagaaaataaaagcaggtgttttaaaatgtctcttctcttccatctaaaacaaaacttcttattctttaataatttttgggtttgtaatagtagacggacattaatcaaatgatagaacagaaataagcagcttgacaataatatttccttgaaaagattgtgtagtcctatctgcaccactttctgaaaaaaagcaaatgaagagttttaaaaatttcacttgttatggatagttgcctcaacattagtatgaagttcggcttaaattctttagaagattaacagattgaattacacaatcactttccaatgatatatcactttaaaaatttcttgatcacttttctgccattcactaacattatttgtctcccatttcatgctcctgtcactctttgttccgtatttttggtgctttcaatacatttttgttcctatgacagttttctccagacttttctactttgcttaaatcgggtttatggttttaaatatctctaattgtttgctttttcctcaccttctatatttttacacattggccccttacacttgaatcttttccagtaatatttggaaatgttgtttgtcttctacattgcaaccaaaatgaagtttttatatctagtctttttgaaatttcagtacagacaggattatgaaagttggaaagaatacacaccataaccactataaaatgtgtatgtgttaagcatagatttggtcttataaatcccagttgcacgtttctgctatttcttggagagggggaagagaatcattttacagttttttttttaaatcataattactatttgatttagtttttcagaaaaactaagtttagcctattatacatagtgagttatggaaagagcctatcagggtaatcaggcctccaatcccaatttataggtaaaggtcattttaagaaaaagacaaaatgaggtttgaattagtttgtaatggattacaaattaaaactgttttgaaatggggaaatgggagtgtgcagcatggaaagtgtcattgttttaggaagtagctgaaaagcttggataagttttttctgaaggaatttgatccaagagccaaggaaagtttaaccttagttcagtttccccccattttcttcagctacaatgcaaatagcacgtaattgggaacttgttttatgttatgattattacaagacaggatgccgaatagatattcactaaataaaactatttcttatagaacatttgttgtcagcagaccaaccctgctctcattgggatgtgaacatagtttttatatttgttgtcagtgtcatttttaatactaaaataagcatgttaatctattgatttaatctaaaatttagcatatatttttgctactaacgtatgagtcagtgaaatttgattagtaggtataattattagttttaacacattgcctccacatggctttagtatatttaaatatggagtttcctagagtatattgtataatgcttaatttttctcctcttttaggctaaatgctcattttgaagtaaatccagattgttctgtttctcgagcagaaatgtattctgaatacctctcgacttgcagtaaattagctcgtggtggaatcctaacatcaactggattttataaatgtcttaggtaggatccatagttctttaaataaagtccatttacgtcacttacaacatctcttgctctttaaagaaaataccaaatatcttatctagttttaaatatttctactactagaagtttcgtatggataggttatagtgtggtggaggtttaaataaaaagcagtttcagaaatcacatctagtgtttgtgttggaacattatgagatttatcaaagaaatgaagtttactttctttttcctacctacttttacatgttaaagacatgactgtatctttttaatcttgaataatagaatataatattattatcttcaaatacaaagactttttgatattttgcaaagtacataaaaataggtatcttttattagttatatgtgggtggaattgtttaaaacccagcgacattgttaataaataatgatgttttaaatgggatgattaatcttttatatttctttgctttccatccttgcagaatataactgtgagtcatactggttcatacataagcaacagtaaacatactgctgttgttcatgtaaacataatgttagaagtcaatgtgatagttatcaaaacttactgattatgtatgtactttacagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggtgttaatttttattgtatttttaaagtattactgatttaataataaaactgaatgaaaaatatatattctatgcattttaaatgtataacttttgtgtctccagtagcattttcttacttggtctattaccatattcatatgattcaaaattgttagatgttaatttcttaaaactattttctcttaagtaaaataattcctacttgggattttcagtcatttcatttggaattttgacgttttcttcatattttcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcaggtaagttattccatgatcacatttctcttatgaaatttctgatctgtaaatacaattttagagggaaatgcactgttttccatgtctcatcttgaaaagttactgtatcagctcacttgtatccaacctgtccttttctttttctctggttttgtaatattagttttcaattttagcacatgatttaaagaatctttcaattttgttatagatccaaattaataattttctaggcccaaggtagagaagcagttgctaatctgacatcttttggagaatttaaaaaatgtatcttaatctcctttttgagtttactgcacaagtgttggggggaatgggggtcctaagagtactctaaatggggatttctgtatttgattttgacctgagtgtgtttttgttgcctctttaacagtactgttgtaataaggatgaatcttgtaataactttatcagtcgtattctttttgtatttatgtattgcattagtctcctttagtgttaaaaagtattatttattgtaatttcaatttgtttcagatattctgatattcttttctgtttcttactcctttgctttactgtcctattcctgctattccctttttaatgcctaagattccatctctgcatgccttagtaaaaacaagtattttctaaaatcagcactaccaagttgagggtccaatcaggctatgaggattttaaggacaatcttatatgctctttccactgaaatcatggattctcttaacagtcgtcaccacctgtttcctggatcacttttctttcactctgttcttcctaattcctacatagccagaaccttctatgactactgccaactctgctgacacagttctggcttgggcttctgtatggttacggtgatgacagcagatatatggctattgttggcattagtgccaaatctaggtgtgggcaatagccaaatggaaagtacaagaacaaagggaagagccccttgcttcagaactagtagaataactgacaggtaccagtccgtggccctttaggaactgggccacacagccggaggtgagcggcaggtgagcgagtgaagcttcatctgtatttacttacagccgcttcccatcactcacgttatatcctgagctctgtctcctgtcagatcagtggcagcattagattctcgtaggaccacaagccctatcgtgaactgtgcatgcgaaggatctaggttgcacgctccttaggagaatctaacgcctgatgatcggtcactgtctcccattccccagatgggactgtcaagttgcaggaaaacaagctcagagcccccaatgattctacattatggcaagttgtataattatttcattatatattacagtgtaataatagaaataaagtgcttaataaatgtaatgcgcttgtatcaccccaaaaccatctcctcactccctggtctgtggaaaaattgtcctccatgaaaccggtccctggtgccaaaaagattggagacttctgctttgagggatgttatatacatggcaataattaatcctgagttattgatggaaaatactgtatcatttttattcaagcttccacatgttgagctttccacttaaacacaattttttaattagtgcaatgtggagtatatagtagatattccatagttaggttttttctcttatatttaataatttcccacttcaccttgattatgtgcctgttactcctcttagagacctttacaatcctaaatagttataacagaccaagccaaattagagaaaaactccatctccatcattatggaattgtttcaccaacactcattttttgtacccttaatcttccaatgtggttgtagtcagtaatatcacaattacaaagaatgaacaataatactagctaagacgaggacatgtcatagggactttatactaaagcagtttctcatttaatcctcacacaaccttattaggtaaaatttattataaagatgaggactcaagatggctagtaacttgcccaaggttaccaactaatatgaggtggtaccaggacagaaacctgggtttgtctgaaaccaaaactcatgctcttaacccattaacctttcttctttccactgttctagaagatttctctataaagctctagagagcctttttttaatctaacatattgattatttgagctgttgtgttagaggatgttctattaaatgatcattttaggacattattgctaaaactcattggttatttgagctgtggtgttatgagatgttctactaaatgataattttaggacattaatgctaaaatgctttacttagcacattggacatatatgtagttaattcaggccaagaaatcaatacattttgttcctaatctgaaaaatctgtattaaactttcttacattctcacaaaggatgtagtttatttaaaataggtacattctttatttctaaaactgatatttggttgtcttatagaaatttaaaactttgcaaggaaaaagagatgtagcgtacatgatgtctatgagaatgagaataacaaaaacagcattcttatatatagcacttagcccagtgcctgctacatatatgggcagttagtaatggggaaggtatgctttatctttttatagatgatgaagtacctattggggctaaatatttttaacagacaaaaaaattaactgttcaagatggcgttataagtttcttttgaagagaaggttgttgggccttctgaaaagcatgctaattaacagaaagccataaccattattgcccccatccttttaatttctttcttttttgggtggggaagacaggggcttactctgttgaccaggctagagtgcagtagtgcaatcacagctcactgcagcctcgacctccttggctcaagtaatccttccacctcagcctcccaagactgtagctgggagcacaggcatgtactgccatgcccagctaatttgttttatgttttatttttgtagagttgggatctccctatgttgcccaggctggtcttaaactcctagcagacttgagtgatccccgcgccttggcctcccaaagtgctgagattataggtgtgagccaacagacctggcttaaatttctttatgtactctttttctttcttcttttctttttttttttttttttttttttttgagacacagtctcgctctgttgcgtaggctggagtgcggtggcatgatgtcagctcactgcaacctctacctcccgggttcaagcgattcttccacctcagcctcctgagtaactggaattacaggccaccatgcctggctgatttttgtatttttaatagagactgggtttcaccatgttggtcaggctggtctcaagctcctgacctcgtgatccgcccacctcggcctcccaaagtgctgggattacaggcgtaagccaccatgcctgactaaatttctttatatactctttaaagttgcatgttagaccttggtttaataccattttattcactatttgaattggtagcttaaaggagtagacaaaatagaggattttaattgtgattttttttggagaaaccttgttattctacaatttcaagggatctagggatgttaaggaagtacttgcaccctgataagggatttccagacttgcagaatgcccagggctggaaagagcacagggaagtctccttgccaagaaggagcaacaagtaatcctttctaatgccattgtaattcattttttttcttctcagttttgtttcttccaacctccattaatcagctatattaattttattacagaaaaaaatagcaacaagtaaaaagaatctatgtgaaagtaaatgatatacccattgatttttatatttagtatttagctgggtagtttatataaatataaaataaactgtacctacttcaaggcacatttctttattggtaactgcttatttcaaatgtaatacttgcaagttgaagcacaatttatagaatactatttccagaagccctgccctgttccactgttcatgaattggtatctgttggaaacatatttgctaaatggcatactaaaaataaaaaagaatttataaaatgaaagaaacttagatacaaaaacttaacataagacttggttttttttcaggatcatacaaaatacatgttgaacataatctgttagttatctgttaatcccataatctgataacatgccaaattcttatacataaaaatagtttaaggatatacatatttaagatatttaacatatgcctcgcctcaattcagagtgtaaatcattcctaataatggtactgtgtaacatggaatattggtatcttactggtaaagagcttgagaaagttactcaacccatcagaaaatagattggtagcctcaggcgggggcagcatttagttgtagccataaaagaacagtttagcaagagccacaagaatatcacttttgtttttctaagagtactgccactcagatttgtagaccaatagcacattataaaactaagaaaagtattacataacttttttgtttatattttaatgtgttcttataaagtagtgttggcatgtattgatgatctaaatttatacttaataagaggaaaaaacttggtaatttaagaaaatgaggaaatgttagagctgaagggtctctgatattatatcttggccaaaactcctacttttaagagttgaagtgaattgtccacattcacaaaaatctcttttccagtgatttctattactgtcttaattctcttctctgaagacttatacatttagctaaatgcatctctctctctctccctctctctctctcttttttttaatacagagcctcgctctgttgcctaggctggagtgcagtggcacactcttggctcactgcaacctctgcctcttgggcttaagcaatcctccttcttcagcctcccgagtggctggcactacaggtgcacactaccacacctgtctgatttttgtattttctgtagagaccaggttttgccatgttgcccaggctgatctcaaactcctgggctcaagtgatccttctgccttggcctcccaaagtgctgggattataggcatgagccaccgtgcctggcctagctagaggtatctcttatatcacattcagagtaaatacaattcttgttccttacaaggttttgaaagtgtctttccttctcacctcttctttagaatactctttcccagtttcttcagtatggttttaggtgtcatggtgtctggtttattcaccatcctgtttatctcaaccatagaagatacagctactcaggaggctgaggtgggaagattgcatgagcccaggagttcaaggctgcagtgaactgtgatcacgccattgcactccagcctgggtgacagagcaaaaccctatctaaaaaaaagaaagaaagaaagaaactttccttttatactttccttgctctttaacccctcctcccatgccactttctcaccatcagagttctatggcttttagaatttgcaggtgaatggttttcagatttatttttccaacattaacttctattgatagacatttttagttcgttcatctgtcattattcccaaactaaaccgatcatctttcctctgaaatatggtttcctattattgccatttattgagactcttgagctaggcttctcatttatagtttctctagtcttcccatcatctcataagttagtttttattacttacactttacagatgagaaaactgaggatcagagaggttaagtcggtagcccaagatcacatggctagtaaaaatcagattgaaagtgtgagtcctgatctgtcaagctggaaaatcctcatcctatttgtgatatctctacggccctaaaatgtttttggtgcatgtgtatgttttcttattgtaaaatcttaagagtgggaacctattatagaaatgtcagtcttgaagtagatttttccctcagagcttagaactcaaaagttcttgacttcccatttctgacaactttgtctttcaacatgttattctcttccttctttcatttgtatgtcatagtagccttgtatgtttgtgatttatctttttttctaaagaaaattactgtggcttttaatctaagttctcagcaattttagcttactgctttcccacctattgccagtacagtcatgtgctacttaaggacatttctgtcaaggatggaccacataatacaacaatagtctcataagatcataatattgttttcactgtaccttttctatgttttgatacacaaatacttaaccattgtgttacggttgcctatagtattcggtacagtaacatgctatacagatttttagcctaggagcaataggctattccatatagcctaggtatgtagtaggctatatcatctaggtttgtggaagtacaccgtatggcattcacagaacaatgaaatgttctgtgacccatttctcaaacatattcctgtcattaagtgatgcacgactgcattaccttataaatgaacaagtatattcaatgttttcccagagttttaatttactgcctttaagcagttcttcaaaaataatgtactaccatttctataagaaatttaacattaatttttccctttgtggtatttcaagaaaatatattgcctaaatttgatttaaggtacattttgattattagtgttttttccaagagaaagggatgggatctaaaagaaaaaaattataggatatatttaaaagactttatgcctacaattagaattattattttttcttttgagacagagtctcctctttcacccaggttggagtgaagtggagcgatctcagctcactgcaacctctgcctcccgggttcaagtgattctcctgcctcagcctcccaagtagctgggattacaggcgcctgccaccacgcctggctaatttttgtttttagcagagatggggtttcgccatgttggccaggttggtctcgaactcctgacctcaggtgatccacccccctgggcctcccaaagtgctaggattacaggcatgaaccaccgtgcccagcctagaattcttacataaataacaaaagatataattagactgggggctggatgtggcagctcatacctgtaatgccagcactttgggaggccaaagggggaggatggcttgaggccagtaatttgagattatagtgagctatgattatgcctctgtaacctgcccaggcaacagaacaagaccgaccctgtctctaaaaataacaaaaatacataattgagcaacttcaaaatctaaaattgttaagcagcttactgcaaattagttaatatcatattttatacatatggttacatcattattgctatctaaaattttcattgctttttaccatattgtttcacattatattctttagaaaatctaaaagtaaacatacaaaaaagtagtaacttgcagttgatctgttcttgtgaagaattcacataagtaaatccaatgggtacatttatagtatatttatttctcatttaaatctacaattgtattgtttcatcctaaaaatctttattttaaataatatatattttatagtggtaataacaatgtggtattaccttcgtggttttatattaaataaaataaactttctaaatatttctataaaaataatttttaaagattttaaaggtaatcataagcttaaaattataaaatgtaaattttatggtagaaatgtataacaacataatcaaatttataagactatactataaaatatgaattttttcagtgtcatgtcacaaactctgcatttgttctttttcacagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtaaatggcaattttatttgatatataaaagtattctttgttttggaatgcttttatatttaagtttctgtcatctatagttgcatgaaaattttcctttagaaccactaactttagcgaaactacaagagttatatttatgatccattatgtggacctaaactaagaaatttatatataagtgatggaaagaacttcattgcttaatggtacgttgtagagaatacggttcaatatttgttttcagtaaagaaaatcaattaagaatttaattatatatttggctgttaaaagcttttttttgttgtttttgtcgtttttaagtggcttgaacttagtggcagctatagtatttccatatagtagaaacttagaagtaataatgtgctagaaagagaatgacttgtcttgaatttgagtttgggatggatacctatgaaaattatttttaaagccataccatcttacaatttaattaagatgaacttttgaaataaacctttcttagacttgaaggaaaacttgaaaagaatgttggttaaaataaaaatcttaattcctttgacagtacttaggtaagaccttttgccttcagtcatttttttagaggtctaggactaaggcatttgtctttttttttttttttttttttggaaacagagtctcgctctgttgttcaggctggagtgcagtggcgctatctccactcactgcaacctccacctcctaggttcaagcaattcttttgcctcagcttcttgagtagctgggattacaggcatgtgccaccatccctggctaatttttgttttttttttcaccacgttggccaggctagtctggaactcctgacctccagtgatccctctggcctcggcctcccaaagtgctgggactacaagcgtaagctactaagccctgccagcatttgttttaatagacataacactgttcattttttagatatcaaagattccatttcactcttcataattaatagcagaaattaccatatcttttacaagctatctttgctattcatatttttgtgatatagatattatactttattgtaaacttcatatacagattttttatatgattatggctacctgtgtagcctagggattattaatagtatgcaaaatatctataggatagcaatgatcaaactgtaactctcaacccagtagtgggactgtggatcattttagtaggtttttgtttgtttttcttttcaatgaaaaaattaaatatatcatagttcaccatgttagcaagggtaaatattgttttcagttatatatatgtgacctatatatgtgtatttgatcatagtataaaatctatttgtcaaaaaaattctttaaaaatcagtcctttaggttgtttccttcattcattgaaggattatttccttcattcatttaatttgaccatctctttctttttaaggtgtatgtttgtaagttaatttgaaactttcttcactgcatgccaattttactctctccatttgtcttgagatttttgtttttttcatggcaaatagtagttgatggaatgggtagtgtgctaaaggtgtttgttaacttttcaaaaagtttacgaagcttgtcgcagtggtgcactcctgtagccccagctgcccaggaaggctgaggcaggaggatcgcttgaacctaggaattcgagtctagcttgggcaacatggtgagacctcatgtctaaaaagataaaaataaagaagtttaagcataactgctttagatgaagtgtttaggttacttcaagataagttgccggaagagttaatgaacctagatgtctgacagtttcccatcttgctaatagatcagtgttacataatttgatgatttacctttttcttgctagtcttttctaaacaagacagattaaacagggcttcttagagcatgccattttttttttatccatagcttttcactactgcattgctaataagtttagttttagtctgcaaatatttgttaagcatcctctacgagggtgcatgtgccagaagatagaaatacaaaaatcactcccagtcctgagggacacagaccaaaaaacaaataaattacagtataagtaagtactgtaaaaaagatagtttcatagtgctgtttgcaacatattggacaatttaactttgagatggttggagagttttactacaagcattacattttagttgagtcttaaagaatgagtaggaatttttcatgctaaaataaacctgtcagaatgttaagagcaagcacaggagtgtaaaaggaccttgtatgtccaggaaactgtgagaagttaggatactacaagcataacgacatgaaaagagaaatggctcttattcatatttagttccagttccaagtaggaacatatatatgatagccattgaccactaagtggctgttctgatttctttaatatcatatcaaaaatactagtaaagaactttatgctgggcatggtggcttgagcctgtaatgccagctactcgggatgctgagaactggagaatctcttgagcccaggacttcaaggctacagtgagctatgattgcatcattgcactccagcctcggttataaagtaagacactgtctctttttaaaaaaaaaacaaaccagaaaactttctttgtttccatcagatttaaagctaaaattattttctttacctatatattattgtaaactgctttgtatttaaagttgaaatagctatgtgctctcttccttttaaggacttaaaagtgactttgagtatacatttaacctgttcttagttctgtattggcaccacactttatgtagtctttttgtatttataattctcctttttttttctttttctttttctttcccttttttttttgttttttttttgagacacagtctcactatgtcacccaggcttctatgcagtggtgctatcttgatcttggctcattgcaacctctgtcttgtgagctcaagccatcctcccacctcagcctccaaagtgactgagactacaggtgcatgccgccacaccaagctaatttttgcatttttttatacagacagggttttgccatgttgccaaggctgttctcgaactcctgaactcaagtgatctgcccacctcagcctcccaaagtgctgggattacaggcatgagccataattctccttttagatgtataatatagattcttttcagtaagccccactccctcttatatcatcacatattgatgcttggttttttgatctgtaagcatttatctctaaaagttagggacctcactctttagatataaatactatataccaccaccaccaccatactcctacagaaaaaaattaattcccttcaatattatgatttcttcttatatcctgtcagtgtttacatttctccagtggccttttgtttagagtttgaattggaatgtaaggttcaaacattgcctctggttgataagtcttaaatctcttttaatctgttagattacccctccatccctcttaatttttttttctttgcaagtttttgttgaaaaaaaaaaaacaggttaatttgtcctatagagcattacaatctggattttcctgatactgtttagcatgttactctgaccttgtattttctgtacattggtagtttggtccaaatatttgatcaagttctggtttcactatatgaagaccacttcagaaatgatattgtgtacttccatcaggagatatgtaatatcttcttgtctctttttgtgatataaacagcctttaaggatcattgttcagaacattatttcattaaggtttgtaaaatataaaagacccccttttatcagtcatttgccttctttgaggaatagttcctacaggaaaggcaagatagatgcttggatatttcccttatttaccagttttcaaaataatgagttgctcactatcaccctgcaaaagttaccatgaggtttggtttttgtttattttgtttgtagtattactgtgagctaacaggaatttaaacatatttgagatatttcagtcaattgaggttatgtatccttcttggtatacaaattgtgccattttcggtcagtgaaagcctcttcaagtggatttcccaggtcctttggttgtgaccttaatataagtgtttgatagttttcctgctctctgataggcaagatagtctgtgtgtttatactgattcttggaatttagattaagtacaacaaggtttttacttcgttttatcattttcacacctgtaccttctttctcccacaccaaaaatcccatttctcaatattgttaagaatttattctttgtcctatgtcatactccaaaaaaaatgttgtctgctgtggtataacttgaaaaggtttttctcattttttcaattaatcatttgtcttttaaagtaaacagacaaatgattgtctttttacaatcatttgtaaaagaaaacaaagtaaccctttgttttttgttattttgtttgtttttgtcctagatgaagggtttttttctttcaattaatttttctgtaaacaaatttattaggtttttcattattgcttcaggatctggattatagttaggaaggctttctctgtgcccaaattgtagaagaacccccatgtttttatttagaacttatgtgattttttagtttccatttaaatcttatattttggtatttttccctgtgtcagtaatctggtcttaaggaaatgagggtaagtcagtgacttttttcttcaatttgtcactgtaactttcttttctcatactataagagtagtttattctaagaaaaatgagagtcacagtggatattttgggcttcagcactgtccagtgggacaatccaaactagtttcatcagatgctactcaagactcttaacaaaagtgattccacaatattttcataattgtttttcttattttaaaattatatttctagcttttaaaaaatttaaattccaaaaatagcgttatcagaagataaccatggttgtaagtttggtatgtgtctttacaaacctttttcatatacagctatactatattgtacatgaaaagtatacatgtatactttgtttcttattttaaactatatatactgatctagagcttgcttcaataatatatgtaatactcattaatatgactatatatatatactttttatgtcaatacatagatttactcattctttgtattgaataccaataattcccttttattgcactgtctttgttatctgcattggtaaatagaactgctcgtcctttttttgacaggattactcttgaattatgaggacacatttctttccataaataagatgcaatgatcctgcactatagtctgttaactatatctcatattaagggtatttaggattttagttatttgctattacatatgaacagaactgtggtgaataatttcgtttccatagcacattttctacaagtatttcagtagaataaaataccaaattgggaattgctgagtcaggggatttacatgtttttatttttgtagaagtaccatctaaaaatgttaacttgtaattcaaataatagaatatgagcttgtttcccactacctggctactcaaaactgaggggaaatttctttgctgatctgatagcctcaaaaagactgtcaatttttattcttttgttattttaactttttaaatagactattttgagagcaattttaggtttacaacaaaattgaatggcaaatacagagtgttcctatatagcactgccccacaaatattacatctttataggaatggtacatttgttataactggttaacctacattgacacatcattatcacccaaagtccattgtttacattaagatttgctcttgacattgtacattctgggggttttgttttgttgggttgttttgtgaagtttgttgttgttgttgttgttgttgttgttgttgttgtttggagatggagtcttacttcatcacccaggctggagtgcagtggggtgatctcggctcactgcaacctccacctcccaagttcaaacgattctcttggctcatcttcctgagtagctgggactacaggtgcgtgccaccatgcccagctaatttttgtatttttagtagagatggcatttcaccatgttgggaaggctggtcttgaactcctgacctcctgatccacccaccttggcctcccaaagtgctgggattacaggcatgagccactgcacccagcctgttgttacttgtttgttttctgagacaaggtcttgttctgtcatccatgctagagtttagtgggatgatcacagttcactgtaacctcaacttcctgagctcaagtgatccctcccgcctcagcctcctgagtagctaggactacagatgtgaccaccacacccacctaattttaacttttttctaagctaattttaaaattttctgtgctggccgggcgcagtggctcatgcctgtaatcccagcactttgggaggccgaggcgggctgatcgtgaggtcaggagatcgagaccatcctggctagcacagtgaaaccccgtctctactaaaaatacaaaaaaattagccgggcatggtggcgggcgcctgtagtcccagctactcgggaggctgaggcaggaaaatggcatgaaccctggaggcggagcttgcagtgagcccagatcgcgccactgcactctagccagggcaacagaacgagactccatctcaaaaaaaaaaaaaagaaaaaaaaacttctgtacagatggggtcttactatgttgcctaagctggtcttgaactcctggtctcaagcaattctcccaccttggcctcacaaagggttgggattacaggcatgagccactgcacctgaccactctatgggttttgacaactattaatataataacatgtgtccaccattacagtatacagaatagttttattgccctaaaaatcttttgtattctgcctcttcatcttaccattccccagctcctgttttaatttttatttcaagtattgagttaaatatctttatgattttcttctgtgaattatctactcgtgtcatttgctcattctttattgcccttcctaaaaatttgcaatacttctctgtacattaaggatgtcaactcttggccaggcgtggtggctcacacctgtaatcccagcactttgagaggccaaggcaggcagatcacttgaggtcaggagttcgagaccagcctggccaacatggcaaaaccctgtctctactaaaaatacaaaaattagctaggcatggtggcgggtacctgtaatcccagctacttgggtggctgaggcacgagaatcgcttgaacccaggaggcagaggttgcagcaagccgagattgtgccactgcactccagcctgggtgacaaagcgagactctgtctcaaagaggaaaaaaagaaggatatcatctctttattatgtgtccaccccacgtctcgagactttagccatattttgctacataaaatttaaatcttaatggttttcatgtcgtgcttagaaagaccttttcaacttttatatcataaaatgcacattttttgctttgtaatacattaatatttttactttttgattaatttgtaatttagcttgatgtataaaatgaggtatgagcctagcttaattattttccaaatggctaacttattggcaatcatctttccctcagacatttgaattgccacctttgtcatatactaatcctataaatgctgtgcctatttctggatcacttgttatccccttgatctctgtccttattacactatcactttaaatgtattttaactttggacatggcagtttgcccctgctgattcttcgcagttttttatgatttatttgagcaactactttatactaggcactgtgccgggttttgaaattagagtgatgtataaatcagatttatttctcgagattgccaagaaaggcatgttgggatttgggttgcaattgctttttgtttttttttttgagatggagtctcgctgtgtcacccaggctggagtacattggcaagatgttggctcactgtaaccttcgcctcccaggttcaagcgattcgcctgcctcagcctgagtagctgggattacaggcacgtgccaccatgcccagctaatttttgtatttttagtagggacagggtttcaccatattggccaggctggtctcgaactcctgagctcgtgatctgcctgcctcggcctcccaaagtgctgggattacaggcgtgcgccaccgtgcccggccgcgattgcttttaatgaacagttttttgtttattttttgatagtgagcacttttttttagatttcccttactggaaaaggtatcagcccatgttattacttttttttttccaatagagcttcttgacttttcttcgcatgaattttgtactttattaagtttattgctaggtggtagtcttatatttagttgttataaatgatctcaacttccattatatttttcaactgataggtgttttctatatttatacttcatattttgtcttatccaattataatgtctaggccaggtgtcgtggctcatgcttgtaatttcagcactttgggaggccgaggcagatggatcacttgaggtcaggagtttgagaacagcctggccaatatggtgaaaccccgtctctactaaaaatgtgaacattagccaggcgtggtggcgggcgactgtaatcccagctaataaggaggctgaagcaggagaattgcttgaaccggggaggtggaggttgcagtgagctgagatcatgccattgcattccagcctgtgtgacagagcaagattccacctcaaaaacaaaacaaaacaaaaacaaacaaacaagtctaatgttttcagcacaattgcacaatagtgataatattcatccatatcttttttaaagctaataaaccattttttttgttgttgttgagacagactcttgctctgtcatccaggctgtagtgcagtggcgcgatctcggctcactgcaagctccgcctcctgggttcacgccattctcctgcctcagcctcctgagtagctgggactacaggcgcccgccaccatgccctgctaactttttttgtatttttagtagagaacggggcttcactgtgctagccaggatggtctcgatctcctgacttcctgatccaccctcctcggcctcccaaagtgctgggattacaggcgtgagccactgtgtccggccaaaaccacgtttttttagagcagttttaggtttatggaaaaatcgagcagacagaatagagttcccatatctccgtcctccctgcacacagtttccactattattgacaccttgcattagtgtggtacacatgtgataattgatgagccaatattgatacactagtattaactaaagttcatagtttacattcagattcatcctttctacagttctgtgggttttgacaaatgcgtaatgtcatgtctccaacattacagtaacatgcagagtaccttcactacactaaaaatccattttgctttacctatttattcctcctcaccccctccctcgcccccagttcctggcagccactcattttttttactatttctatagttttcatttttccagaatgtaatatagttggaattattcagcagtatcctttttaatctggtttctttcacttagtaatatgcacataagttttctccatgtcttcttattgttggatagctcatttctttttatttctgtataatattttattatacagatgtacatagtttgcttatccattcgtctattgaacagtgtcataattgcttccaattactggcaattttgaactaaggtgttataaacatttatgtgtaagtttgtgtggatgtagtttttcaactaactcatttgggcaaacacctaggattataattgctggatcatatgataaagactatgcttaacattgtaagacactgtgaatctgtcttccaaagtgtctgtacgattttgtattcctaccagcagtgaatgagaattttgttgcttcatatccttgccaacatttagttttgtcagtgttttagatatgagccattctgataggtgtgtgttggtatatctgttaatttctagttccctaaaaacatatgatgctgagcatctttttgtttgtttatttaccatatgtatatctttttggtgggtgtctattcagatatttaacccatttttaatttggttgtttgctgagagcttttggcatgagtagataatggattatgtcaaatgcttttctgcgtctattgctatgatcatatgatttttattttttgtcttgtgaatgtgatggattacttcaatttttgcttcaaccagccttgtgtccctgtaataaattttactttgtcatggcatatatttcttttttatgcattgtttgatacaatttgctaatatttttcctgaggatgttctcctctatattcatgcaagattctgggatgtagttttcttgtaatgtctttgtctgattttggtaatagggttatgctgtcctcatagaataagttagaaagtgttccctctgcttctattgtctggtagggagtagggattgtagagaatttatatcattccttcctttaattatttgttgtgaattcagcagagaaacctgtggtcctggtactttctgttttgaaggttattaattattgattcaatttctttaatagttacaatgttattcagattatctgttgctccttgagtgagttttggcagattgtgtctttcagggaattggccgatttcatctaagttatcaaatatgtgagcatagagatatttctgtttctttattagcatccttttaatgtccatgggattggtagtaatggtccctttttcatttctgatattaatgatttgtatcttctgttattttttcttggttaggttagctacaggtttatgtattttattgaattttttttcccccaaagaaccagcttttggttttgttaaatttttttctttctgttgatttcctgttttcagtttcattaatttctgctcttttattattttttttcttctgcctgctttgggtttaatgtgctcttctttgtctagtttcctaaggtagaagcttgcattattattttagatctttcttcttttttagtatataagttcaatgctaaagccttccctctaagtactacttttactatatccagaaattatgattatgttgtattttcattttcctctagttcgaaatattgcaaaaatgtgttatttagactccaaatgtttttggtattttctagctatctttttgttattgatttctctattaatctgttctcacactgctttaaggacatacccgagactgggtaacttataaagaataaaggtttaattgactcacagttttgcatggctgggaaggcctcaggaaagcaacaatcatgacagaaagggaagtaaacacgtccttcacatggcagcaagagagagaagtgccaagcaaagaggggaaaagtcccttataaaatcgtcagatctcgtgagaactcactcactatcaggagaacagcagcacgggcgtaaccgcatgggtggggacacagccaaaccatatcaattactatttaattccattgtggtttcagagtatacatatgatttctattcttttaaatttgctaaggtgtgttttatgtcccagattgtggtctatcttggtggatgttccatgtgagcttgagaagaatatattgttggatgaagtattcagtaaatatcaattagatccagttgattgatggtgctgttcaattcaactatatccttactgattttctgcctattggatctgtcaattactgatagaggtatgttgaagtcttcaactataatagtggatttggttctttctctttgcagttctatcagtgtttgactcacatgttttgatgctttatgttcagtacatatatcttaaggattgctatatcttcttggagaagattgttaggttttctttatcattatgtaatgcccctcttgatccacgataattttccttgctctgaagtctgctttgtctgaaataattattgccactccagcttacttttaattagtgttaatatagtttatctttctccatccctttacttttaatctgtgtctttattttaacaatacatagttgggtcttattatcctctctgtcttttaattcgtgtatttagatcattctcatttaatgtgattttcactgtagttgcattgatagctatcatatttgtaaatgcacttgttctttttctgctgtcccatttttctgccttctctgatgttagctgagcactttttatgttgccattttctcccctttcttcggatatcaatcatatttctttaactttttcatttgtggttattttagagtttgcagtatacatttatagttaatctaagatgactttcaaacaatagtacaggcatacctcagagatattgcatgtttggttccagatcaccacaagaaggcaaatatcacaataaagcaagtcacataaatatttttgtttcttagtgcatttaaaagtaatgtttacactatactgtagttaattaagtgtgcaataacattttgtctaaaataaaaaggtacataccttaattaaaaatgctttactgctaaagatgctaatgatcatctgaacctttagcaagtcatcatctttttgctggtgaaaggtcttgcctcgatattgatggctgctgactgatcaggatagtggttgctgaaggttggggtagtcatgtcaatttcttaaaataaggtaatgaagtttgccacatcactggactcttcctttcacaaaagattttgctgtagcatgagatgctgcttgataccattttacccacggtagaacttctttcaaaattggaatcaagcagcagtgcattcctgtactcccagctatttgggaggttgaggaaggaggattgcttgagtccaagagttctgggctgtagcacactacactgactggttgtctgcactaagttcggcatcagtatggtgacttcctgggagtagggaccaccaggttgcctaaggaagggtgaactagcccaagtcagaaatggagcaagtcaaaactccaacgctgatcagtactaggatagtgcctgtaaatagccactgcactccaacctggacaatagagcaagaccctgtctcttaaaaaaaaaaaaaagattgagtcagtcttctcaaaccctgctgctatgttatcaactaagtttatgtaatattctaaagcctttgctatcatttcaacagtgttcacagcatcttcaccaggagtagattctaccccaagaaaccactttctttgttcatccctaagaagcaactcctcatccattcaaattttatcataagattttagcaattcagttacatctttaggctctgcttctagttctcttgctatttgtatcatatttgctgttacttcctccactgaagccttgaatcctcaaagtcattcatgagaattggaatcaatttcttccatactcctgctaatgttcatatttcgacctcctcccatgaatcacgaatgttcttagtggcaactagcattagagaatcctttgcagaagattttcaatttactttgccagatctatccatggaattactatctatagcagctatagccttaaggaacaagagttgaaagttgaggccaggcacagtggctgatgcctgtaatctcaacactttggaaggccaaagcaggaagatggcttgaacctaggagttcaagatgaggctggcaatatagcaagaccttgttcctacaaaaaaaataaaaaataggtggtgatggtggcccttgcctgtggtcccagttactcaggaggctttggtggaaggatcgcttgagcccaggaggcggagtttgcagtgagcggagatgtaccactacactccatcctcagcaacagagtgagaccctgtctcaaaaaaataaaaaatagttgaagtgactgcttgttccatgggctgcagaatggatgttgtgttagcagcatgaaaacaacattcatatccttgtagagctccatcagagctcttgggcacctagatacattgtcagtgagtggtactgttttgaaataaatcttttcatcagagtggtaagtttcaatagcagacttaaaatactcagtaaaccatgctgtaaacaaatgtgctatcatctaggctttgatgttgcccaggcaatgtagatttagcataattcttaagagtcctcagattttcagaatggccaatgagcattgacttcaacttaaagtcaccagctgcattagctgctaatgagagtcagcctttcttagaatcttagaagctttgaagccaggtattgacttttcctctctagctatgaaagtcctagacctagatatcatcttcttccagtaaaaggctgtttgatctttattgaaaatctgttgcttagtgtagcattctttatcaatgatgttagctaggtcttctggataacgtgctgcagcttctgcatcaggacttgctttaccttgcactttcatgttatggagatggcttcttaaacctcatgaagcaacctctgctggcttcaaacttttcttctgcagcttctctacctctctcaacctatgcatagaatttaagagagtttagggccttgctctggattaggctttggcttaatagaatgtcttgactggtttgatattctatccagacctctacaactgtctccatatcagcaaggctctttcactttcctgacatttgggtgttcacttgagaatcacttttattttccattgagaacttttcatttacattcacagcttggctgtttggtgcaagaggcatagcttttagcctttctcagctttgccatacctttctcactaaacttaatcatttctagcttttaatttaaagtgagagacatacgactcttcctttcacttgaacactgagaggccattgtggggttattaattggcctaatttcattattgttgaatggtgtatcagggagccctaaggatggagagagagatgaaggtaacagccagtcaatggagtactcaaaagacacataacatttggctgggtgcagtggctcacgcctgtaatcccagcactttgggaggccgaggcgggtggatcacgtgaggttgggagttcaagaccaccctgaccaacatggagaaaccctgtttctcctaaaaatacaaaattagccagatgtggtggcacatgcctgtaatcccagctagtagggaggctgaggcaggagaatcgtttgagcccggaaggtggaggttgcggtgagccagagattgtgccgttgcactccagcctgggcaacaagagcgaaactccatctcaaaaaaagaaaaaaaaggaaaaaaaaaaaaagacacagaacatttacactccaaaacatttacaaaggtgacatcaagatcactgatcacagatcactataacagatatagtaataatgaaagtgttttaaatattgtgagaattaccaaaatgtgatataaagacaggaagcaagcacatgctgttagaaaaatggtgctgatagtcttgcttgtcacagggttgccacaaaccttcaattaaaaaaaaaaaaaaggccgggcgtggtggctcacgcctgtaatcccagcactttgggaggctgaggtgggcggatcacaagttcaggagaccgagaccatcctggctaacacagtgaaaactcatctctactaaaaaaatacaaaaaaattaaccaggcctggtggtgggcacctgtagtcccagctccttgggagggtgaggcaggagaatagcgtgaacccaggagacagagcttgcagtgagcccagatcacgccactgcactccagcctgggtgacagagtgagactccatctcaaaaaaaaaaaaaaaaaaagtatttgcaaagcataataaagcaacatgcaataaaatgggatgtacctgtgtattgctatacaggtactggtccgtggcctgttaggaaccaggctgcacagcaggaggtgagtgccaggcaaaaaagcaaagcttcatctgtatttacagccgctccctattgcttgcattaccacctaagctctgccccctgttagatcagtggcggcattggattctcataggagcgcaagccctgttgtgaactgtgcatgcgagggatctaggttgcatgctccttatgagaacctaatgcctgatgatctgtcacttctcccatcacccccagatgggaccatctagttgcaggaaaagaagcacagggctcccattgattctacattatggtgagttgtataattatttcattatatggtacaatgagtaataatggaaataaagtgtacaataaatgtaatgcgcttgaatcatcccaaaaccatccccccaacccctggtccatggaaaaattgtcttccatgaaagtggtccctggtaccaaaaaaggttggtgaccgttgccttatactatgtcctttacatactgtcactcatttcacttatctgtaagctataatcaccagatatactattgttattttttattatctgttagatcaatcaaaagtaagaaaaagaaatattttgcttctattgatttcttctctaacactcttccttactctatgtaaattcaagttttgacctctatattttccttctctgaagatctccttttaacatttcttgtgaagcaagtctcctggtgcatatggcctcagtttttgtttgtctgagaaagtctatttctccttgacttttgaagagtgattttactggatacaaaattctaggttagtggatgtttatctttcaacagtttaaatatctcattccattcttcttgcttgcattattcctaaagagacatcagtgtattcttctccttgtccttccatcagtaagttggttttttccctcttaattctgtgaaggtttttttctttgtctttggtttttggaagtttgaatatgatgtggctaggtgttgattttttaatatttatcttgtttagtgttgtctgtgtttcctggatctgtgatttcttgtgtgacattagttttggaaaattctcacttcgttcttacttcaaatattttttgtgttctttctctttttcttctctttatggtattcccactgcatatatttgcagcttttgttatcaccccacagtccttgaatattctgtttgtttcctctattctttgttccctttgcttttcagtttgggaagttcctgttgacatatcttacttacatcttcaagtccactgattctttccttatctgtatccagtctgttgatgagtctatgaaagacattgtttatttctgttacagtttttttcatatttctagcattttctttttattcttagcatctcatctctgcttacattattcatttgttcttgatgttcactttttccattagtcttagcatatttattataattattttaaattctcagtctgaaaatgtcaaaatttgtgtgatatctgagtctggttctaatgttagctttgcctcttctgaccgtgtgtgtggtggtgggcgggggttgtttgtttttatacttttggcgtgccttgtcagtttttgttaagtcagacaggatgtttcagttaagcatctgaggtaaatagcctttggcgtgaggttttatgtttatctggttagaatttaggctatgtttaatgtttgctgtagctgtaggtgtcagaagcttcagtattccctgatgtccttttttttcttcctttgttgttgttggattttttttagaaactcctttttaaatatagcctgtatcttgtagctctctcagttctaatacactgttatactatactggaaacctgttgatacagtggtaaggtaatggggaggtgaaatattctataatcttatgattaaatctcactttaaaaaagtcggccttcatctaagggctgcgactttggtaagtttttcagcctttattttttttctcctgtgtaagacgaaaagtctagagagggcccgtgttttctaattgcttttcctgtaagtcagataaggctctggtaaagtcgtttttcatgagacagacctttgtaaggtgaagagaacagtctgggcatattagaaatgtttactcacccccttccattcctggaagcagggagaaatttttcttcagtcttcactgtgagatcctggactctgaaggtaattcacacaaaagtatgggttctccacagaaactgacctcccgccccaagggtttttaattgtgaagattagcagtttgtcagttgctgtttaagggttcctgcaagttacgggctccagctataagggctgattctctgtattcaagggtctctccagctttcagagtggtagtttgccctgtgacctcagttctctgacagatccaggaggagttgtaaattttcagtttgttcatcttatttcttattgtgaggatgggactgatgacttgcagctttttacatgtttgaaaggaaactgaaagtcctcatcattatcttttatccttgtttatcatcattaagcacaatgttgactattagtttatccttgaaatgtataaataatgtgtgattgtataaaacatttttgagactccctcaaaagtgtcctttatttaaaaatatctatgaattgctgtttaaattctgtgtaattggagaaaaggacttgatgcctttgaatagtggagtttatattaagtgtttttaggactttatttttctaggctacagtgttctttgaataagtggtgtcaggcaaagttaagaaaggccctctaccttgcctttaaacataggagttttgcttttgttttatatataggggttttaagtaatattttgtttgaagattctgttgctaaaaagacatttgaaaaacacttttctggaatctattgctcctcatatatttctcgttaaaaactgctacagaaagatgaaaattattttcccttaagaggaataaaatctacattatatttgtatttagaattgcattattgaaagtcaaaccaggaatatagaggatctcaaatatattctaaacaaatatttcctgtgtgaaaacttgtctgtctatgaaggagggacttttacttggtactgataaaactgataattccccaactgcccaggaaatctacccaagtgatgttgaggttcaaatcaccaggttcctactgaaccttatacagttacaattcctcctaaagttcctattgtaaggtataattactcctactgtacaagccagaataatttttttgtttgtttgtttatttgttgggtgacccaggcaattttattactttatccctgaacctcagttgcctcatggataagatggggataataatagcactcattttataattatgaagattaaacacattaatgcaaggaaaacacttgagtctgtgtctagcacatgctcaacacttaacagatgttatttatacatgctgatgtctcaaacaggcatggaatgttaaatacataaaacaggaagttttagccattgacatattctctgcccctaccccagtttgtccaagcctatcgagatagtgtccttaatctttgcaggtgttggattcaagacaactgtcagatggcgttcatctgcataagtgaatataaatgcagttttggctgtttggggggacacaacactagagtttaatcttcgaacttgacttggaagcattcctgccaatataaaagattttgtttgaggcattggagaagccaaagcctgctcctaggttgaacttccagctcatggcctagttgtagtcctgctgcaggttctgctgcaggctatttgctgccttcttgctgagggtcatgttgggccttgcagtcatgctaggggggcagctgaatgaaggggtcagatttttgaatccacccatgtttgagaaatttccatttctgttccttgttcttaaaaccagtatcctactggccaaactgggttactgtccacttcctggtttcagaagcttctcttttgcccagctaaagatcagtctgttgcaaggccttccacctcacctggtctgtgtgccccttgtccatgttgcctttcttttccaacataacctctgtgtctgtctgttttctctttccacgagtttcctgctaccccactctctttcctcttctttttttccttttcagagccacgtcctcagtgagtggctgctctgtttttcttggacttcagtttcttctttgctgtgaccttagggccatcgcatattgcgatgtattttggagcctcaattttgactggcttttttttacttcgtatcctaaggctacatacacttcatggacctggagggcttggggtgtggcctaggaggttgtctcccttccggtggatttttttgtcttcttcacttaaccactgtgttccctgggcttcccctgcttccgttctgccccaaggctgcctgctccttgccctccttcctcactgagcaaatgtaggcaacattcctttccttgcagaatcaagggtcctggactgagaaggctctgggttcctgtgcccctttttttccctcttgtgttttttgaacttctcgccaactctggtctcctcctcactgtgtctgggatctggggaggttttcaccccagagccgtggaacatgccagaggtcacttctttttcttcttcctgctgaggaactccaagtggcaaagcgcctgcttcctggggctgggtgacttccctgtctgtctgtcacacaacatggcctcaggttctaggtgctccttagggtgctaaggcttgtctttgttttcactagaggcatctctggtgtccgcgcttgtaccacactcttagagcgggatgtggctcttataggagaaacatcaacaaaatgattgtcattgtttaaaattgagattaagtctccagttctttgatgaccttctttcttttttactttgggaccccaaggcccaggtctcctttgtgggccttggtgattattcccataagtcaaacttctctgcctccaggtgagagcctacttcaccatgacccagaagtcccggaataagacttttgtaccgaactggctaaagtacgaataatgctttgtctgatagaaaattactgaaaacaacaacagacaccaacttcactatattttgcaagtgattaaaaacttacaggtagctagaatttgttttctagaacaaaggtagattgatttacatgattacttctacttcttccaaaagtattgaagtatctaaagacgagctgaatgttacacataaaactgccatcttgataatgtgaaaatacttgaaagagtaaaatatccaagtggaatttttaaattcatgataacatgccttagcaaatactgtttaattttaggtaaactgccaatttaggttgaaattaatcagtagttagattgatcaatagcttgacttaaatgtcagtgggagaaacaaattgaaattagttttgtagcatcatttgtctcaattttgtggtcataaaaccagaagagatcttcagagggttatatgttgttttctgaagttttgtggtattagcacaatgccttgcacataaaatgcttttaactaacatatttttgactaagttaaatgaatgaagtttacctagcttgattctaaagtcatcagttctttgctgacttagcctgttggcatcttgcattttcaattgtcaggataacaagttgtcgtcatcttgctgtttctaggttgataaaatattttgtgtgagagcgctaaaatactagatattttgctaatattactatccttataatttgaactaatgagccttcataaatgtgagattaatttcatttaataatttatttttggtaacatcagtttgagaaatatgtgttccttaggccttaactactgatttgccataaataatttttttaactaggaaataccctgatttctaccacacatagtagtagaatttttaccttgctctattattttaaacattgaataccaaagaatttgattacttaaagatgttatcaaatgccaaaaggttacataacaatgagaagaatttgccaaatcatgttgaagacatttttgttatcaaatatttacaatagttgggaaaagaatttcctagggtgagaatctagtatgtacttcagcaaaaacaaaaacaaagaaacaaaccttatttattccttggaaacttgtgcgtaaaataaggagaattatataccaatgctaacctcttatctagtatgctttcagaatttatttgccagtatgatatcacagatactgtatataaaaatatacccccatttttacctagtaatacatctatgtgtagtatttgagtaaacaattatgtagtatcacatagaaggagaaaatcaggtcttttatgttagacataccaggtttcaaatcccagttctgttacttagctgtataactctggaaaagttactttttgaaagcccacttcctcagcagtaaagggataattttatgttcaaagagcagtcatgggaatcaaataagatgatatatgtgaatatgccagatacatagtaagttctgagcaaacagaagttcaagtggagacgtactttgcgctatgtgcagctttgtcaagaacagtgtgaactgatgtgctagcatatctttcaaagagaagaatgaatgaataagctagaatttaaaagtttaaaattatttggtatgctttttttatttcattaaaaccacacagatatacacatcatcacttatttttattttatctccaagtttatgtttagcttattaagaataacattgttgaccagacacggtggctcatgcctgtaatcccagcactttgggatactgaggtgtgcagattgcttgaggtcacgagttcaagaccagctggccaacatagtgaaaccccatctctactaaaaatacaaaaattagctgggcatggtggcaggtgcctgtaatctcagctacttgggaggctgaggcaggagaatcacttaaacctgggaggtggaggttgcagtgagcagagatcatgccagtatactccagcctgctcaacagagtgagattctgtctcaaacaaacaaacaaacaaacaaaacattgttataatacctgaattgtacaaatcagctttcatagcacttttcaaatgtgaactactgtttcagcccaatattcatatttgtttggcaggtacacattttaaaaacattttaaaacaaagtccctgataattcacttttatattttactatgtaaaataagtgactgcttcacagaccggcgggttaatagcacttgatgtgggaaggtcaaagagcaaatacagaaatcttttcctgtaataattattaggaggaaaggaaaggagtcagaactgagggcagttggtttggatcatcccccatatgaaccccttcctatatttgggatatttcctacaatttcagtcttactaggaggcagggcccatctttgtacaaaagccccccaagaaggccaaatacttgcttcctcccctattgcctttggcagctacactagtcaatcagttgttcccacctatgacttttaatctggattgacggtagcacagaagctgagactggagaattcattcttgtaggaacagcaatattttgtttccaagaataccagtactgattttcagttttccagtttgtatttataatgtttcatcatgtattaaggaaataaattaatttctctttaatagtgtagttagtactttttttctattttgaacttttgcaactagataaaataaagttgggttagcctctcaccaaggttgttggtatattttttccccagaattttagcagcttgttactaagtcttatttgaatatataataatgcttgcccttgatatttcttttgtcatagaatatatatatctaaaacagatgccaagggttgaggtacaagttcatggttctgcaaccaataatagagccttttttaaaactaaaatatgtttgcagtatgaattttttggatgtatagtctcacatatacatttatgtgcatttattaacatttatgtgccatctttttaactagaatattcctgcaaaaaaaaaaaatcccttgcattttaagtcaggtgagtttgtttgtttgtttgtttcagtaggaaggctataaagaaggatatggaatactctttggccaccaaagaaaaatagcctgccaagaccttgagtaaataagaaaactccaaatgaaactatctgtattgtccattcttatgctgctataaagaactgccagagactgggtaatttgcaaaggaaagaggtttaattgactcacacttctgcagggctgggcaggcctcaggaaacttgcaatcatggcagaaggagaagcaaacatgtccttcttcacatggcagcaggagagagaagtgctgagcaaacagggataagccctttataaaaccatcagatctcatgagaactcactcagtatcacaagaacagcataggggtaaccccatgattcagttacctcctactgggtccctcctatgacaagtaaggattatgggaactacaattcaaggtgagatttgggtgggtacacagccaaaccgtatcattctgccctggcccctcccaaatctcatgtcctcacatttcaaaacacaatcatgcctttccaggagtcccccagagtctgagctcattccatcattaaccaaaaagtccaagtccaaagtctcatttgagacaaggaaagtcccttccacctatcagcctgtaaaatcaaaagcaagttagttacttcctagatacagtgggatagaggcattgagtatatatacccattccaaatgggagaaattggccaaaacaaagaggctacaggcaccatccaaatccataatccaatagggtagtcattaaaccttaaagttccaaaatgatctcctttgactccatgtttcacaccctggtcacgctgatgcacgaggtgggctcctacagccttgcgcagctccacccctgtggctttgcaggatacagtgccccccccggtcagctgccatcatgggttggcattgagtgtctgcggtttctccaggagcacagtgcaagctgttcatttatctaccattctggggtctggaggatgatggccctcttctcacagctccactaggtagtgtcccagtggggactctgtgtggggctctgacctgccctagcagatgttctccatgagggttctgcccctgcagcaaacttctgcttggacatccagatgtttccatacatcctctgaaatctaggtggaggttcccaaacatcctctgaaatctaggtggaggttcccaaacctcaatttttgatttttatgtacccacaggctcaacaccacgtgaaagctgccaaggcttgggatttgcactctctgaagctacagcccaagctgtaccttggccctttttagccatggctggaacagctgggatgcagggcatcaagtccctaggctgcaggcagcatgggggcctggggctggcccaggaaataattttgtcctgctagggctctggggagaggctgccatgaaggtctctgacatgccctggagacattttccccattgtcttggtgattaacattcagctccttgttacttatacaaattcctgcagcagacctgaatttctccccagaaaatgggttttcatttcaggaaatttgtacctagtagcctatgtgaatatttgctcagttgaaccaaacagctcttcactggaataaaagaaaatacaatttggctgaaggggaattaaatgaagaatagaagctaatcctgagctttcactgcaatgatttaaataataagcaggaaaccaactattataaattatagtgatgatgtaactgaaaaatatatatatattttaaatcgccagtgactgagagaaaagtgtcaaaaacttgttacagtaattatattaaatactacattttgcattgttttgccagatattgataaattctggttcctttcttttgaaaaagtagcaggatcaaagaaaaagtgttgtttctatcgcttctagttagaataacatttgtttttatatacttaagtgtgggattcagaagagaggaaaagataaaagatgcaaaagaggggataatttaggaagaaacacaatagaatccaatgttgtaggaaaaaaccgggttcttttcacacaaccaggaaagattaggctcatagacacatggaagtgtgaggagtggaatttactggatgagaacggaaaaggaaaaacaactcagcaaagtgagatggagtcctgctaacaggttttccacctcacagattgaatcccagcttaccacacaggaagaggagtggccaggcatctcccttctgcaagtggcacgaacttcccgaggctccaccccgtccttccagtgcagaggctggtcagggattctctgaggagcccttttaacttggttgtctcaccaatatataagtgaaggagttaaccagggaaatagtagctacatttggctgagatcctagagaaagaaaggatgaataatgactgaagatctaatgtacagaagaaagttaaagaagctaggcgggcggatcacgaggtcaggagattgagaccatcctggctaacacggtgaaaccctgtctctactaaaaatataaaaaatcagctgggggtgctggcgggcgcctgtagtcccagctacccaggaggctgtagcaggagaatggtgtgaacctgggaggcggagcttgcagtgagccgagatcgcgccactgcactccagcctgggtgacagagcgagactccgtctcaaaaaaaaaaaaaaagctctaatgaaatgaacttattttttcagtaataagcatttttttcagagacaaatgtaagatactgtctctaaatttacaaatacacacaagtacagaggaagacaagctctaaaataagattgaaactcactatttaaccaaagttgaattgcagatagtttctatggagaatattttcaggagcagaaatgaataaaagtagttgtgagcgatagtgagtgttgcttgctaatggaggccactaacttgaaggtggaccaaacgttacttagcaaagcttggcaattttggaatagttgtggagaagatctcagagtagaggattaacaagatgggcaggtgaagagacaagacgttaccagtacctccactaccccttaccaccactactgctactattactgatcatgatgacaatagcccttatttatttttggcctactattttccaaatagatttatacatatcatcaaatttaagcctcacacccatctttaaaactagattctcagtgagtaaaatgcatttcagaggaatcttttttgcccagagctgttgcctgtggttgtacacatcaaagggggatccagttacattgtatgtgccatatgtggtatatttattacaacaatttttcagcacaaggcaataaagtatcttaaggaagagtattattttaatttgtacaaaggggctgggcttggtggcccacacctgtaatcccagcactttgggaggccaaggcaggcgaatcacttgaggtcaggagcttgaaaccagcctggccgacatgccgaaaccctgtctctactaaaaaaatacaaaaattaggcattgtggtgcacgtaatcccagctactcgggaggctgaggcaaaagaaacacttgaactcaggagatacaggttgcagtgagccaagattgtgcccctgcactccagcctgggcaacagagtgagactctgtctcaaataataataataatttgtacaaaggtatcatattactctggagtggcagcagtatataaaattatatcagtaacagtcccagttttgtttaaaaacacatacatactcagagaaggcttaaagaaagtatactaaaatgttagcattttagtatacttggctatatatcacaggtaatttttatttttattattttgtatactcttgaattttcccagttcccttaaatgaacatattgtttatgatttgcgggttgctgatagggagtggaggtgattgctggagtagttttaagaacagttttctagacatgacagtaaatggtagcattctgcttcatcacttacacttctcccaacccatccaataaatatccgtaatgttctgaaaactcagtatttatttgctttacatttctttagagtttaactctccaatattacacgtaaacttttaaaactcaggtatcggccaggcacggtggctggctcacgcctgtaatcccaacactttggaaggccgaggcgggtggatcacaaggtcaggagttcgagaccagtctggccaacatggcgaaaccccgtcttgcctaaaaatacaaaaattagctgggcgtggtggcaggtgcctgtagtcccagctacttgggaggctgaggcaggagaatcgcttgaacccgggaggcagaagttgcattgagtcgagatcgcaccattgctctccagcctgggtgacagagcaagactctgtctcataaataaataaaattcaggtagttcatttaatggatttggaacccttaactacttttcaccttcatgtgattattgcaaccagcttcattcatagttagattagaactttaccttgaaccaccacaacaatcaatgaatagcttttatgactagagtagttagatagagagaaaatagacttggaatgaagaaaagagtagtagattggagagaaaaatagactctgaggacagatagactaatgaacacttaaaaatatctgttttaaaatcatacatagttgtgtatatttagtaattaaaattgatttaaggaagtgctatcctttttcctatggctgctacattcaccatttttattgttgcaaataaacttgattaattgtatgtattgaaaaatagtttagaaatagacattgtgaatagtgagtagtagtacatttgggttttggtttctgtgtatatgtgtgcacgtgtgtgcagactttatattgcaattaatgatttaatagtatttaggtaatgtcttaacaagaaatgcctccttgtggcaataactagtatgtataacagaactcaaatcatatttcatattaatgaaatagcattgtgagttctgagaattaaacgaaattctaaaacaaaatgtatttactgattttagcctcacaatatacttttgtaggtatttatatagatgcatgtgatggaaattaaatatataacttactctttctgacattgtgttatataattcagtatttaattacttttttgattaaattttattttaaaatattagtcattcctgaaggaatattaatttgggatactagatatttgttacacgttaaaaactggttcaaatatagatatgttaatatgacagccataaaaagtcaaatcctaagagatctttgctgtagatcttaaagatattgattatggccaggtgctgtggctcatacctgtaatcccagcactttgggaggccaaggcgggcagatcatgaggtcaggaattcgagaccagcctggccaacatggtgaaaccccgtctctactaaaaatacaaaaattagccgcgcatggtggcatgtgcttgtagtcccaggtactcgggaggctgaagcagaagaagcacttgaacccaggaggtggaggttgcagtgagccgagatcgcaccactgcactccagcctggcgacagagcgagactccgtctcaaaaaaaaaaaaaaaaattgattgcacaaatatttgagttactcattagtaattgaagccttttaatacattctttgctgtctagattccactgttctctctcatttccctactgtctaataaaggagaataaaatctgactttcttcagttttgtgtgctttgccacatgcccactcagacatcatagggtatgtgctggaggagtgagagatgggacttaaaaacatggacagacatataaatgtgaacttaaaaggcagacttactaaaacttatagaatttgaactgttggattggatatgcttgagttattatatgtaatatgaaatctagtaaatgcttgagaaatttatgaaagtacagtagagtatggtatttgtttataagataatgttctatggtgtttttaatgatatttcattcacttttaagagatttttagtcagccttcattgaaggtagggaattatgaataagggatgttaaaacaatttaccaaaagtgttcagtacaactgatgattccacttggaaatataagcagagaaatttttgaaatagtttcaaaatatacttgaatacatccaagtgtctactacttttattttttataggtggtttcagacaccctcacaggttttctaccatgcagcaactgaacatggaggaaaagatgtatatccagggcagtgtctttgggaaggttgtgagccttttcagcgacagcggttttcttttattacccacttgcaggtacactttttaaatactatttgatcagtaactcatttgactgcattaaagattttgacgtgccattctcttgcttcctcttcctcaaaaaggataagcactgttcaaaggatgccctacttgcaggattaaaacaagatgaaccaggacaagcaggaagtcagaagtcttctaccaagtaaggaaaatgagtttacttcctgttgtacatacaaaaagaaactaggcaaaacacaagaaaatgaaacgcaacttagcatattaggagaccagaaacctgggttctagtccagctctgccatgaaccagcaatgtgaccctgttcaaattgcttagattctcttggcatcacttttccttttggctggacaatgtggtctgtaagttacctttcagctctaacactgattctgttttgtagactagtcagtcattggaagtaatgacagatgatatatgagaaatgctttgtaaactaaaagtactgtgtatggttcttttttctgtaaaagtaatcatctatttgataatggcaaagagatttcatatcttgtcattatcatatatatatatatacacacacatataaacatacactagtttacagtttaaagattgttttcaggttatcttatttaatattcagaattagcttaaaataatttaatattcagaattagtaaaaatatatcagaaatacccctgcttttcagatgtgaaaagaaatattgaaagtcatgcagccagttacagtgtcagaaatagggtttcctcatatacgagtcagcatctccattgctatctcaccagagcacacagataatgatgcactatatctgcttggtgaaagaaatctacagtagtttgaatcttattttacataaaatcatctctgcagttcttccattctgtatctttcataaataacagaactatagtgaaaggattgattgaaattataaactaataatgaaatttaagatatgtaagtaatagttggaaatgtggtatttagcataattccatgttatcataccatgttttcttggatgaccagtgtcagtacattcttaggtaatattactttactcttaggtaccatttagaaataatttgtagcaaaaattgtagacttttcttctttgttaaaatgttcacattatattcaaagatgagaaggctataacttcgatgctacgttgaatttgtcttgattgcatacttacccaatacagtaactttaaagatggaacatctgtttgctttaaaattgatagattggaaaataaaagacttgaaactttaccttgatactaagcgcccctttgcctaggctgtcacagagcataaacgttaatgctagaccattggacctttagtcaccctgtaaacacgattttaaaataaccagcttaaaggggttggcagggtggtcatagttgtcagtctgtctgcagtatcacgttaattctctctctctctctctctctgatcaatttaggcagccaactgtagggggcacaagctcaactcctagagcacaaaaggccattgtgaatcatcccagtgctgcacttatggctctgaggagaggatcaagaaaccttgtctttcgagattttacagtaagcatgccttgaaacccttatctgtaaaagtctgagtcctgtatgatttagatctttattcttttttttcctttctttttaaggatgaaaaagagggaccaataactaaacacatccgactaacagctgccttaatattaaaaaatattggtaaatattcagaatgtggtcgcaggtgagtaatatgttttctgtagccaaagtgaatttagtttattttatttttacatataagttaataaaattagataactgtattttcttcattgtttttctcatcaattttgcaaatacatccaaaagtttatgcctaggtcaggccatgatgagctcttaaaagtcaaaaataaatagaagttaaaacaaccaaaaggtggtctcttaagttgttttattaagttaatttgtcttactgaccatataatttagaacaaaaagcagctgtactaaagaggaaacttaggagtttattggggaaaacaaaggaatttgatcatttgaatcacgtggagtccaaatgaaattcagtttgacacctggcattttcatgtacccatcaatggcataaataatgttaaggtatgtgtataatactctgaagttttaaaacttaactttccaatggatttaagcaaaagaaaacccaggattttgtagatctacagaaactaggagggataactcattaattcgtgagagagcaaatatagaatattctgtcaataccttgtcttccttagttacttttctagaattcctcctacatcttcaattgaccagtcttgggccgcctctctgcgaaattgtcctcagatgcatcttgtgttcctgatagtcactttctatctcaggccctccctttcacataatattagttccatctccttaatgtattttgaatccatgttagttcttccctacaccactattttaccttgtcttacgtcttttatgatattttttttgcaatgacctttaaactgaattttctaagcataaaaatagtggtatcaattataaaaagaaaatgaatttgactatattgttttaagatttctctaagtggaaggtgaataacatttaaagctaaagttgaaaagtatttgcaatgacaaatgttactatatttatttaatcaagtataaatgaacaggaaaatttttaacacttgagccaagttttttttagaaaaaaaagaaatataaaggtttagtaaccatatgagaataccagtatcttcatgatttagttcataacatttctttttacttttcttactttatttcccttctaacctcttttttgtttcatagcctacatttcagtgaaactaagccacatgcaagttcctaatcacattgggctctctcaagtcacacttggtacctttgttccaatgctcatactattctccctgcctagaatgccctcctccctgcgttgcccacctattgaatatctgcttatccttcatgattcagttcagacatgagtttctttgtgtagcttttcctttgctctattccccttccctactgagcttgttctcctctatttttataacatgtctgtcttaaaacttttaatctcattgttttgaaaatgtttttttatgtggctttttcccttacagaactatgtgcagagacttcctctgattaatctttgtagcttgaacacttagcacagtgcccaacacattataacctctacctcctattcatcctttaagattcaactcagtggttactgcttcctttcctgatgtcttccttactaccttaaccctgacctggagcacagtacatattccctaatgccccatgtgttgcatgttaccaccttagatgatgagctctttgaaggtagggattcagtattttgatctttgtatctttagtgcctagcatagtgttggcaatatgatagtcattcagtaagtatttgattgatagacaggtggtgggaaattcattttctcctagagttctgatctggaattttttgagacagagtctcgctctatcgcccaggctggagtgcagtggcacgatctcggctcactgcaacctctgcctcctgggtttgagcgattctcctgcctcagcctctcgagtagctgggattatcggctcatgccactatgccgagctaatttttgtatttttagtagcgacagagtttcaccatgttggccagtttggtcttgaactcctgacctcgtgatccacctgcctcggcctcccaaagtgctgggattacaggtgtgagccaccgcacctggccagtaattccatttacaatagcatcaaaaagagtaaaatacttaggagttgtcttaaccaaagagaagatttgtaaactgaaaactacaaaatattactgaaagaaattaaagaatatataaacaactggaaagatttctcatgttcatggattggaagacttaatttaggtgagatgtcagtactaccaaagtattctacagattcagtgcaacccctgtcaacatcccaatgatttttgaaaaaatagaaaaatccagttatgtgtgagtgacacgaggtgagggttgcagatgcagtttcctgttttcatcgtatagacagggcagctctgctgcggagatggtcaatgtgcctaaaacccaaagaaccttgtgtaagaagtgtggtaagcatcagccttacaaaagtgacacagtatgagaagggcaaggattccctgtatgcccagggaaagaggtgctatgattggaagcagagtggctgtggtgggcagacaaagtcagttttccaaaagaaggctgatgcggtttggctgtgtccccacccagatctcctcttgaattcccacatgttgtgggagggacccggcaggaagtaattgaatcatgggggcacgtctctcctgtgctgttctcattattgtgaataagtctcacgagatccgatggttttaaaaaagggagtgtgcctgcaaaagctctcttgtttgccaccatgtgagacgtacttttcactttccaccataattgtgaggcctccccagccacgtggaactaaaagtccaataaacctctttcttttgtaaattgcccagtcttgggtatgtctttatcagcagcgtgaaaacggactaatacaaaggctaaaaccacgattatgctaagggtggaatgtgttgagcctaacagcagatcaacaggatgctggccattaagagatgcaagcattttgaactgggaggagataaagaagagaaagggccaaatgatccagttctaaatttggggatgtttttcttttcattttgaagataaaacattgaagctatagaaaaaatataggaaaataaatacagtgataatcttactcaaaaaaagaaaaattcgtactagaattcatacgtaatctcaagagaccctgaatagcagaaacaatcttgagaaagaacaatgttgcaggactcccacttctgatttactacaaagctaacataatcaaaacagcgtggtactggcataaagacagccatagagaccaatggaatagaagagagggcccaaaaagtaagtcctcacatatttggtcaaatgattttccataagtatgacaattcttcattcaatgaggaaaagacagtcttttcaacaaatggcatttgaaaaactggatatgtacatcaaaacaatgaagttggacacttaccctgtaccatatataaaaccgtaagactcttagaagaaaacacagggcaaaagctttataatattggatttggcagtgatttcttgggatatgacaccaaagacacagacaataaaaggaaaaccagacaaactgtacttcgtcaaaatttgaagcttgtacatcaaaggatactatcaacagagtaaaaaggcaacccatagaattagacaaaataattgcaagtcacctgtctgagaagaaactaatattcagaatatatagagaatgcctaactactgtgtaaaacagggcagttccttaaaaaaacaaacagaattacctgtttcattcagcagtcccacttctgagtatattcacaaatgaattgaaggcagggaattgaaagatatgtttacaccaatattgatggctattactcataagagacaaaaattggtgtggaagcaacctaagtgtctatcatcgatgatagacaaaatgtggcatgtacatgcaatggaatattactcagtattacaaaggaaaaaacaatttacttatagtaaagttcacgctttttagtgtacagttctatgagtttttgaggtttttttttttatctttgagacggggtctcactcagttgcccagggtgggttgcagcggagcaatcatggctcactgcagtcttgacctctccaggctcaggtgatcctcccatctcagtttttgtgtttttagtagagacgaggtctcaccatgttgtgcagggttgtcttgaacttctgggctcaagcaatccacctgcctcggcccctcaaagtgctaggattacaggcgtgagctactgagcccagcctacaaaggaaaaaaaattctgacatatgctacatatgaataaactttgagaacatcatgccaagtgaaattagcatgacacaaaaggacaaatatatggtatgatttcacttatgagatacctagaagagtcaaatgcatagagacagaaagtagaacagtggttactggggctgggggtagttcaggaatggagagttactgttaagtgggtagagagttccattatgagatgatgaaaaagttgtggagatggatagtggtgatggttgtacaacagtatgaatgtacttaatgccactgaactgtacacttaaaagtggttaaaatagtacgttttatgttatgtatgttttaccacaatggaaaaaaactaaaacacaacaaaggaaggatttggggaaaattggaagtgactgctaatgggtattgggtttcttttaaagatgatgaaaatattctagaattgtggtgatggttgcacaattccgtgaatatactaaaaacgagagaatttttgtttaaatgggtggattgggccagacgcggtggcttatgcctataatcccggcactttgggaggctgaggcgggcggatcatccgaggtcaggagtttgagaccagcctggccagcatggcaaaaccccatctctactaaaaaatataaaaattagctgggcatggtggcgcatgcctgtaatcccagctactcaggctgaggcaggagaatcgcttgaacccaggaggcggatgttgcagtgagctgagatcatgccactgtactccagcctgtgtgacagagcaagattgcatctcaaataaataaatagattgtatagtgtgtgaattatacctcaatgaaggtgttagaaaaaataaattttaaaaaatcaaggcggggcgtggtggctcatgcctgtaatcccagtactttgggaggctgaggcaggtgaatcacgaggtcaagatattgagatcatcctggccaacatggtgaaaccccatctctactaaaaatacaaaaattagctgggcgtggtggcgcgtacctgtagtcccagctactcaggaggctgaggcaggagaatcatttgaacccgtaaggcggaggttgcggtgagccaagatcacaccactgcattccagcctggcgaaagagcaagactctgtctcaaaaaaaaaaaaaaaaaaaaaaaaaaagtaagtgctacaaaagttataaccaggctgggcgtggtggctcacacctgtaatcccagcactttgggaggccaaggcgggcagatcacgaggtcaggagatcaagaccatcctggctaacacagtgaaaccccatctctagtaaaatatacaaaaaaattagctgggcgtggtggcgggcgcctgtagtcccagctactcaggaggctgaggcaggagaatggcgtgaacacaggaggcggagcttgcagtgaaccgagatcccaccactgcactccagcctgggcgacagagcgagattccatctcaaaatatatatatatgtatatatttggttatatatatatatatttggttatatatatatatatggttatatatggttatatatatatggttatatatatatatggttatatatatatggttatatatatatggttttatatatatatatataaccaaatagttccctactttacccccccctcccacctccaaggggggagcctgcaacaatttgagctagtgcaattgctttcatatttcaaaatatgtctatgttactatttcttaacttatctaattttatacatttattgacttcccttttaagaaattggataaacctctcttcttcccactttacttttacctcatcatattattgttccatcacagtcgttgattaaatcttaaatcagatattgttggattgtttgatgttgagccaagtgctatactattatgtttttctttctcttttttatttttattttttgagacagagtctcgctctgtcacccagactggagttccgtggcgtgatctcggctcatttcaacctttgcctcccaggttcaagtgattctcctgcctcagcctcctgagtagctggaactacaggctcccactactacgcctggctaatttttttatttctagtggagatggggtttcaccatgtgggccaggctggtcctcaattcctgacctcaagtgatccacccaccttggcctcccaatgggctgggattacaggtgtgagccaccatacccagcttttttgtctctgtattaggcccataaaaagcatgagtgccatgctttttgcttggctttttacgggcctaatactgattgtaccatatattttaatcagtatctttcaagcctgtcaataagctgtccacatactgaaacacagttgttaaacctctgtcaaattttcatttttagaatatttttttccttgcaaactgctcttctgcagtctagacaggttgctctctggacctggtacacacctcttctcaggaattacctccatgttgaatcccttttcgttgaaacccatttattttcttttcttgttttactctcttcatgcaaaagcatatccttcaatcatttaagaccctacatgcctaaaaatgtctgtaatctacccttactcttgatagttgttggctgtacataacattctagattgaaaaatcatttttctttaaaaacctgagggcattgctttggtgtattctagcaccagctttgctgttgagaagactagtgacattctggttcccatttctttgtatgtgatctgttttcccccctctagaaactgttgtgatctctttatttctgaatattctgaggtttcttgatgatgatgtgtcttcggtgggtgttttgttgttgttttcattgaagtcattatttcattttggtgggtcctttcaatctggagatttatatccttcagtaatgggaacttttctggtatgtttctttttcttttctcttttagctttctgttttctctctgtttaatctattttttggaaatttccttaattttttttttttttttttttttttttttttttttgagacagagtctcgctccgttgcccaggctggaatgcagtggcacgatcttggctcactgcaagctccacctcccaggttcacgccattctcctgcctcatcctctggagtagctgggactacaggcgcccaccaccatgccccgctaatattttgtatatttagtagagacagggtttcacctagttagccaggatggtctcgatctcctgacctcgtgatccgccctcctcagcctcccaaagtgctgggattacaggcatgagccaccacccccagccggaaatttccttaatttttaagagcttgttattggttgccagttgttactattttataacatcctgttcttagtggtgtcttctcatctctctgaggatattaacacctctacttttgtagttttttcccaatctgtgtatggttactctttccttgtaattcctcaaatttctgaggatttgggggtttgcttatcctccgccccccaagacaagagtcttgctctgttacccaggctggagttcagtggggccatcatggctcactgcagcctccaacctcctgggctcaagtgatcctcccaccttagcctcctgagtaattgggaccacaagcatatgccaccatgcccaacagttcattttttaattttctgtaaggtggggggtgggggagggtgtctcactatattgcccaagctggtcttgaactcctcaactcaagtgatccacctgcctcggcctcccaaagtgctgggattacaggcgtgagccaccacgcctagcaaaaaataaatttcttttacccttcgtactgttttgaggagggaatggaaagaaacttgtttaaacttgttttcttagaagctgatttgtatcctaaatggtttttactagtgttgcttagaaattatttttattatctgttaaggatattagagtgacccaatatttattctttgttaaatcatctcaaaaaactaacatgtgaatttagaagttgaaagaatatcattttataaaaaaacaaattaggcatgttttgttttatatcaaaacaaagtgagtgcttaattttttaaaacctcaaaaaattaaacatttatatcaaaaaggaaattattagttactttaaaatcatcctagtgatttcagtttattctttctagttttatccatgcaatattcaaataaaagaatactttttaacatgtgactatcactttgaaaaatatgattttgttaactttttgaaactaaagtcttttttctttctttgttaaaatattcattgattgtggggaaaaactgattgtactttgtaaagttatttttattttgtaaattttttttttttttgagatggagtctcgctctgttgcccaggctggagtgtagtggtgcagtctcggctcactgcaacctctgcctcctgggttcaagcgattctcctgcctcagcctcctgagtagctgggattagtagcctcccaagtagctcctgccaccacgcccagctaattttttgtatttttagtagagatggggtttcaccatgttggccaggctggtctcgaactcctgacctcgtgatccgcctgcctcagcctcccaaagcgttttgtaaatttttaaatcaatttttgtacaactaatttttcttttccagaaagatcttagaaatttcatactttattttaaaagttgttaaataaaattttaaagaaaatcataaagattttataaaacagaagtgtaaagttcagtgaattatcacaaactgaaccactcatataactatctgtccaagttaagaaatagagcaatatcagttgaaatctttcatgttctctccaatctttactccatcctcctctctataagggaccactatcctgatctgtgacaccagaggttcattttgcctgattttgaactttctatatgtgaaatcatacaatattattttcagcattatatttttgagattgattcatgttgttgcatgatagtattttattcatattattgtatttttttctctgcttttgatgggcaaatgggttatttccaatttggggctattaagagtaatgctgctataaacattctaaaccatattctgttttttggccatatacggaacatatttctgttgagtgttttcaaaggattggtgactcataagatgttaaaagtttgctacatgatgccaaccaattccaaaatgattttatcaattgacactctatagaaatgtatgagagtctcagctactccatgtacttgccaacatttggtattgtaattaaaatgtttaattttatccactcttttgagtgtgtgatggtatgtatatatggaaactacataaaactgaaatggcccaaaaaacatgaaaagatgcccaactgtttattcttcagtctcattttttgctcatttcttttcctttgctttactatagtaaaagtgactccagtccctacattaaattttgattttgaatttttgcatcttttccataaacttcttttctacagtgttttttaattcaaaatgtacgtgtcttcatcttctctttttttctcctgtagtttcttttattcggagttattttaatgaaggcaccaaggttcctgggtaatctcatgctggctgatatttttttttaacatttaatataaaatttttcacacataggcaaatttgaaatgtttgcaatgaaattttttatacctgccacctagctattaccatgaatattttagtatacttgctttatcacatatctgtccatttatccatcccacagttctgggtgatttttaccatttttctcagcccccagcatcccttttttttagctagatgatgctcacttttataatctctcattatatagatagccacatcaatattgtgatcttttgggtagaaaatttaagattgataagtttttagaaaacagcttttatggctaatggggcatttaggatatagttaagctagatgtggcttggtttcacttaatgaagactaagaagctttaattatacctacaatataattttaatttcatgtcatcccttaaaagcaaccattttgttcctctccagctgttttctgacaccattttctaaattttctagaaacatgaatgaagattgaaaaagaattttgctgtgcagccttccatatttagaaaggtactatggagaggctgggcgcggtggctcacgcctgtaatcccagcactttgggaggccaaggcgggtggatcacaaggtcaagagatcgagaccgtcctggccaacatggtgaaaccccgtctctactaaaaatacaaaaattagctgggcgtggtggcacacgcctgttgtcccagctacttgggaggctgaggcaggagaatcacttgaacccgggaggtggaggttgcagtgagctaagattgcgccattacactccagcctggcaatagagtgagactccttctcaaaaaaaaaaaaaaaaaaaaaaaaaggtactatgcagaaaaggcaaacagtaatagtcagcctcagtttatccttctagttgtttcccagatgcttccctctcttcctgcaatactatattaacatttacggggtgtggagctatgtattgtttctattttagtttttaaacttgcaaaattcatgataaagagtcatcgctgtgaccttggagactgacaatcttctatatgtttttttgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaaggaaaaaaaaaaaagaactgctgtgggattgtcaaccagcttatctgcaggatgtttcagatctgataaatcctgatggaaactggtatgatcagaattcagtaccatccacattggaatatacatggaatattgtaaaacctacatgagcagatgaaatagaagcattaaatatttttatctatatccaaaaaggagcacatttttatatttacaaaaccgtttaagctggtttgaataatttaaaaaagtttcagcacacctatacccccgatctcagagggggccaccaatatctagctatggatcgtgtgttttgtttagaaatcagtagcttggttttcttacttgagccaatatattttcacttatttattatcataaaaatttaccagtctgaatagatcttgtaaatatttgtgaatagaatgaatacctttcatgccactgcagccactggaaatacattctgtggtgtcctagaagcattattggtaggttctaaagttttctagactttcctgtcaattgtaagtaattgtgatatattctatgcagtggatgaatgttctttaaatttgtgtaaatacttctgcaaaggtactgatgctgtaaagtcaaaacagttttgtggaactgtgatttttttttcttttttctttttttttttctttttttttttgtattatacaccttgtagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttttcccccagcgtgaaatgtatccatttataactgcctattgcctgttctattagcatccaaaaatgtggaaggcctcccaaccaccatttctgctgtgtccttaggatgtgcagtaaaaaatatagacctaacagtttatgttatagaatggctttatttactttggtgactgtttatagtttttaaataaaagactgaacattttcttgagtccttcatttctgagtatgcttaagacatcttaaaaatatagagagaattctaaattcagctgaaggcaaggtataacggtcacctacctatttgattatatgttgattgataacatattaaatagagaacaaataagagaggtcctttacatgacaaatttgcatgaaataagcagattaaccaagtatttatttttcatcttgttataatgcagagcaaatgtagagaacagcaaatgattgatgcagttaaagctcaatatgcctttttttactggatactgtacatttggctaaaagcttttattgtttgatgttgtgtttcttgactgtttattcagaatcacagtgtatccaaatcttcagcttgaatttggaggcagattcttagagtgaaaaagcctcagtttccatattaaaaatgttttaaatattttgattgaattagtaccaatgtaaaatctagtttcttcctgaaggaggatccctggcgctgtcctgccatgtctcaaaggaatgtttgagaaacttcatctaatattagttataaggttgtggaatttatgcttggcccaccttccaagactggcactgcccaacagacaccgctgaaatcatgtgggtatccctaggatggccttcagagccctcaaacttacaagcacctggtagttgacatcatatggggaattttctattcaccgtacttatccaaaaatctcttttaaaaagtaaatttgtgcaacaacgtttatttgaaagataatgtcttctcaaaatcagaaactgcagtggtaattaaattaatagaaaagagaacaaactgcaggtttagaaaaatggttttcatattcaccattcttccacctcattgaattgcatgctgtagttctagcttttctgctataatatgtaaatatgactgtagccttttaagcttcagtctcagcagagaatttcctaaatgcgtttgacctaatgaaactgatcatggcttcccacttaggtttttcttcttatagctttatagaactatataataatatggacttgctgtgtaatggaattaaagtgcttttgcacaataagttctgcaaaaccctctcattcatgaaaaggtgctccttgctagacagaaacttgctgatttacagtattgttatttttgtctaaagttctgtaaatacatgctttaatgttatctttgagaaatctatgtaaataatatagtctacaacatagagactgtataattctgtgttatatatgtgcctagtgctctgttggcactcaataaattttaagtaacaaaattgataatcatatagcgaaggcatatttttcttccaagctcaagtcaggattgtgactatatattaatgagactcagtaatccaacccacacctgagaactcgtctcattactttatagtcatgtcatgtatgtttttttaaccatgaaatgacaataaaatgatttttaaaatgagaatgttttggataagtgacttctgtcctgatcttaaccactgctgttaaataccaaacagaggaaacatgatgcaaagcagaagctgctaaagagcagaagtggagctatggggttaaccacgtgggacacctggcactgtcactgttaccaaatagtaagttaaatgagaacaaaatccagtatctattaggaaattttagccgatcactttcatactgcttgactcttctcagactcatacagcagtcagtcatacgacaactacactagccttctccagaggcaacaaaacaaatgaagacagtaccactgtctaattacattactacactggtatttgtaactctttcatttcaattatatagcctcatttcctattggtaaaaattaagtccaggattgccttgtgtgtggataagaaacactaagacacactggcatatacttaagtagatccatttactttgattaataagactacatttaaatattaaaagaaaaggctattattaagtcaagtcctggctcctgtggattttagtctgagatacaacccacattgtatacatttatttaaaacataaactgcctttagaaagtaacttaatcaaaaagttaaattatatgaaaagcctcattcccatctgcttcaccacccgtgtcccccaaccagataaccactgttcacatttcttgagtacatctctggtgttgattacatacaagtgaattcaatattttctcttttttacacaaaaatatgtcataccataaataatatgccgtactttcttgaaattttaatattttaagtttattccatattggtacatagctttctcatccttcttacagctatacaatatagttttccattgtatgggtatactatatttaactagaccccatatcgatggacatttaaattgtttccaaaatttaaggtgctgttttaaactagtcactaatactttgctgaacactactctgtcaggcactgtgctaagcattttacatgtattgtttcagccttcacaacagcccaatgtaatagctaatatttcacaagtggggaaaagagggttaagatgagtaagtaccttgaccaggttcttaacagcaagtaagtggttaaactatccagctcctctgaagcctagttatgaagagtaattgggagaattctttcctcagagagtcagactcaaggccaggagtctgctagtataaacactatgtacccctaattttggtgtggatcttttcgtttgtatttgcctcattgttcctagtattttctttctttgcattttgtctttttaagattttccataattcttcagatttcccaagtatttcattcattaacttggcaccactttatacagccagaaaaattttctggaaatacccttgacaaagggccatttctaagacaaatatttatagtaagttgaaaccacagtttctaatcaactatccgtctggtgcctagttcaaacaaccatctgctgactcctttggaaagagtcatactccttaacaatagtatgatgttaataggattttccccagcgtacacctttaaatcaccttcaatgcacaatactgttggagtacctatgctgctgctttggaaggcggagacatcctgctctgaaggtagcccaaacttacaaataatacccaatacgataaaagataaaaacatgtgccataaggaaattataaacagtttggggagtttaatcatgtagcaggcttcatttgatgctgagttggaaagggaaagtaggaaaggctttgtggagaaggcaaaatgtctttttctttttaagtactttgtattattttttatcttttatttctttatttttaagacagggtctggctctgtcacccatactgaagtgcagtggtgtaatctcggctcactgcaacctccgcctcccaggctcaagcggtcctcccacttcagcctcctgagttagctgggattacaggtgcgagccaccatgcctggctaatttttgtgtttatttatttttttgtagagatagtattttgccatgtcgcccatactggtcttgaactcctgacctcaagcaatccacccacctcggtcttccaaggtgctgggattagaggtgtgagccaccgcgcccgacccctgagaagggaaaatgtctttttaatgagagattctaagggctagtagaaatttgacagacctcagccaggcatggtggttcgcacctataattccagcacattgggacgctgaggcaggaagattgctcaagctcaggaatttgagaccaacttggttaacatggtgcagactttgtctctacaaaaaataagaaaattagctgggtgtggtggtgcacacctgtggttccaactactggagaggatgaagcatgtggatatttgagcccaggaggttgaagctacagtgaactgtgtttgtgccactccactccagcctgggcaacagagtgagaccttgtctcaaaataataataaaatagaaatggacagacctaatggtagtaagagagtttgagtttggagaggtcttgttgaggatgagaggaggttatagattgacaagtgcaggggttaactagtaagaggtcaaagctataaacattctccacacacaaaatgcacaaaaatgaaactcgacaatatcagggaggagcagagtgagatgatagaaatgtcttggccacctagtaaacagaactaacagggccccacaaagtgtagttttgaaatcaaatgtagtaagtaagtttaaccaacacatttggttgagaggggcttcggaatctctggactatacattatgacttccctaaactggagaaaacgtttagcctttgcttttgagaagatgtattgatttgaattatcaaatatgatgctctatttatagctaaactgtgaaagacaaaactagactggctttcaggttgaccttttaaacgaaatcacttttgcaaggcagctgcctgggacaggcacttttctaaattgtacaaccattgaaaatgagtttgtttttcatctttaggtagaaaatggcatggttaaagtaacttagaaaaagaaaggacctgaaagttggtgcaatctaatacagaaagcattgtttttgactgactgattggctatagagacaaggcctcactatgttgcctaggctggtctcaactcctgggctcaagcaatcctactgccttggcatcccaaagtgctgggatttacaggcgtgagccaccatgcctggctgagcactatttgaaatgaacacacaacttcaatcttgtgcagagtaggcccttgaatgtttgttgctttttacttatttctggttcctaacagatgtatgtcttatgtgatgcaaaattattctttgaatggagattttttttcccccttcaagttcatggattttctttttgcctttgggactggattgagagaatgggaaaaatgtagatttgactatcaaatctaaaacaatggccttgggttaattgctagccccttggtactttctttaaaaacttttaaattatgaaatataacacatataacaaagtgagtaaaatgtagagtagagctttatttttatgtttttagagatagggtcttgctatgttgctcaggctggtcttgaactcctggcctgaagcaatcctcctgcctcaacctcccgagtagctgggattacaggcatgactcacagtgcctggcttattgttttacagcaaaccctatgtagccgttgcccagatcaagaaaagaccttgatagtccccccagaagcctctcatgtcccatctcaatcaaagcccctaaacccccatcagtaaccactatctgaattttcaaggcaactgcttctattctttatgtttttttttttacctttactacgtaagtatggatctctaaacactataatttagttttgtcaatttttgaactattacagaaatacagtattggattatattttgtgtctatctttcactcagcttggttgtgagattcacctatattgttggatgtagcaatggttcccttatttttattgctgaatattcccaatactgatggcatttagattgtttctaatttggggcaactacatatgatgctataaacattctactcgtctcttgatgcactggggcatgtgtttctgttggacattaacttaggagcggaatttcccttattatctagtaagataattccacagagcagtctggaagtgtgcaaatggcaagtacaaatacaatccaaattaggttctgagggcgaatgggactaaccagaggtgcctcaaaggaagtcagattgagagccataggcaagaggatggctaagcagctgtgcagtcctcaccttcagcctgagcagactcattcctttgtaattagattttgtttggagttctgctgtaaagtttgttggcaatatggcatacaggaattacgtggctcatcacaagtatataattaatattagttgaattagatgattaatttagaagtcagcaggatgatctgaaagactaaatagggtgaccacttagtttattatatttataatatttgactgattatgaggacttcacacactttggagcaggataatggaaacagaaatatacagatgttatttctagtgcccaaactgctagataggttggaggaagggtcagtgttaggacatggatacttcacaaaggaaatatcgctgggcagaccatgtaatgagctgagaggaatattataagatggttgagagcattttttccattctaaaatgaagtaaataatggaacctacttttcaaggttgttaggaaaattgaagtagataatacaataaaagtcttggcacagagccagtaataagtgctccgtgttagccactgctgttggtaattaagattgactgtacttagctagcagtaaggagaacctgctatcagctttgaaagtgtataagaaaaagatttctggaaattatttgaaaaagcaatactacaatgataattttagaagctataactccgttaggcaagagtgtaaataaaaatcttgttaaattaagtatacgcatcctaactttaccaacagctgggttcctacaagaggttgattgcactgtgaactactgtgtgaacatcctggaaatgtctgacatcttgtctctgaaggtgctgttttgccatcttcctagtgcttagtgggctcaaaattccagataatgtggtagattcgaatttgaaaacaatgttaaaaagagttacgtgtgtgtacaaactatcaggtgctgttgatgtttcagagagcagggatagaatccaaatggctttcaaacaagctgtgatctggccaggcatagtggctcacacctgcaatcccagcattttgggaggctgagtcaggtggattgcttgagcccaggagtttgagaccagcctgggcaacatggtgaaacctcatttctacaaaaatacaaaaagtagcatgatagcacatgcctgtagttccagctatttgggagactgaggtgggaggatcacttaaacccacgaggttgagcctacagtgagctgtgatcatgcccctgcactccagcctcagcgatagagcaagactgtctcaaaaagagaacaagttgtaatctaattaattatgttattctaaccaaacagctgtgatctgcaggggatctaaaaaagttacatggtttgcttcttggctgcacattagactccacctgggagattttaaaataccccatccccagagacagatataattggtctggggtgggcctgtgcttgtgcatggccttttataaaactctctatatgaccctaagtaggcagctagaagttaagttgcatttcagggatgcaacagggatgaaagcagtgagaaaacagtcctggttatataggcaggaatttccccaagtaaatgtggaggaaatttcaagacattcccatctattatctcaatcctcagtaaccctgcaaggtagataggcagcacccctttttataggcaattcaggttcagagatagcatactggggccctctgtgatacccctgcttatcaccagaaatggattatcttctgtggtactcacaggattggtgggcagtatgctcagctagttatggtttgggaagtccactgcttcatgactaaagcatttctcaccccacaaagccagtgcgtgctgactacttagactagaactcatcagttgccagggaagttaagctcctccctgaggagctgagtgtgaggagccaccagacacttgcccatcacagtcagatgctcaagcatctgagaactcagaccagttctggtgtgggaaactttcagctcttcagcctagagcaaagccttcaccccgtctctcaccctcataccacaagcagtgaggcctgcaattttgaagatagtttttctgatcatgcaatttttattaactgtgtgaaatttgggagacaaaagcatacaggggaaaaaatcctctattacccagaaacaacttctattaataatatgtatttttttgccttaaagtttttaaagaaagttaggataatggtatataatttgtgtcctattattttttctccatttagtattaaaggagtacattcttccatttcccgccccccggaaacatttaaaatagctgtaaaatactttcatatgaatgaaccatagtttatgttaaccatccctctccagttttccactaatactggaaagaaatatgtggaccaggatgtttatattatgaaaagaatatataatccctttaagtttctttatacatattttcaaattgcctttcagaaaaattgtacatatttgcacccctctgcccacagtagtgtttgatcgtggcactcttgccataattggaaattatcaattcgacaaaacttaaaacactgttgtttaatgtttttgcttgaacacttcttaagtaagtttttttgtttttgagacgacagaatttcgctcttgttgcccaggctggaatgcaatggcgcgatcttggctcaccacaacctctgcctcccaggttcaagtgattctcgtgcctcagcctcccaagtagctaggattacaggcatgcgccactacgcccggctaattttgtatttttaatagaaacgggatttatccatgttggtcaggctgatctggaactcctgacctcaggtgacctgcccgccttggcctcccaaagtgctgggattacaggcataagccaccgcgcccggcccacttctcttgttctaaccgcttgtattgagccattgaaacattttgagcactcatttcaaaatgcaaatctgatcatgtcaaacacctccagtttaaaagcttttccttacaaaatatgctgccaaaaaactcctcccaatcttcattccagccattccaggtttagagatgccatgctatctctggctagacccactcttgccccattccctctgccagctcatcctctccctgcctagctaccgtttggctcttagctgaagtgtcaacccccttcccaccccaagggtcctccctgaccaatcttagattttataaacccatcagattcttggagcatctggttgtcctatttgcaccctcatcagttatatatgtacctgttttccccaccaagcatatggctccatgatgatactgttttgctctctcttctctactgtgtagcacacacacaggctggcattatctgttgaagaaatgatgtggaataatttgaccaaaactgtactattggatgattagtctatagtttctgagatgaaactggtttccgcagaatttaagtaagagttaaaactactgaaaaaagtcaaaggtaacatggctggaaactggagctggagtttattgtaaaggaggaattgatgcacaggagatagcaactgtttgagaaaatgaaaacagggtgagaaaagcaaataattcactaaagatggcttcatggttaaatgtttaatatctccaaaataggaaatatgggagtgctattaaaaagtcaaaaatgaggccaggcaccatggcgcatgcctataatcccagcactttgggaggccaaggcaggacaattgcttgagctcaggagtttgagaccagcctgggcaccagagcaagatcctgtctctataaaattaaaaaaatcagatgggcggagtggcctctgcctgtagtcccagctacttggaaggctgaggtgtaaagatcacttgagcccaggaggttgaggctgcagtgagccaagatcatgccactgcactccaggctgggcaacaaagtgagactgtctccaaaaaaaaaagtaaaaaatgagtggacctgaatagacacatgataaatgtctcttcctctcactttccccatgctgttttcacttctctctatcagctatcattcctgcgttactatacaaatgttaagtttatgtatgtgaactcaacaatgtaacatcccgaagtctagcatggactttgatgtgaatcttggctccattaagtagctgtgcaactaggtaactcagttaatcctttatgcatctcaattttttcgtcaaattactagaattggttttacaaatgaaatgtggtaatacatatgaaatgtttgacagaatgcctagcacatactaaaagcttaatatggtaatatttaccgtactattccttttagaatactggggtaagattaaacctgacaagacatcaagaatctaagaattccttatacacagtaggcatgcattgtttgatgaacaactgaatgttcaataagaccgatgaacaggccactggctcatgcctgtaatcccagcactttgggaggctgaggcaggtggactgcttgaatccaggagtttgagaccagcctgggcaacacagcaaaaccccatctctacaaaaaatacaaaaattagtcgggcgtggtggtgcacacctgtagtcccagctactcaggaggctgaggtgggaggactgcttgagcctgggaggttgaggctgcagtgagcagtgattgtgccactgcactcttgcctgggcaacaaagtgagactcttgtctcaaaaaaaaaaaaaaaaaaaaaaattgttcagcgattaagtcacaaagaagggtgttcattaaagcgttgtaatagccaaaacctgcacataacttaaatggccaccaatagaggaacatgatgtagccattataaagaacatggcacatttatatgtactgacattagaatatatcttcaatttattaagggaactagagatgcagaacaatttacaaaatataattctatgctgggaaaaatgatctgtgcaacctgctttcctgcaactttacaaaacattttgttgttgagacagtatcttgctctaacacccaggctggagtgcagtggcacaattttggctcactgcaacctctgcctcctgggctcaagcaattctcccacctcagcctcccaagtatcttgagaccacaggtatacaccaccacacctggcaaacttctttattttttgtagagacggggtcttgctatgttacccagactggtttccaactcctgagctcaagcagtcctcctggcttggcctcccaaagtgctgggattacaggcaggaaccaccctgctgccaagttaaaaaaaattttgtaaacggattaaagagtttggaaatatatacaaacctctgtagtggttctctggatagaaaaatcagcttaagaaaatgaagtttcacagtatatgtaattcaatttttagaaagtatgcatcatgtatgtttaattacatttaaaagattttttatgataaaatattctagaatcccaagaaaatctgaaattggtagagactgtttatacgtcttatttatattttactaatttatattcataaaagtaacttaggccaggcacagtggctcatgcctgtaatcccagcactttgggaggctgaggcgggcggatcacgagttcaggagatcgagaccatcctaacacggtgaaatcccgtctctactaaaaacacaaaacattagccgggtgcggtggcaggcgcttgtagtcccagctacttgggggctaaggcaggagaatggagtgaacccgggaggtggagcttgcagtgagccgagatagcgccactgcagtccggcctgggcgacagagcgagactccgtctcaaagaaaaaaggcaacttaatatccaacagtggaggattcttttactggtacagtcacgttatagactactatacagccactgggccaggtgtggtggctcacacctgtaaatcaagcactttgggaggctgggcaggcagatcacttgaggtcaggaattcgagaccaacatggtgaaacctcgtctccactaaaaatacaaaaattagccaggcgtggtgtcaggtgcctgtaatcccagctactcaagaggccaaggcaggagaattgcttgaacccggaaggtggagggtgcagtgagctgagatggcgccactgcattccagcctgggcaacagagcgagactccatctcaaaaaaagaaaaaaaaagagaatattatacagccagtataaatcatgctgtaatttttactaaaatggaaagttctcagtacgtcaagtgaaaatgaaaggttacaacatattatgtgcagtttgcttggcattagttattacctttggtaggattacaggtgatttttctcctttttcagtctcttcttttacacatttactaaagtttttctaatttcttacaataattatgtaatcaggggaaaatgccattaaaatatatgcttatagctaactctaagcttgctttagagcttgggtattacgtaaccatgatgcgaatgactggtacaaatccaagtaacacttcaatacgtttgtaagggattataattgaaaagtcaccattcccctggaaccttaataataaaatgttaaagacattagtttatcaaaagaatttattagaaaatattacacactacatacatatttatttaagagtataatttcagtagacagcactccaacttcataatacaaacaatatctcatggaccctggggcaatcactgtgcttctgaagctacatcttttggatggaacattccagcagtacacactgtggccatttaaaggaaggtaagagaaaaaaatgtgataattaccaaaacaaattttaaaaagcacaaaacttttggaatgttaatggataactactattagtctcaaaattctaggcatttctataaaacattggtcaatgtgactagtaagttaacgggaccaaggtttcaaagatcaatactgaaccttgataaataataagaggaaatgtaactccacaaaatgtttctgattaagtttgtgcccatgcaaaattaacataaatttcttaactcaagaatgaggaatattaaagcaatgtattttttcaacataaagcatgcattttctaatacattcttaaacatttcaaaattttaaaagttcgaattctaatcaagtagctattaatgcagtctaaccagtgccccaaatcagacatggaacacacacttgttactgtcacggaaataattcatgggagtgctactaaagatatatgagacttcaactcttgaccacatcactttttctccaaaactttagaacttgtttgcaaaagctaaatggtataaaacacattttaaaatgtcacccaattctcaaatgtcactgaaagaaaatgcaggaaaagtatgtattgtgtgattaatcagcttaggcttaactcaaaatactttcaatgttcacaaaattgtttctagagttctaatctaaaacaactaaggaggtgtgccttgatattctgaaacactgtcttaatactttattagaagaaatatgcttgaaatttctttaccataatctaaacgcaaactttaaaaatatataccagtagaataccatattacaaatgcccagaaatgtagaataaaggtcaaaaactgcttggaaatatttttatgattacactcataacaacaaagcttatgaactagcacaatcattatgggaccaacatttcaaaatattttgcctatcaaagctagcaccaggaaaagtattatgcacataaaattgagaaacagataatctttactttagaaaagcacagttctacagagtattgctctggctaaatagtttagctagtaaaaaggtcagtttatctcactgaggcatgtatctccttggatctattaacttatctgaagaactttccaggtacttggtatgtactgaaaattcttactggaatcagtttatcatggagaaaacctactgttctttcaagatgccagttaaaataatggcacaataaacattttaaacttaccttttataaaaactgagatattctagtattaaaaagagaaaaaaaaaaaaacccaaatccctaatccctgaaaggctaaccaggactccattatttaaatttcccctctgtttctaaaacacaggttttactgtctagaattttgcaacatggctaatggctaccacctggtcaccaaattaacacttcattcattgtaaagcatttggggattttcaagtgtgaaaatatttcatcagtgattagataaacaacaactttacgccagtgccatgagtcttgtaattcttagccccaaggaagggaggataacagcctaacagcaattctcgaattggcacaaataatttatcgtctgcaacgggtagaagaagatactatgaaagaacataatttctacaaagtcaacacttttttttttcttttttttgagacggagatttgctcctgttgcccaggctggagtgcaatggcatggtctcggctcactgcaatccccgcctcccgggttcaactgattctcctgcctcagcctctcgcatagctgggattacaggcgcccaccaccacgcctggctaatttttgtatttttagtagagacgggatttcaccatgttggccaggctggtctcgaactcctgacctcaggtgatccgccacctcggcctcccaaagtgctgggattacaggcgtgagccatcatgcccggccgaaagtcaacaatttttccaaatctttttcctcaaagtcttcaacaaagactttgaactgccaaagttgtaatctagtaagtcaaactgcttatctcaattaggggtaaacaaaggcacaaaagaaaaacaagcagcataacctttatttggtcatacaataggtgaagagtgtctcaatgttttgaacactaaattttactcgtgataattttttttctatctaggcaatttattcagatatgtgctttaaaaatacacattaggaactttgcaactgatatgttctatttaatattagaaacatttttcatggtaatacattatttaactttctataattagagggaaaaaatcataaagatcatactttacattttaacctgacagaataaatgcattatatatatctctttgaaaaccagtgcacttagaagtttctaatttatgcactccattgccctaatcaaaaagctatacattttccagtatccacactataacacagtcctagtaaagatgcacattcctttaaaccctttactttcccttgaattttgtgggggagggtggaggggaaggaaggatacagaagttgcagtgcagacctatatttatttagaacaaaacatcatatcctatgttaaaaaaataattttatcaaaaccaaatttcaatcacagttatgtatgattttcagttaatggtacatgttgaaattgcactttgcagatatcctgataatgtccttgacagcgttccccatttcagcctatgtttttttcagtagacacaggttcttccagagttttcttttggctccccttccgtgaatatttgtatttgtctacataggctttaaccagatttgccactttagtagaatttacttctccactcttactatgacaaacctaagaaaaaaggggtggggggtaaacttttttcatgcttaaagggattaaagccaaaatagaaagctttgtgaaaaacaaccccaaagagataaccagacttattttcatgtttcattatctcacacaaactaatcaaaaggcaaaaaagtagacaggaattagtaggagctagcttttattattttaattaaacttcagcattcatttattaaaacagaggtggttcaaaacaacgtgcacatactccactaaagccataacttactttatctactgctttccgtacaatttctttatattcttccttggtgatatctttattttggtaaaatggcttgatggccaattttacctcttgtgctgctttttcttgaatttgcaatttctgatgagaagaaaatgtataatttattatttgccagtcatactgctctcacaaaatcccaaacaagaaattgaaaatacttcatatttacaataagagactctccaactattaacgtgacaaatataaaacagtttatttactaaaacatatcaaacatttctaaaaacaattataaaatattaccagtaatttactggacatcaacacatctagagagaatccttcaaataataatggcatttagacagccaataagaaattcccttcaccactcatacaataaaaagctgatattttttctcctttatcatatacagaattatgaaggttgctctcaaccttgaacttgccttgtctgtcttcgagctatctgcgctggcttccactgcaacacttactttgctttctgccaattttacagcagcattagaggctttgctgtgacttgatgacgaagtattaccagaacttggtccctgaaccattcccgtatttcctggggctgctgtcggagcaggcaaaactggtgtactcatgttattacttacatgagaagaactaggaataccctgttttaaagagttatcatcagttaatgaattacttgtactcgatagaagtcttttagtgatgcattagaaataacattaaaaaacacaaagcaaaccaaccttagtactaaagaaaaatgcatatttcaggtaattatatctaaagggccctttaaagaaaaatgagtaacattcttaaacggggccttatttagatatgtcaagatgacttttaaattatatatatgtattgtaacattttgacagcaatactaaacacaaggaggagaatagcatttaaagaattatatctttcctgcaaggatctttaggaatattaacaaatattaaagtgccctcactttaaagcctggaaaaaataaggcagtaaagtcaaatggcttgtagtaagttgacaggagaaaaaaggcttgcagtaagttgacaggagaaaaagattaagatcccaaatactaaaatccaatttccctattccttcaactctatcttactgtcaggattctatttattttattttattttaattaattatttatttatttagagacgaagtctcactctgtctcccaggctggagtgcagtggcgcgatcttggctcactgcaatctccgactaccaggttcaagtgattcttgagcctcagcctccgagtagctgggattacaggaatgcatcaccgcgcctggctaatttttgtatttttttttttctagacagagtcttgctctgtcacccaggctggagtgcagtggtgcaatctcggctcactgcaacctccgcctcctgggttcaagcaattctcctgcctcaacctccttagtagctgggattacaggcgcttgccaccacacccggctaatttttgtatttttagtagaggcagggtttcaccatgttggccaggctgatcctgacctcgtgattcacccacctgggcctcacaaggtgctgggataacaggcgtgagccaccatgcccggcctaggattctaaaatttttaaaaggcagtcataaaattataagcaacaaattgtttgcaaattattcaaattttctatgtctcacagaggcacttctcctttctttttagcatgataaattcatgaaaatgaaacacagatggtaatggataataaacagctttatccagtgtttgtctgaacaagacaataaaagcttcatcacagtacttaatcactagttcccaccgtccccatataccccctaaacagtgcaaaacaggggaaaaatgtaaagcacccaccactcgattctaatttggcttataatttggtttacttaatatgaataaaaaaatcctgttcagatataagtaacagcatatatgtagcttggatttggtaataagtatttaattaattttctaatttgggagttggggggttttgagaaggatagtgaaagagggattatgaaggtttaccataactgaaatcaaataaacaattgtttttgaatgccaggatgcctttttttgaacatctgtcatgaacagctaaatgtttacaatggctatattgattaaacttgagttgctaaaaacatacctgcaattgctttccatctggttgtgaagcaatgtagttgacttgttgggatggtgggggagggggtggtggtggtggtagtccctgagatacactggtaggagtggctacctgcatgaggggcactcctgtgtggagatgcaagggtagctgaggatgaatgttaaatggattgcgttggatgttcatcaaaggagcatgaacacccactggatatgggaagatattcataggctggtgttgtgcattcatttgttgctgcattacattcatttgcggttgcatcatatttataggtagctgagaaccatcaacttgctggtttgtttggtcttttaggctagaatctatcaaaagaaaaaaagcttgtgaaaaaaatcatgttataaatctctttagacagagaaacaaagaaccactggttacagtaaaattaaatagcaattaataggctcagtataccaataccaatctccaattgcttaatttaatcctgtcatttctaaataatgtggactgactttctaatgaaagaaaacatttggcgaggcacggtggctcaagcctgtaatcccagcactttgggaggccaaggcgggcagatcacctgaggtcaggtgttcgagagcagcctggccaacatggtgaaaccccgtctctactaaaaaaatacaaaaattagccaggcgtggtggtgagcgcctgtaatcccagctagtcaggaggctggagaattgcttgaacccaggaggtggaggttgcagtgagcaaagatcatgccattgcactccagcctgggcaacaacagagaaactccatctcaaaaaacaaaacgaacattcacctgaaaatatttttaagaataagttcatgcaaaacatacatcaacaatcagtagctcaagaaactgactagttaaaaaaaaaaatcacataaaatttaactactaaattataaggttattcaatttttacatcttcaacagcctttatcttgcaatgttcttaacaagaaaaaaaacaaggaaatataaatctttactattaaaacaatggcttattttatttgtatgagaacaattatcaaaaaaattaaaagtgtacatatctgaaataaacaaattagaggttaaatcctgcataggaatatcccaaactcttctattgtagcaaacagtgctgaaaatatttaagtctttggcaaggtttggagcagaggtagcattaataatatacttatgtagataaacgtacgtgtatatatatttatataatgctaagtgacttgtaaacaactaaggttcagcttattataaaaactacaaataaggatcatttcaactcatacaaataacatattaaatttataattcttcaaataaaacagtatcaataaaccaacaagaatacattaccctgtccagatgtttcctcctcttgtttcatccatccagactgtggacctgaagaatttctgcctcgtcgtgagtagtagttttgtacatctgctggcaaagtctttctcacggcccagctggatgcagatgtccatccagatctatctgctggtgtatcaaatgagaactcctgttcactttttcgcttataggattgctgttccacaaacttgaaagattcactccctgaactgtttgaattccctgagaggggttttcgattttgccaccgattttcattctgatctttataggcaaaactacttctgtaagtgcctctgccacggttgcctctgcctctaccacggttagatacccaaccagaaccaaagtttttattccaagaatttcctgaattttcatttctattttcttcccaatgagactctttcaacttttctggatttctggttcttggatcaggcccagagtttattttttctgttatccaattgggacagtcatttctatgtttgtcagcagaatttggatcatcagcatctagatggatgtcatttttttcttttcttgtattttcattctgtttctctgggtcattctttctgtaccgatcatttcctcgtggacatctccaaccatcatttgcccatcttcccttccaccggggagagtaactatctctgtcaattctaccaaatgatgaactcttactttttgttctacatcttgagggggacctagaatgagatctggacctagaccactttctggttctcctttctctctctctcctctgcccatctctatcactttctcgttctctgctctgggacctggatttttctcctggggaagaatctttcactcttggctgagatcttttgttctctctagaagtttctcttcttggggacagtgattcagatcttctgctttccctagtagtatccctttttggagaccgagactgagattgcctcctttctcttgcaatatccttttttggggactgagaacgggattttttccggcctctggctgactcattcttaggagatggtgattgagacttcctgctttctttcccagtttctcttctgggagatggagactggggccgcttcttttcttgtggagtgtctttgttgggtgaccaagttgtagatggagaatgaaatctagatcttcgagtacgaggctttttggttttatctatggtatcttttgggctttcagatggttgagaaacagtttcaaccttttcatccgcaagatcagaagacggcatattattttcagaacagtgtgtcacagaattttcattcatttgtttaagatcagcatttacagatggttcaacttcagattcattttggtcactgcaaaatgaatcacactccataggtatcatttcattgttgtcctcactaaaatgcttctgaatctgttcaatgtgtgttttaggcaactctgtagatctaggatgttcggtcagcgattcattcttttcttctaaagatttttccaatttggtgttcagaagattattttttagtaagttattttcagagtcttgaatattattgaaatcttcattcccaaaagtatcacatgttgcaattatttctacatcttcagtttcaacatgcccaagcaattgaacctctgggctcttaacagattgtctgtccactgtctgtataatttcaccctcagaagattctaacttggggctctctataagctcctctgtttttagtgtaaaatctttatgttcagtaatttctactagggaactctctgttattttttcttcattaaccactgactctacattctcagataagtcacttaggggacaagatacaggttggtacactttgctttcagatgttaaacatgtaggaaaatcatttggaagatgaactgtacatacatctgtctttacctctgattgtgaaagtccagatatctggtcttgcttttccaatggatcacctcctttttcaagaatattttcagaaatctcactttccaaacacaaaacattagcctctatacctgtattctcgagttttttaacttccccttcctcaccaactagcacaggaagatcttgagcacaagactcagaagatgaagatcctactctttcctctgtatcataatttgcagtatgcttctcactttcttctatttgctcattgcaacttttcaagcaattagcagactggttttctacatgagtctgcacagtacaaatgttactactgtctacatctggttggtgctctttttctaacacaggtgatgtgtcagattctgctgtttcttcatctactgaatcattggaagatgatttttcaggggcagctacagagctccgaagtttctttttcagtaaaggtggttttcttcctcttcttacagacttccgttttggagcctgtcttgtttgcttttctgactcagctgaagagggaacacttaaagatggattactgttacctggggcatcacacccagaattgtctgatattggggatctctgagactgactggctgtttcagctcttgtgttacgtgtagacctccttgtaggagttgtcattgcaggttttcgtcttgatcctctggtatttgatgtaccagaagtttgcttcttttcttccccttcttgagtatgtgctaatgcatatcccttgcaagaagtacctaataatatttaaaaaaaaaaaaaaagtaaaaaatatgttttaagaaatagtaatttggctttagctaattttagcataaaatagtctgcaacagagtgaaactaaatacttataaataaaactattaataaatgcatagctactaacatctgagtaatatgacttattcatcaactttcttaatgacactgaaataagttataactagatttggtccaaatgggcaattttatagagaaaaaaaaaaaggaaaataacttttggtcttgtaactgctacttgcttaattttttttttttttggagacagggtctcactctgtcacccaggctggagtgcaatggcgtgatcactggagcaatcatcgcgcacagaagcctcaacctcccaggctcaagcgatcctcccacctcagcctcccaggtagctgggactacaggcatgcactaccatgcccagctaatttttgtatttttaatagagacagggttttgccatgttgcccaagctggtctcaaactcctgagttcaagtgatctgcctgcctcggcctcccaaactgctgggaatacaggcgtgagctactgtgcccggccatgatctgggattatctaagcaaaaggagagagaaaatggtcaagttatccatgaattaataaagactcaaactatttattaataattaattaacagatgttacttctaaagatctatggtttggatatgaaagcctgaaacagaaaggagacttctaatcagttcctcaaagcctccaagttgtaatttcaaaaactacaacagagtttctagttggaatattttttatttttaaaactgactaacagataaaactgtgtttctcatgtacaacatgatgttttgaagtacatatacattgtggaatgaccaaatctagctacttaatatatgcactacctcacatagttataatttgtttagtgagaacactttacgtccactctctagcaattttcaaaaatacaatatagtcgaccctttaacaacacagggattaggagcaccaacccccaacacagtcaaaaattgaaacagtttttactccccaaaacttaactgttattcaccagactccttactgataacagtgaattaatatattttttatgttatgtgttacatactgtattcttacaataaaagaagctaaagaaaaggttattacaaaaatcataagagaaaatacattataatgctgtactgtatttattgataccctaagtttatatcatttgtttacaagatgaatcatctgtctgaaatggcaggcaactgcagctatagatctcaatctgttcctatcaaggaattaaacttcttcttataaagccataattttgcttcttgggagcacttcctacatcactaatggcacttatgtgggtcccaaaggtgttactcaaggtttacagtattgcactaaacactatgaaaaatatgcatgcactgcaagagatcactttttactgtgatatgcaatctattagaaagacaaatgctcacatggagatgattacattaaaccaggttttgcgttgtgttttgttttttttttgtttttttttttttttgagacaggctgttgttctgttgcacaggctggagtgcagtggtgcaatcatggctcattgtagcctcaacctcccagacattcacaacacttgagtacaccagaatagcaacaggtggcggccacaaaaattgttacactggtaaatacgtactatatttaattttacacagctatgatttaatactgtatctttacagctgtttacatttcttatgactgcaaatggtggaaccatgtggtttgagtgtgtatatgttttgataaattttaacttgttatcatagatttgtatatattttatggtagtaaatgatgaaatagactagtacctacatatattttatacattaatgacatacctttttcttaatttttttcactatttataggttatgcgatttttctgttttttcagtgttgcaaatctccaaacattttccgatatatttattttttaaaattcatgtataatgtcgccacccagttaaaacctatgttgttcaagggtcaactgtattattatagtcatcacgtttcacaattgatctttagaacttattctatccagctgaaactgtatcctctgaccaacaacctccaccccaccacacctaccccaccccctaatctacaatctagttctacgagatcaacttttttagattccacatataagtgagatcatgtggttatgtgcctttctgtgcctgccttattcacttagcctaatgtcctccaggttcatccacgttggcacaaacaagatttccttctttttgtggcagaataatattccattgtgtgtgtatatagatatatggagagactatgtatctatctatctatatatacatacactctagttgaagcaattctaaagttaagtcattgtccaaatatttatagacgtatttacaagttactatgccttactttacagcttttctaagtcatcaaacacacatttttatgaaactggaagaaactaataataataatttttaaaatagaaaatgatttcacaaactttaccaaaatgttcgaaagatatggtacttgttggaaaaatagttcttggcaacacagaagaaatgagaggaaggacttctgtttcaacattccagggtataaaaccaattctgaaaacataataaagacatttttgtttaaatggtttaaaaaattaaaccaccaatttaaaagtattaattctctaaatcaggttagcaatattaaaatacagtgcttaaatgttttttgcccaaatagctaaaaatgtaaattcaaggttactccttgtctaaagatagctaccaattggctaaaattcagaaaaaaacctttaaaagtatgtttttctgataaattcatggcaaagaaaagatgaaagcaacttaacacagatgtttctctttgaaataatttatgtagtattttgtcaagaatttttccagctttcatcatgttcttcactactctaaaaaaataaaatcaactttgaggtgtaattcaacataaaatgcagactttaagcgtacatttgctaactttttaccaaagtgtgtgcatatatatatatatatgtctgtgttaaccaccaccccaatcaagaaagagaacatttctgcccccctagaaagtgtcctcacactcctttgtatccttctccctcctttccaggcaaccaaggaactgatttataccactatgttatattctaaaattcctcgacctggtgatggctcttcaaagttctcagtgtccctagagacctgttaagaccccctccttcaaattttctccattcaaacccaaaccacttcttggctttctttttcttattcatttaggtctcctaacaaaagactatctgattcaatataaggtaagattctggagtaggagaagcatgggaaaaaaaatgtaacttgtacatgtataaaaatatgtaactataaggaagggtttcatagtacatacatctggaattcttcatctgacttctattatgttctgccatcattcttagagggtgaatgccctatacagaactatattatagtgacatataaaataaagtcataatatgttataggaattaatataaaactcaggcagcgaccctaatctttacttaggagcttgatttaagtatatattatttatctagcaccatcttagtagcttcaagaataaactaagaaataaaaaactagattacagaaagtcatgagtgtcagggtagagtaggcacttgatcaaatagttatttagaaaaacatttttgaggagaggaatatggtaaaagcgtgattcagcggacagcacgcaggtaagactggaatgggagaagagtagaggaatgatgacagatgtattactaacaataaatcttaatattcgggttctctcccttttaaataaatctagcatatacacagctatacttgttaaacagataaattaaggattctttactttctaaggggtcctttatatagcaatctttattgggcatttgaaacaccaaagtttaatttgcacaaaacttccttaggaaaataacaattgaataaggtacccttgtacttaagtactaatgctatcttgttcatgttagcatgtaaacacctgagtaaataattttttatttttaccttccaattccaggtaatgtatcaggaaaccatgacaattccagttcatgtctcttctgcctaatcaatgcactgatttcactggcttctataaattctgtactaaaagataaattttagaccttcatcagaatctcacaattttaggttcaaaaaaacaattaggttgtacaaagaatagcagtcgtttttgtacctggcattatgaatcacacttacaagcatgtgagctcttttctatttaaacactttcaaaataaactcattcctaaaataagtacaatttttatattgcaaatcagagttgtatttatatgattgttaaaaataacccttgaatttctatcttaagtgacagaattttttaaataaagtcaagtcagagtaatatcctcattattgaaaggaagaaattctaggtgcaatagtttcctacttgaaactaagcctaagacaaaagaagaaaataaagtagggtaagatgactgcaaccaaaaatgggtatagttcagcttttcaaaagcctacttagacataatttttttcttggtaccttgccaagttctaaaattaaatcacacaatcgtattctgtgctgctggctcaactaactgtacgtgattttaaaacctcaatttaatcttcaaattccataaatatcaacttagtatctacatgccagtcactaggattcaaagatgaatggatcagctgtaaaagggttcttctttaggtaacatccccacaagctaataaataagctacttctcaatcatataaacagcttatatagaacaacttattaatgaaaacaaagcacactggcataggcaatcactgcacaatagagaagctcccaaaattaacaggttttctctttgctagagctagtttaccttcccccccgcccaaaaaaaaactaaagcaaaacaaccaggtgggcctttcagtttttattgggcccagagtttaaatttctagcaaaagttaataattattaaacatcaagtataaacagcataaattaaaagtagaaaatactaaccaataagctctataggtaaaggaagattctccagagtggctaacagaagaaaacatattggagaaaaaatttctgaagcactgatttgtactccaatttgatctctgaggctagaaaagtaaaaagtagttagtgaaacagcaaataaataacaggtaaataatagttatacttaaatattttgatacacctgaagcactggttatttatggactaaataaccctaaagtgttatcatctaagaaaaagatttttcttggtttcaacaaaccttatttatctttattgctgcatttttctttcctcctgtttcactgtataaagagtttcctgtacaaagacataaaaggacttggttaccttgtattaatttttattaaaaaggctgtaaaccagcatcgataccagcacattggcaagggttgaaatacgtagaaaagctgtatttcaaataatacacaattttttacacaattttcccaaatgctgatttcatcttaccttgttaagctattactacaagtaaaatataaaaggccacaatacagaaactgggtgaagtatgtcaaacctgctatgtttacaacatatgagttaaaattctaatcaacattttctgctaccttatgcaaacttaaagtatcttgtaacaaaaggtatacacaagaagtcaagctatttaatatcaataatacacttaacatttcttttccagctatcatctagaaaacaggtagctatctcaagcaggggctgactaggtggcctggggccatcagctcttgttaaccataaattaccatttagccactggcacccacttcaggtatgttctttccttccaattttatactaagatggaaaagtagatgtgctgactgaaacagctttctgttacaacgttggtggctgcattgcttatgacttgtccacagtgcatatgacaactgccttttaattttcccccttgcttgcctcacaaagggcctattgacattgttcaaaataaatcacactaactaggaggcttgtttcctgcactgcaagatcatatgtattttggtttacttctgttagttcagttggtaatagcctactttctacttaatagcatactaatttcctttttagttattatacaacagctgtttggttttgcacaagtccctctcagaactactgtaacaaatgtaatttcaatgttagtggaagacgaacaggctgagttccggaacttactgccttacccctttgaaaatctgtatctaaaagatgatacgctgattttttaaaatggcttaagaggcaagaagtaaaaatgtgtggtaggtacacagataacactcttagaaataaccatgttccttcagctagacatagaattgctgtgctatacctacatagtgtcttttatgccctaaggatgctgagttgttttgtttcaggttgcattcactcaacacttaacgagtatgtagtgtttacatagcattctttcatttggaaacctatctcagaaagccatcattagataaaatgctctctactgaaagaactgttagttttctctgagcaatgctacatgtgaaaatccagttcaaaagctgtttcacatatttctgggtaattctcaggtaattactcaacagcttcaatggcaatctctaaagtattcgatactggtgaatttgtctaaattgtggtttcctgaagatcgtttcacaaatccaccctacttgtctgtttttggtgggcagtgatacgccttttcatttaatttttatcaaagtaatgcatgtacatactttaagatgtcaaacagtacttccaaacttataaagaaaaattatggaaatacccactcttgatttctgcttccccaaagcactcatcaaatcctttggctgtttcttctaacatttacttattactaaataacacccttatactactctatgtgtggttttttttgttttttttttttgaaacagaatctcgctttgttggccaggctggagtgcagtgccacaatctcggctgactgcaacctctgcctcccaggttcaagcaattctcctgtctcggcctcctgagcagctgggactacaggcgcacaccaccacgcccggctaattttggtatttttagtagagatggggtttcaccatattggtgaggctggtcttgaactcctgacctcaggtgatccacccacttcggcctcccaaagtgctgggatcacaggcatgagccaccacgcccagccagcttcattcaggtattttcctagggttaataatgtctttgttttctcttttccttttcttccttattatccatcattaatttagctaactacaacaaaagtataaatctgagtttaatacactcaaacacaacaactcatccataaggtttgttccccactctcctggcaaaactctttctttgtcctggtccaatatgaactggtaactctcaaagctgctgttcaatagtcattttgggattgtcctttgtcattatcccaataatcctctttgtcctgtttaatcttttcctgagttggaactcattttctgaatctcacattgttcttccatttactatctcatttagtgaagtatatacatacatcctccagcagaagtggaaaagggtgggaattctgagttagtgcacgatggatagtttgataggttatagaattgtctaggttagtaattattttccctagagttttcaaggcattgcttcactactccaactattgttgatgacactctgtaaccccaatcctctatgtggtctgtttttactctctctcttgtcatcctcagacttctagaactttatgaagtatttggtatgatttttttttcatttactaagtattatattatttcttcatatctggacacctgtgctctactattacggaaaaaatttcctttgtattacttttttaaaaataaatttttgcatttttccttcctgaaattttattattcgatattgaatctcttaaatgaatatcctatcatctcttttttagtcctactttgagacttaagaacttatcttctactcctgttgaatttttgtatttttgctgtaatatttttaacttctgaaagctttttcttaaatattatttttcttgtatcattgataaaatatcccttctttcaggctttgaggatattaagttttttaaagttattccctatttttcagcattgggtctgtcccatcaggttgcttttgtctttgttttgatctctattatgttgattttcctcaaacatctggagatccttgattgtttgctggacactaaaatattgattgaaaatggtgtagatgggtggtcagagcctttcagctaatgtgtttcactgtagggtgatcaagcagacatctggttacttcattgggagactctcaaatgacattatctttaagtcttttcttttgggcaagtcagttttccaaaagatgtcccttatttcctactttggaaaattataataatcaagactgccagtgctttgaaaaatgctcttaggtagaggactagaagcctcatcatttgacttaatttccctctctgttgtttcctgtaccatcatttatgctaaagtttaaatctggttcaaatactcattttagagtgtaaatctccagtctttcattgggtactccccttcctctacccacagccaggaatcttcaggatctaaagatttttaaccaattctgttttccaaaaccaccccatatctctgccttcacagataatggaggcctccaaactcaacttgctaaggtttgatggtatgtgtactgtcttgagattcttaactccattcttcccatgaaatgtctatgtatcagctttctgctaagacaatttaccatccccctcatactgttttactttctattttgtggacacttatgtgctgtccccctctctccagctttcttgtctttgtggcttaaactttgtggcttaaaactcttctttctggccaggcacagtggctcacaactgtaatcccagcactctgggaggccgaggttggcggatcacctgaggtcaggagttcgagaccagcctggccaacatggtgaaaccctgctctactaaaaataccaaaattagccgggcatgatggcgggcacctgtaatcccagctactcaggaggctaaggcagtagaatcacttgaacctgggaggcggaggttgcagtaagctgagattgtgtcactgtactccagcctgggtgacaagagcgagactgcatctcaaaaaaacaaacaaacaaacaaacaaaaaacacacttttctttcattcctttattgtcattttagtagagatttgggatgagagggatcacagcattaaacaagtactcaatctgctatgcttaactagaaccttgttttatttatgttaattcagcatatccctaaacatgtttcatgaaacactaatccgaaaggatgtttcatgaaaacatccttttgtacgatacaaacaagtataataaaggctctgagcttagaacccagtacttggcaggcatccaattaaagtctgactaattgattccaaagtttaataaagacataattagatggatctagtatgtacttaaagaagtactacattaagaaatgcctgaaagggagatcctgtctgtaaactatatcaattataaactactatcccaaaccaaagattaatgttcattccaagaaacaaagtgaacataaaggagattaaaaacaaaaatgtataattcagttatctagtatgacagaagaaagaaagtgatatttcctcaacaaatttgctaataggtttgctgtctaacctttcactatacctctagtgtggcaacatcatcttcattatatgagaaaactagacagtttatataattttactaaagtcacaggtgttttaatggtaaaaactgtacaaaactcaaggggcttgacttccagtaaaaccatctattagacctgctgaagttttaactaatagtatactatatttataggctataataatctctaatcaagatataagaattcgcaacttcacaaactctattcattagtttgattactgtataacaaatgacttcagatagaaagtcacacacctatgtttaaagaacagtcccatcctgcttcacaaaactttaagaaattaaagaagtttggccaggtgcagtggttcacgcctgtaatcccagcactttgggaggccgagacgggcagatcatctgaggtcaggagtttgagaccagcctgaccaacatggtgaaattcccctgtctctactaaaaatacaaaagtagctgggcatggtggcgcatgcctgtaatcccagctacttgggaggctgagacagaagaattgtttgaacccaggaggcggaggttgcagtgagccgagatcgtgccattgagatcgtgccattgcactctagcctgggcaacaagaccgaaactccatctcaaataaacaaataaataaataagaaaacaagaagctaagctaagtagagttgcttctaaaatctaaccaatcaatcctagataaagagacagacaacagtttctcaagtagttcttttataaaaagaaatttaaattatccttaggctatatcatggtttctgttcagtgtaactgggtaaataaagatgtattcaatttgcacaatcccccactaactctaccttcgtgactttgtctcttggttccttgcttagtcatcaaatgtcaacatttaaggatacaagctgtcttttctgttgcgtgacagactcatttctgcccctaaactttgcaataattccaagttacacttacaggttctcttagtcttctaattagtcagtttgttaataaatactgtctaagaaacctcataagaaatgtgaaaattaaaagaaaaattaaaaacaaaagaaatgtccaaattaaaggcaaaaactcttaaaggttctaatcttacagctatgatttatgacctttaacctgaaggaaaaaaaaatcacagttaactgataagtggggagcagacattctgctatcaaaatgaaagagaactaattttacattaaaaattatttttgagctcaaaagtacatccaaacaagatccaccagaatggcaataatttcagttacaaaggttgcagacaaccataaagtgagaggcttaattaaggtcggtaacactaacaatatcatgctttggtattattttgtagtagaaagtggcattggatatagagtcagaagactggatcaaattctggtggctccaattattagcaatgtgatctcggacaagacatttagccttttaaaaaagactttacaaaatgatgttaatacataatctcagaagacagagttatcttattaacctcctcttttgacatctttagaaactttctaacagattacttggcttcccatccttttggaatacttcaaccaggttagtttatctaaaacagtttcaccgcattgtatctcaatgaaaaaaacttttaattgtgtctacttgcatagcaatcttccttttcagtcttatttccttttatttattcttttgagaaagggtcttactctggcgcccacgctggagtgcagtggcatgatcatgactcacctgcagcctcaacttccccaggctcaggtgatcctcccacctcagcctcccgagtagctgggactacaggtgtgtatcaccacacttggctaatttttgtattttttgtagaggtgggtttcgccacgttgcctcaatcttatttctgatcatcattagtcttaaacattctgcctgaactcaagagtgagaaaagaaatgacaactggaagaaaccatcaatttaactgaggagtcaagcataaataaacatatatcaacacaaactgttcaccattaaaataacatgaagatgagtagatcttatttgtacatgaaatgcaaatatacaatttcttcagagcatctctatggtcgtagacaccttacttatcgaaaaacgaatttgcctgtcatctttattgaggtacaattgacaaaaattgtatatatttaaggtatactacttaatgttctgatatacgtacacattgtgaaaataatcaccacaaaccaaacatatgcatcacctcacagttaccattctccctttttcttgtagtgagaacacaagatctaaatttcaagtgtacaatacaccattattaattatatccacactgctgtacatctatacattaggtatccagaatttattcatcttgcataactgaacctctgaatcccttgacaaacatctccctatcttccccgctcccaaaaaccaccaccattctacttccaaaagagaattcttcattataccctcccaaacgttctcccaccagccttccccatttcagtaactggcaactcctattttaccagttccttaggtcaagaccttgtagtcaaccctgacttccttctttcttgtagcctatatccaatccatcaatgaatcctgttagcttcatctttcaagtacgatgcagctgacccttgaacaacatgtgtttgaactccatgggtctgcttattcatgaatgtttttcaataaaagttacactgagtgtgcttgcctctcctgcctccccttccaccttttctgccattgccatccaagacagcaagaccaaccccttctcttccttagcccactcaatgtgaagacaaggacaaagacctttatgatgatccacttctgctcaatgaacagtaaatgtattttctcatccttatgatttcttaataacattctttctccagcttactttattgtaggaatactgtatataatacatataacatataaaatgtgtttatcaactgtttatgttatctgtaaggtttccagtcaacaggaggctattagtagtcaagttctgaggcagtcaaaagtaatacactgatttctgactgtgcaggggtacccctaactcttgtgttttcaaggatcaatggtacatacagaatggaaccacttatcatcatctccactaatatctccttggcccaagccactacaatttgtggcctagaaaaacgtcacctaaaataaaaagaacaaaaaagaaaaaagccacctaaatagtcaatttccacttctactcttattcgtctatgattttcttcccttcacagccagagtaatccttttaaaatgtaccagatcacgttactcctgaaaacactccctagctcacattggccctaaatgatctccccttatgtcttactctttctcctccatctacctaattcagtcattctagccacactaacttccttgctattctttggagacattccaagaatattcctgtctcaggcttttacacttgctgttcccttgccccaaacaagattccctgagatatcttcatggcttaacttcttacttcttgaaggtcactgctcaaatatatctttattcaagagggtttccctaacactttaaataaacggtcatctccacaatgtcatcaccctttaatcttttacccagctttattcttctttaaagcatttattaccgcctgttttatatttatatttgcgtttgtctacgagaagatcccattgacaagcactttgttgtttttgttcactactatacccctaagagtcactgtgctcagtatagttaggtatttgttaaatgtatgagtgatctcaattcccttttgcttctccgagtatgaacatctaatactgagtacgtattgagtatgaatctagaatttaaacctgaataattttcatcaaatgtaatatctaaatataagctgcttcatccaataaataatctatttcaatataggaagaaaaactgaccatgttagacttatcaaatttccctagtaaaaagtaacatcacagcaaaactattaataacgaaatggataatccatgagtaaagtggtccccccttatttatggtgtctctttctgcagtttcagttacctgtggtcaaatgcagcccaaaaatattaagtggaaaattccagatacaaacaattcttaagttttaaattgtacaccattctgaataacatgatgaaatcttgtgtcactctaccttcatcacaagaagagtaagaagagtaagtacaataagaaattttgagagagcccacgctcacctaacttttattacagtatattattataattgttctatattattattcattattgttaatctttccaccacctaatttataaattaaactttatcatgggtatgtacatataggaaaaaacaaaatatacacagagtttggtactatctgtagtttcaggcatctacttggaacatatcccccatggacaaggggtaactaccatacccagttcccttcaaatcagtccaggttggtcagtgaagacatttgctcataattacctcagcatcagcactcttgtattacccactcaaagtataatgagtatttctgcctatcctaaaccaaacaaacgacttcaggcatcttaagtagatacagcattgagttacaggccttagataatgctaaccttctggcagaaattgtttttttcctcattataattttaaaatagctatccaatctaatatgccacattctaaacagtaaaacaaaatctcaaatcagaattaatcatagatgcttataaatgagctttactatactgaagcatatggaatttaagattttcctgtatttcaccttctaaaaatgagcccaggcaagagataaacactttaagaaaattacagttgtcagtggtcttaaaactaagactagcataatttagtgggccaaattacctagaaaaaatctgtaacatcatttaatcttcctcagcagtaaattttatattggttcttagaattggcaagcaaatgctattcataaaaaaagaatgctaatctacagcaatgacatagaaaagcaaagactgttttcatatctaaagctgacaaaagaaaaatgcctttttaaccacagaagtccagagatcaaaacaacttttgcttcaatttcactttaatagtaaaatttcaaaggcagaacgtttgttaatctgtaaatctaacctgagggatcatattaattctaatcaaaaacaaagccaacaaaaaaccaacaacttggtattcatagtgcataaaaaatgaagttattcactttttaaaacaataaattaattctttcacagctcactaatttactagttctagctgtaagtggaaattcactgtgacttagtctggaaaataaatgcccacctcctcgcttacaaacagatcatagtaagatgttctttgggacagaataaacagcctgaacccccaaggaggagtcacaaagaactatggatgttgtcatttttattcaggctctgctgcaaagccttcctgtgtattagaaaatcatgtaccagacaaaaacagaagacaggaatatttaactgctcatgtagataaatatgttagaggtgcttttatttctaaagtttcaaattagaagtaaggctagaggccaaactacaacttccttcaggaactgtgaattactttcttgctgtcacagtcttcctttgctactgcttacagtaactggcccacaaggtatttaatctcatctcccccaaggacttctgcactaatgggtggaataaggccacagtatgagctggtcaacaccaagaaattgtgaaacactcttttctcccaacacacgcacacacacaccccttttaagaggagcaagaaggaaaaaaggggcagaaaacagtataaattgctccatgaaaacaaaatttatgtaggatttaacacaatgtacagagttctgaggactattttccagcctgaagtgttactgatgagaactctgacacaaccattaaattaaaaaacaacaaaaaaaaaggtagaatccacaagcaaaaagtaacttactatgtatccacttcaagtcacaaacttttgcacttaatagatcttctcttacgatggcttttcttctgtaaacatcaataaagacaggaaagaattaagaaaaaaactgtcattttgctcacttattttcaactcattctcctccatcaaaatgaaatctatcatgcactgattttggtaactatgctgaaatctggtaaatggtttaaggatattctcacagactcctatgagatattagaatgtcaagttaggttttaatatctattgagttgtattatctcagtcttttttttttttttttttttgagacaagattttgctgacacccaggctggactgttgtggtgcaatcacggcttactgcagtcttgacctcctgggcagaagcaatcctcccagctcagcctcctgagtagcttggactacaggcatgcaccaccttgtcaggttaattttttctatttttgcagagagtttccctttgctcatgaggctgttcttgaactcctgggctcaagtgatcctcccgccttggcctccctaagtgctggaattacaggtgtaagctaccatgcctggctaatatattttttattcttattcttattattattttttttactagacacgaggtctcactatgttgcccaggctggtctcaaaccccggatctcaagcgattctccccctcagcctcccaaagtgctgggattacaggcatgagccaccacgtctggcttcatctcagtctttaaacaacaatcttactggctgatcatgactgactggctattgagccacgcagactagaggtaagcagatattgtcttttttaaaaggaccattaggaaattctagcaaagaaagcatgattagtttcactcctcactcagttaccattctctacaatgacttaaaatggaggttcactaccaagaaacaaaataccactgcaatgccttctttggaactggtaaaaagtatcagaaacagagaggtcccagggttttattgctttggaagggagaggcaaaattgaatgaagtttgtctgtgtgttggaagaccaagtatccagtaaatagaagactgaatgacaggactactaaaaacatccaagactccaaaaaagagtataatgtaaatatccaacagctgacagagattttccaccttgggaaaaatagttaagctatgccttggtgggcaaaggcaaattattaattttgcagctgttatttccttatgacaaatctcagaaaaagcagttaaatatggggacgacttttgctatgttagactcaaataagagctgtgagccttataggtaattctgtgatgaccactacacccttggcaagagccaagagaattgggtaattttgagggagaaaaaaaaaaatgcatatctatgatactgtcacagccagtgatatgagttgtatcaagaattaaaagtatttctaccaaaaggttatttcttcactatgcctgggaaaagtgtactattatctactatgtaaatacaaatgcaagaaccaaagctgataagtatttttcagaaataattataaaatttggtctaatgcagttactaactttggggctcatgggtaggctcttggagggggtattccatgaataccttgaaatcatatacaaagttttatgtctgtaaacgtgtatttttctagcagaagggatctgaatcattcttcacattcttaaagaatgccataactacccaaaagttaacatctaaggagcttacagtgttataaattagtaataggttgaattaatctcagtgactactgccaactgttttaggaactaaataaacttactcttttaagaaattagtattctgatgaaaagtactaatgaatcatagatttaattatgaatctgacaacatattgacttaaaaattcaactcttggacagctctaaatacatttcagatcaaaatgagcttaagtttcaaatgtattagaacaagttatttaagcattaatttccagtgtactactcatattcaatttacctcaaaaatgtgttaaacacctactaaactcaagtattaaacaccgcatttctaggcatttatgttaaaataggcaatggttttaacagcaactaaaaaaaagaaacctgtatatttaaaaaaatgttttaacataaacacttgttatagtagacagcaagtgcctgctgcaacacaggaaagcagtacgtgaaggttaataaacagtttaaattataactgatgaagaatgttgtgctatactattaggtattccgtactttttgtccataagtaacttgatcagtgctatttacagtgtggtatgagcaccaatgcttatctattaggtgtttaatattggtatgtgattaagtacaaaaatgagggtaagcattcagaattttggtttgtttttgagacagagtcttgctctgttgctcaggctggaatgcactggtgtgatcatagctcactgcagcctcagattcctgggttcaagatatctccctgcctcaacttcctaagtagctggaactgcagccatgtgtcaccatgcccggctaatctgtaaatttttagtagagacagggtctcattatgttgcctaggctggtcttgaactcctgagctcaagtgatcctcccacctcagtctcccaaagtgctagccttaaaggtgtgagccaccacacctggccagcattcagaaattttacattgctgaacattttattttacaaaaggtttggtctaaaacagattcagaaataaactgaaaagaacgaattcttttaattctttttattttgtgttattttttagtagagacagaggaggggaggacggtcctcactatgttccccaggctggtaccaaactcctggtctcatgtgatcctctcaccttagcctcccaaagcactgggattataggagtgagccaccatgcccagccagaaccaattcttcaccaaaaacagagtagagctcaaatcagattctcagatttcagctagtccctccttaaattatcaagtgtgtgcttttgaataagtgattaaatacatttaaaccccacttcatttttttaataccttttttgtactagttaacttctgttccactcatttgcattccacttctaaagttaatcactaaccttatacagcttttagaattttcatgacaggagacctgtttctcaaatgagttttcatttttcttgtcttttgtttctctcagctgtttttttacttgaacctatgagaaaagcaaaatcaatttagagcaacaatccagccttacaaataactttttaaattcttccttgaaatgattaaaattacagaaacaaaactgtccaattaaaaagtgtagtccaaatacatatgcttattcattcaagcatgctaaaccataagcttagtaagtatgcttaggtctggggaaacaaaatagtgacagctaagcataaacagattaagtgcttataacagagatatgaacacagatttgtatatacatataggactcagaaattaactgaggatgtcacagaagactttaatgagtagatgatgtatgagttggtcttaaaggatagttaggaattggtctaagaaaaaaatattctaggtggaggaaagaacagagttgtaaggaacagtgagaagccaatgtagacaggtaaaaacagagtagctagatgtgaaattggtgaaatgtgttaggactcgactgtaaaggttcttgaataagaaaatctacaggcatcagagagtaagcggactttttaaagcaagtgaatgcgatgatcaaatttgtttttaggaagataactttggtgtgatatggggaatcaaccagttaaggagagactataaaaaccaggctcttatagataaactagatcttaaaagaaagctcttaagatagactagatctatgctgtccaagacaacagtcactagccacatatggccactcagtgcttggaatgtggctcgtctaaattggaatgtgccgcaagtataaaatagacacaagatttcaaagacttagtataattttttaaaagaatgtaaaatctctcaataataattttaaaatattacatgttgagctaatacattagatatattggattaaaaataaaatatatcattcaatttatttcatttttttattattttaggatgcttacttaaaattttagttatttagtggcttatagtatacttctatcagacagcactagttagatgaaagaataggggtctacaaagagggaacaatggagggatacagaagaaacatatttaagacattgagcagaaaaaaacagatgagggagagaaaactggaaaagtcccagatatttctgatcttggtgactagggctgtgattccattaacaactggggctggggaaaggggtagggaatgtgattaatttggagtttgttaatgtcagattttgttggtattccagatagagatgcacaagtggttgtaaatacaggtctggctctcagtaaagaagtctaggacagtgacagaattttagaagcatccaaatatacgtagtacttaaagctactgaagtataatagctgagaagacttagaaagaaagtatactgaaagaatttaaatgaagatcctatgagtcctaatgattaagaaaaggaacaggagggtagggatatgacaaagaagattgtgaaaggacagagaagtaaaacaatcattcatacatacatacatacatacatacttacatacatacccacaagagaaggatgttttagaagccgaaggaattagagggtagtcagcagcactacacgcagaaaacaaaccatggaatgtggaagtctgagcctggaccttggtgagggtagtgtttgtaaaataagataatagaggtaaatgttctatgggaactgaaaagtgagtaagaattgagaagaggtagttgtagaattcaagaagttcaattgcaaagggaaaaagataatgaagtgaagattcgaaagaagtaaaggtctagggaaggcacttaagagaatgtggaagatatctcatgtgccaagaaataccttttaagttaaacaaaaattaaactagcactgtaccaaacttttaagtaaaatacaaactctatcaaataaattttattctaagcaagaaaacataatttcacagaaaaatatatttggaatctactttacactaatgaatcttttgcaatgtaattatacatacaaacagcgtttggaaaaatggagaatatgtcttcaggaaaagccacacttactatattacacttctataatgttttatcttttttctgagatataaactaatttgcattgatggcaaagttatacaattacaacaagcaaaccgtttatttgaattgcagtcctgtttgtaccttgcatcaagattcatctggtaaaaatatatcaaaacaaattatgaaaacctacactgagaaagacaaataattaaatagttgtacattgcttccatccccttttctacttacatagacagtaaccaagtggacaaagactaacagtgctacctaaaaacggtttgtttctcctattaacggcatcacttatgtttatattgagtactctcatttttagctatttttcattcatgacttggtagtgatacatcaagaaatctttctcatatacttaactactactcttctccttttctcttttcttcttactcaactcagacatgtttttttgttttttcaggtaagcaaaaaattaacataaatacaaatcataatcatggctcacaacagtaagtaacattaatgaggtaagcagaatttaattttattggctaatttcaaaattattgtttttcaggaaaacacagttttcagttattttggacttaaggttttgtgggagttggtctttgaatctaatacttcatttcaaacattttttcaatggaaaacatgtattcaaagtgctagccaattaaattctttgaaatatgggaagaagtcctcgcattcaagatattctaaaatgttaagtattttataattaagccttagtacaaaacgtccttcagattatcagagatctaatacattttgtggtatactacaaggtgatcattatggatatgccctctttagggggcaaatgaataaaaggttcagaatttaagtatattagttgaaaggtataaatttatcatgctaaggaggattaaaataacatattaaaccttaagttgaacaattttcaaatatacacaaactggaaatcaaagtcaaacagcttcaattaatttttatataattcatgttgcagaataaaaagacttaccttaacataaccttccaatgcactgaatttaaacactgcctgaaaaggtttacggtcaataggacatgaagccagtgtctgaaaagtgattaacaaattatatctttacaaatgtttctttagatcaaaattataaatacaattataaattttccataaaattatttttatctctatcttcgaaagaaaaaaatatttttataccttaaatttgtttcattcattcaaacatttactgaatacctcctgtatgctagatagttggaatacaatgatgaacgagacagaatctgttattaaaatcccattaagatatgctgcccggttgagaactactagtatagtgaaagatgagttgggctgacagcagtagttctgtgatgtaaagctggctgttacactaaacttgggccactccaaatggctccgaaaggttcctcacaaattttaatattctatgacttaatattttccccccaaattagttacattaaataggcagttgtgccagcaataaaaacatttgaaagatatgaagaaaatgaagtactccttcacccctcccctcagccacctagatggccactccagaggcagtttcttacataaccttttgtggatatccattgcatatgcatatatgtgtatctttttaatatataaacttaagattgattcatattagtaattcagagctgccttatccttaacagaataatatgaataagagttttttactttacatttccttttataggagtaaggttgagcacattttcctatttttaaggactatccaaagttccttttctttaagctgcctattcaagttctttgcttaggttcttattaagttgctactctttttcaaattgagttataggtgctctttatttattaaggaaattggtccttaagtgatactatgattataagtcaacattatcttgctttatttcctgtccttttaaaattcctgtgcatcaactctaagagtttctctgataaaactactaaatatttgtgtaagaatgggtttacattatttaaagaatttaagatgaaatgtattttctattagggtaggagggaaaactctgcaaagagcgtaccaaaaggtgatattattaatacctatggttacaaaaataaaacggaattttaacaatctaatagcaatagtctcaaagagcaaagatagtaatggaaactagatatattattcctatgtaaaaaatgtgatctttgcctttctgggttttaccacgtatcaagacatgcttatacaagtaaaagtagagcagattgtgtatggtccttgatcatttaacacattttcacaaagctcacaagtcactttgggagcagccaaaatatgggctgagttactattttctttctcttttaagtgggcttcaatgggaaaaaagctttaccacatctgaattaggaaatgtgaccttactatattaaattggttcagactggaagaagccagttcagcctacttttaagtactatggatttaggaggctattactttccctatagaaaacttgaccttaagaaggtttgcttcagcaacaaagaagttcatatattttttaataatgcattgtctagttcgaagaacttaacatcataaccattgctgtttatcccagtggcataccctgtatgaaatttcttaagagattatattaatgctacatttatggttttcaaaaatatttaaaagttgaaatctggctgagcatggtggtgcatgcctgtaatgccaacactttgagaggccaaggcaggaggatcccttgagcctaggagttcgaggctgtagtaagccatgatcacaccactgtactgcagcctaggcaacagagtgagatcccatctctgaaacatagataaataaaattaaaagtgtaatatttctagtgcttcctatttttacaaaagcttcaaaatgttttttattcctattttaaaggtaaatttagagaaacattaaaaaaaggttatgtggtaataaatgaaaatttgttttttcgtaaaaactaagatgtatagaggccatgaatttactgtgctactttcgtatctttttaataaactcgagcaagttacagtctctctgtgcctcagtaaccttatttgtgaaaatgagaaaaaataacttacctctaaggtttttatgggaataaataattcctagaagaaagtgtggcatatactaaatattatgtaaggtcttgtaatcaactagttttagtaacaaaaaaacttggttaattaacaaaagacaaccacaatatgatacatatacaagtgagagacatgagttcttaacaatttttattggaatttgcaaagtttatgacgtagatggaaatccaagtacttcattattttagctattttgatttgtgacactaagatccaaagaaagtcacgtgttcaagaaatttgtatcagatgcatcaaatctttcaaagactctcaaatcatacaatctcattttttctttattaaatttcctctactgacatcagctaaattgcattttttcctttacaattttttctttattttttttattttttgagacagggtcttgctctgtcccccaggctggagtgcagtggcactatcatgggtcactaaggcctttgcctcccagactgagatcagatgatcctcccatgtcagcctcctgagtagctgggactacaggtgcatgccaccatacccagctaatttttgtatttttcatagagatggggttttaccatgttgcccagggtggtcttggactcctgggcttaagcgatcaacctgccttggaggggttaatggcgtgagctgctgtacccagccttcctttacaattttgaattatgacagttttaatctaagctgttacttttttttttttttttttaacacagggtttcactctgtcgcccacgctggagtgcagtcacctgatcacagcttactgcaggcttgaactcctggggctcaagcaattcttccactttaccctcccaagtagctgggatacatgcatgtatcaccgtgcctagcttttttttttttttttttttttaacttttttcatagagacagggtctcactatgttgctcaggcttcatcttgaactcctgtgctcaaacgatcctcctacctcagcctcccaaagtgttgggattacaggaggagccatcacacctgctctgagccattccatttgatccgtttcaaaaaacagttctgagtaagattcccccccttttttttccttaagcataattgtcttaggtttgcctagtttcattttaagaaaaggctccactggtattacaaaaacacaaaggaaaaacaagaaaaaaaagtagtagtaataggaaaactactgccatatatcatcacaatctatataaaatgtaattacctaaagataatttagttaacaccaaaaaataagttaattttctttgacacagactcagccatcataattttttttttaaacagggtctcaccctcttgcccaggctgtagtgcagcggcatcacggctcactgcaacctcaacctcctaggttcaagcgatggcctcacctcagtttcccaagtagttgggactacaggcacgcaccaccatgcccagctaattttttgtagagatcgggttttgccatgttgcccaggctggtctcgaactcctgagctcaaagcgattggcccaccccggcctcccaaagtgttgggattacaagcgtgagccaccacacccggcccagactggcctaattttaaggaactcccaaggatgcctcactcttatatccagcagatatctatccagaaaggtctcaaagatgtttttagttttcagagtaaaatttacaattaaatttccaagttgtgaggttttaaaagttcacattttaaactaatgtaaagaaattttaactaatacttactctatttttaagttattttaattttgaagaaaattatctcaaattttgttgccttaaatacaataaaaatatccttcaattatttaccattttgattccttatatacaacaaaatatccttcaatgactcacttgtttgaattactgactttcatttcaataatttttaaagtatctaattcagtttcataaccaagtagtctaataacatcattggctttatgatacagctacaaaattaatggaatttgctcactgctttacagtgtaatgtgtattaaacagagcatatgttttactgtgaatgctctgtactaaggttgttgtatcagttaagaaggcaattttgatagaaaaaaataatcttcctaatgatttcagtaaaacacaccctactattctgaagcattataaattctcagctcagacaaacccacatttaaatgtaagaacaagaaaccttccttatttgggaattcaggatcctcgatttctaatttctcgcttcctcctgctgctctatcctcaatcacataggctgcttatagatagctcctcttagagagagagaaacaagtgttaagacaagtgcttaaagactaaatctcaatacctatgtttataggtaggtttgcctgtttgtgggaatctcgaacatctatctctctactaacaaaatagagcatgttatacaaaattctagttcaaaatcaaataaagatgacttagaaatgcataccattagtggctaatgcttattttaaagctattttccaggacctatcttttttcatttatggttctaagacacctcacctgtacttccaaattaattgttcacctgcagtcagcctacatgttccctatcacatttaaccagttctttcaagacagtctttgtcaatccatattagtgaaactgtggttctttataccagcattcaggagtgtatccctaaaggacaaatggctgtcagtgataaaattaacccccagtaagaacacatttcatcaaactacttaaaatcctttcatgttctccaagataccagttggggagaattacatgtaatcttaatttattctgacaataggcaacactttatctagtgtaaaaacaagaaactcagtaaactacccatacagatcattttacatattctgacatttaaaactaggcacaaagaaatgcatgttaatttaccttactggtaaacagagtacttaaattcttttagatatatgctttaggtgatgggtgttcacaatgcaaaaatcctctttgctctactaaaaaatttcccaaaggattaattcacagggtgaaaatagtggtggatctgaaaaaattagctacaagttaaagttcttgtggagctagcaatcactccaacccacactaaggatgaagatggagagagccctgatcatctattgcataggcgtaataaatttaaaaaatgtatctgacaatactttataaattataaatgactaatgttagtggtactacacaggtacatttacattaccgttcacagagagctacataacagaggtgtctgggttagttctggttaatttttttaaaattagaatttgaggaaaaattgattgaaaattccagataataaagctttactgaattatattacttaaaagtagtctaacaaccagaatggacaaatttccacctactgcataaagaaacacctgtatataaaacacatgtgcagtccagatataagtcaagaactcacatcttgattttttggtatttattattaattcaaaaatataaccttcacctatgttgaacactattgtttgacttcttcaagaactgcatgtcaccttaataagacacttcatttctagtttaggagagaaaccatgcctttgccaactgccgaattttgatttcattaacctttactctctcatactgaagctgttggcattttatacaaaatgggtgattttgtataaaatggagggagaataatctgcttataatgggaaactaatcacatttttaaaaataatacttaaaagataagggaaatattttatattatgtaaaagggaaaagaatgccagcagatatcaagaacatcctcatcacatatactgcaggttccattaaacattgttaagaactcttaaatgctttaaacatgtgtcttcaaaccatgaccttattttaagggccaaatttttaatcacttctcggcaactgtgggaaataatgattcctactttctctcttttttttgagatagggtcttattttgtcacccaggctgaagtgcagtggcataatcacagataaatgtagtctcgacctcccaggctcaagtgatcctccaacctccccccatcagcttcccaagtagctgggactacaggcatactccaccatgcctggctaattttttttttttttcccagtagagatgaggtctcaccatgttgcccaggctggtcttaaactcctgggctcgagtgatccaccctccttggcctcccaaagtgctgggattagaggcgtgagccatcatgcctggccaataaatcccatttacttaacctgtgtgtgtttgtatgtgttggagattatcttgtctgtaggaaatcataattgtcactactacaatgtgtgtcaagacttctctgtcctttaccttcctaaagtatgcaaactcagatatattaaaagctatcaataagtatatattgtttttgcccacaatatgggtaaaataaataacttcctaactgaatagatgataagctttagcatactggctctatatacatttcatcagttcaaatgtctttgattaattttagattgttggatctaacagttatggtttaaattaacaaaaatttcagccttccttaatgtcaattattgtgtcattgttcaatattctatttctatataatcatcattattttataaatcaacaggtttaccatctatgaattccttgaaactaaatataatcatagtggacatgattaatttcaatttgttctagtgtccctaagggcaggcaattaggctatgggccatgaaggctaccacaggttcaccctgaaacattttgccctaagtaaagaggattctgacatacccaaagactttttacttaatcactttaaagtccttacatagcttttgtttaaataaccacagaaccaaaattttagagcttgaaaagactgaaactaactttgatctatgtggccaaaataaatatactagactacgacacactttaatttttcaaaacaccagtttcttacagaccagtgtttttaagaatgtgttcaatgcctaaaatattaaggtgaaagtaaataaatgagtccttttttggtgcttgatattccttctgaatcatatttcagtgaaccttgggtacaaatctcagaaagcacagaaattttgaaagatacagaaatctagaaagatgatcctaactgcaaattgtactgttctcttatgcagatttctcaggagctgtggcacaagaatcgcttggcctgggaggcagaagttgcagtgagccgagatggttccactgcactagagcctgggtgacagactgagactctgtctcaaataaaaaaaaaaaaagaagtgaacatgcataaaattgtacaccacaaaccaattttttaaaaagattttaacgtcaggctatcccttgacgtacttaaaaatcgtaagtttagaatccttgtcttgtatagcaaataaatattaacatagtgaattaaatgaaattaaatgttagaatgtgtatgacagcctaggcataaggcatggcctgttagaaggctgaagacacttattcctgatcctgaaatccgaagtaaactgtaaactttgcttttagatggaagaagactgagggaaatgagaggatggagcttaatttataatgatgaaaaaaagaaacatactcctgaatttgaaatctgattctatttgtgaaagcacttacatgctttgaaacatatctatttttatcacagcaataaaagattcaaactgaaaacttagtctacatgatttttttagccagcattcacttataatttataataagcaatttattaatagattgctctcttgttactgctcaactgaaaggtttatttaaatgatgattgctatccccatcagggacaacgaaataattcagaatgttctgtttattctcccctttaaaggttaattacctttgtttaaacactatcacaactcctccctgcctacccagcatcacagtttataatagcagcataaagataagtactttcttttgaaaagcaatttgaaaaatattacatgcgggaaaggtgttggctgccataccatgtatgttatccagtattttcaacttaaaaatattcaacaagagttaaaaatatagacaagtttgccactgtctagtagagttaagtatgtgcatcatctacaacccgtaattccacctctagatacataccctagagaaacctggaacatgtacatcagggtaaaggttgtgtgaaagatgcacttgaagttgaaagaaaggatggagaaccattatctacttattacatacacattataattttcttagagcaaaacatatactccgattaagttgttgaaattcacaattatgtggtcaccaaatacaatcttataaaaaagcactgtattgaaaccttccacccatccaacaatattatttctttacccaaagcaaaatctctaaaaaaatttaaccacaaagcaaccatgtgcactaaattcaacacagataaaaatctttatttgggtggcagaaaaaaaatatgcattatttcattaaacagtgatcctacacagagagagatttaccaaccatattaattcagcaaaactcaaaatacttttccccaaaatacattttcacctatcctgtcacttcttgttaaagaccagtttaggttttactaaattaaaatagtttatatgtatactattattaattcaatttgtataacaaatcttctcttccttcttttgagaactcagccagagtcactatacagttacattctcctttccacactattaatgaaaatttaagcaaaacatagcgctttgaaaaccccaattatgtaatatgcaattaattccaacatatttaagaacattaacaattggaatgcagctaatgttaaaatatttttaagatattatcttctttactaatttttacagactgacaaatattaacttagaaaatatagcataatatgaacaataattttttacttaacatttcataacaataaggcttatattaaattaatatttacttcaaagtatttggcccaaattgagtcaacataatacattaaaagtcacgaatgtcttgtttcttattcactgtctatgacggtaatatctctaattcagactctgaaattagtccacactaaattaaaaacaggaattagaaaatcagttctaaattcacttctgcctcttaaactatgagatcttgaccaagtcatagaacataaaatccaagtttcctcatctgtaaaatggaaggacactatcgtatctgctctggttattccacaaggctgatataaagaagaaatcaaataacctatgtgaaaagtccctgaaaaatataaaacaaaaagcagacagaaggtgttattagtggtaaacagatattatcctattaagcacagagtcaagtacactgaaaaattaattactgcatttctaccagaaaaaaagtttgatctgttcttcctataaggttattaactttttttaaaaaagtatgcatttaaaatattatttgcaaaatcaaagcctgataaaagaaaattagaagaaaatgactgacagaatttgaataatacaaggaaatttgtccaaagtaggaagaaaatacattactgtgaaataatttatgaaaggcagtatcaactctttaggtgaaatgaaatcatgctaggaaattaaaatacattaatgtgtcagacttacctctgcccatttaagaatacaagtcatacagaagacatgattacagctttctggaaaaccaacttccttttctaatagacaattaagacatattgggcatctgtcagcctcactgtacaacagaccagtggaaatagtattatctccgttttcttcacctgttaaagtaaaacagccatatgtgctttcaagttctccagaccaaaaatcttgtgtttctaggagtatagtggattagatactctaaaggaccctcctactataaagcaaatagatcttagataaattatagcaaacatactgcttgagcccaacgtgcccaacatttactttcttaaatttttttaacgggggactgaaacaaacttttcattaattaaatttaaagtgagtaatattcacacggatcaaaaatttaagagcaaatttctcattcaaatttatccccatccagttccaaccaatccaataagtaacaactgttaaatttcttttgtgttcttcctaggaatttttaatgtacagaaaaacaaatgctaatacaaactcttccacattcctttctttacacaaatgcaagaatactatacacactagtctgcttttttctttattcaaatctattgatggacattcacatgttttcaacttttggctatgacaatgttgcaataaaaatttagttatttcacatttttaaaagtatatctgtagtgtaagttcctaaaaatggaactgctagagtaatgtgtgtatacatttgtattatgaataggtattaacaaattattctccttaggatttgtactactttaaactcccaccagtaatgtaaccaactcatacaaaagtatgcatcgctggctcataagaaaataatagatactctgaaattcaacataaaaataaaacagaaataaaggattggtcagctgaaatgtgaacagtaatatcaagcaaagttggaactgtcctgggcacaactgtccaaaccagtgtttagatctggagactaagccttagaaccgcttcaggaaggaaaactaatcctgatagactccagtatcaagccaagacttttaaatggggctaaagaggtcccagcatgggcctgggaagaaacaaatacaaatcctctggaggaaagaatacctaaattaggccctcatagatttaatttatcaaatgtaagctcataatcaaacattaccaaacctaagaaaataagctgtcttgagtgagaagcagcaggaaacacatttagaaatccactaacttcaaatatcagaagtttcaaataccacataaaatggacaatcagcagattagatccaagaaaaatacttgtgaattggaagacaaatctgaggaaaccagctagactctaggagacagaaaaggaaatataagacatagcctgtgaaacaggttaagaaatgaggttacagaacggtctaacatactaattgaaatccaaaagagaataaaggaaaggcaacaaagaggtaatggtcgggaaatgattaaacacatgaaccaacaaaggaaacacaatgcatactgttaagagaaataaaaataatccatgcctagaaacaatggagtaaaactgtaaaatatcaaagacgaaaccaagaccttaaaagcagaaaattggaaaagacagatcacctacaaaagagaatgataattagactgggaagaaatctccagacagcaagggaaaaaaaatgagtaatatcttcaaagtgctaagagaaaaaaaaactatcatttcagaattatatacccagtaaaactatctttgaatagttttaaagtggataaaatagattaaaaaaattcagagtttaccaccaatagaccttcactaaagaaacttctcagatttattttcagaaagaaaataaatgaagaggaaataaactcaagcaaacattgcataaaacatcatctaactggtggtgtctgaaataaaagaactcaaataatggaactataacctatacattgagattaggatgatcagagttaaagcattcttgggttcttcttctgttggtagtgaaaattaaattagctttagaagcagaggacagtaccaacgctaactttttttcttttttaaaaagacagggacaaaaacataaacagtaattcctaaaccagtagagagtaaacctttaagaaaaaagggaaaagtaaacaatttaacaaatcaaaaaacttgatcagtcgaaaataagatatgggaagaaaaaaatgtgtatacttaggcagcttattttggaatttaagaacaacaataacaaaaaactcctgtgtattctgaaatgtatacaagtggacagtttggaaacaactgttttgctttcaacaaacaaactttataaaaatgaaaagttaccttccatgtcttcatacttcttatctcccatatttagggtacatacagttttcttcttcatttctctttggaaaagggtttcctataagataaattataatagagaattttatgtttgccttctcccaataatatcaattaaaaaaaaatcctaaactgtaagaaattattttacacataaaagaacacagtacgagccaagccagtttgtggataatccagtactcttttatactccttgctatcaaaatgcacagtcttattgaacggaaaagccttggccgtgcacggtggctcacgcctgtaatcccagcactttgggaggccgaggcgggcggatcacaagttcaggagatcgagaccatcctggctaacacggtgaaaccctgtctctactaaaaacacaaaaaattagccgggcgtggtggcaggtgcctgtagtcccagctgctcgggaggttgaggcaggagaatggcgtgaacctgggaggcaaagcttgcagtgagcccagatcgcgccactgcactccagcctgggggacacagtgagactctgtctcaaaaaaaaaaaacggaaaggaaaagccttttataactattaagcaacaaagcctaaatgatatattttgtggcacagacataaatgcaattgaagcttaaggaacagagatcaatttggaatagagttttcagagaatgtgataggttagatgtgttgaggaacttcaggcattcaaggagcaacacagtatggagaaatacaataacatttagctaggccaatctcacaattgagcgggtgagagaaaacagtgggtgaaagtgtgtgtgtgtgtgtgtctactaaggagacagttgtgtgtgtgtatgtgtgtgtctctactgaggagggggttggcatgtaagccatgaattttatctgaaaaatcacagtgagaggtaataagaaataagcagagcaatgtaaatcaagtatggctagattatagatggatcgctaatgattgactgagaaccttagattcaatcttacaaattctatgaagaagagtgacaagataaaagtgatataagtgaatttttttaaaaaagatagatacgccagccaagtatggattgaattacaatggaaggagattataagcagagatatttgcatagctaaagtaactggctgtgaagtatatttgaaaagcacggaattaaaaggctgcagaaattctgagatttggtgagcaactacagtgaaggagacaatatcctggcctaaaagactaggaaaatggtgcttataaaaaggtaaaaatgagaaaagtgggaaaggatgttaatatggcaaaggcaagaaattcatacagtaacattttattttaatcaactttttttcctaagagatggggtcttgctgtgtttcccaggctggtctccaactcctgggctcaagcgatcctcctgcctccacctcccaaaatgctggaattacaggcataagccactgcacctggccttaaatcaactcttaatattccttcctgaactgatgcaagacataattgcaatgaaatgtccaaatatgcatttatatctacgcacaagaaatccttgattttatcagttgtgattctcctatatgtatctgaatgggtttttctattaatttctaaaataatttacacatggtagtttctacattaaaggtatgaactccccaggaaaattccctatttggttaaataaggagaaatacaaagtcccagacttatagttcaaaaactaaccataaaagcagaagaaacttagtagcatatgtaagaatgatttaaaggttgtagcagatcaaatacaacctcaaaatgaatcagcattagaatctaaaaactttttttaatccaatcaatctgacaataaaagttggatgaggaatatttcccactcttagcctatgtgtgcaacattagttttagttctggtgcaaactaacttgttttagttctggtatttaaggacaaacaacataatgatgaatgtccagggaagatgactaaaatggtgacagccctggaaaccctatcatatgcagaaaggtaaactagtaagaatgtttagcttggaagaacagaaagcttaagaacattagcaattatcttcaaataaaatgaactgttctgaagggaggtagaataatctatcaatgaaagtattcaagcaaaggcccagtgatcttttgtgggatttttttttttttagctccaagatttatagaatactataggtatactaggcaattctcttagtactgaacaaggcagaaatctctacctttatgttctagtggggaagacaaaataaacaaaatagtaagtaaaatatctagtatgttagacgttgagaagtgctatggagaaaaattaaaaacagtgtggctattaaggaataaaaaaagaggaagctgttgtttcatacagaatactgagggaaagcttctgtgataaagggacatttgaactggcaatcagaaagcagcaagggagacagttatgtgaatatcatccagtgcttccaggctaagcattcttggcagagagaatagccaatatgaaagtcctaaggcatgtctggtatgttcaaggaacaacaacaaagagatgaatgactggaatacagtgaaagaagaaaagtagatgaggacagagttatattgcactgctgtatattattattttttatttggggaaattcataccatactatctccttcattatcctaaatatctgagaataaaaaaatattaaggttggagttaactcaatgtgataaaatgtcatttgaaagttaacacagtattttaaaaacctaagagatgttcagatgtaatatattatccctttatgtaacgcaatgatttatttgtcctatttaatagtctaacctatgctattttcacatttcctcctttaagcaaactaacctgatatataatttataatttatattttaaagtggggtgcattggtatatgcctataatcctagctacttaggaggccgaggtgggaggatcgcttgagcccaagaagttcaagaccagcctgggcaacacagcaagaccctgttaaaaaaaaaacaacctacaattaatattttatagtaagcactgtcttctctattttaagacccatatagtgaaatatacatgagaaactgagaaacctcaatcaagttacacactgcctttgttagaaatctgccttaatggccaggtgccggtggctcacgcaagtaatcccagcactttgggaggctgaggcgggaggagcgtctgagatcaggagttcgagaccagcctggccaacatggcgaaaccttgtctctactaaaaatacaaaaattagctgggtgtggtagcaggcacctataatgccagctacaagggagggtgaggcaggagaattgcttgaacccaggaggcggaggttgcagtgaatcgagattgcgccactgcactccagcctgggcaacagagtgaggctccatctcaaaaagaaagaaatctgctttaaaaactgtttaagcattccaaagttttagaagttgcatgctttattccttaacatgtcctctattaactgtttttatacctgaaaatgattatgccatgttactaatttagtcatttaaaatgacaggaacttagcattttgctagatgaaagtcctaagtctcagttcaacaacttataaacttgtaacttgtcctgtttatctgttctatctgcctggactccagttttcaatccaaggatccacaagtatttttgaataaaagctttgctttgaatatccagtgacaggaacacagtaataccacacagagtcatagtcctagccagtaatttgtggtcaatagccctaagaggtaagatgtgggtaggtaggactacccttccttgtagttacctgaaaagttagatatatctcaattttgtgttattaactatttatggctttataatcatgttatattctacctatactacttattagttctactaagttctgtaagttaattatctataagtcaaattgtattttcttttattggttctacatttactaaatggatgttaattctagattttcagtaaactttgcttttctgattattttaatttacaaatgtcaatctttaatgtttcctcctaggctttatctttccaagctaaaatatctttttagtctgtgacccctaatataatgatctaacatacttctatcgtccagttgctcttttccatttcataacatattgtttctgctagatactgaaagtgatactccaaatatgttcatataataattggggaagaatggtctaagttttaaattttatttatcatataagaaggtattaaagcttggaatttaaaatttaaaaaaaaaagcactgataaaaatcagtttttaggaactcaaaactcattttcccatagtagaatacatggaaatgagtgtcctaggccagccactacactgcattcaaataatggtagtgacgcagggcacagtggctcacacctgtaatcccagcactttgggaggctgaggcaggcggaccacttgaagtcaggaggttgagactagcctgaccaacacggtgaaaccccgtcgctactaaaaatacaaaaaattagccgggcgtggtgtaatcccagctacaggctgaggcaggagaattgcttgaacccaggaggtggaggttgcagagagccgagatcatgccatggcactccagcctgggcgacagagcgagactccatcttaaagaacacccaaaaacgcaaaaaacaaaaacggtctgtattaagtcatttcggttctctagaatagtgctgcccaacagggaattcttctatcaagcacttcaagtgtggacagtgcatgtgagaaactaaattttaaatttttgtgaagttttagttaatttaaatagcccaatgtgctactgtacagctatttaaaaatatatttaatagctgcactgctactgtagagcacaactgttaaaaacctgtttcaagttatatttgggatgctaagaatgtacattccattttaacagttgctgggtacctcaagccgcggggaatcagaagtagccagggttcctaataatgtaaactattctttagcctagtctggtttggtttcaaattactacccttctttccttctattttttttcttccaaagtctgtttctttctgctgttacaaaacagagctcctttcccttccagttcacttcaaaactccctctccctccttgctcttgctgttctcttcaagtaagcccatggtatctaaagatacctacatcctggttaatactacaaactttagaatccaacaggtctagattcaaatcctaactctaccatcattcaataaatggctgttatcaagatcattattattcttattgtcagaaacaacagagaaataggaaatagtaataaaactgttgcttgccactttctttgttttccctaaagcaaatgcaaggactaaaaaaagataaatcaacattactaaataacaactaaattgatcaagtctcctattagagtgtgagtgtgtgtgtttgttttaagagaaacagtcttgctctgtcgtccaggctggagcgtggtggcacaattacagctcactgcagccttgaattcctgggctcaagcaatcctcctgcctcagcctctcaagtagctaggactgcaggtgcacaccaccacattcaaccattttttttttcttaagacggagtctcgctctgtcgcccaggctggagtgcagtggcgcatctcagctcaccgcaacctccgcttcccaagttcaagcaattctctgcctcagcctcctgagtagctgggattacaggtgcccgccaccacgcccagctaatttttgtatttttaggagagacggggtttcaccatcttggccaggctggtcttgaactcctgacctcgtgatccacccgccttggcctcccaaagtgctgggattacaggcatgagccaccgcgcccggcctcaactaatttttttatttgtagagatggagtctcactctgttgcccaggctggtctcaaattccagacctcaagcaatcttcccaccttggtctcctaaaatgccgggattacaagcatgtgccactgtgcccagccttctagtgatattttgtcaaaaaggtaaaatcagattctctggttacacagaaagaagagggatataaatggccacgaggaaatatcacactattaccaatcctactcccaagcccaatcctgccatgacagaccctactatggatgagcactgatatgataaatgagagacagaggtgaataaaagggaaagtagaagcagtctctatgttgggcacacttatgccaagggcataccagtccccagaattagtttctagttcagtttctaagaagattatcagtgacctgattgcttgttagcagttgatcaacaaaagcaatttctaggaatctttcatattcacttcctccactgtggacctatgttaagaaaaggaccaagcaccattcactgatgaacaaattatcctattatcttgtgcttaccagataaatggaaaattaagaagctgaagtcacccacatttacaggtcttttaataaaatcagtttcctatatcaatccagaaagtaaggatatgtttcagaacgtctctaaaattctcgtgcagtgtggaagcgagtgccaaaataatccataatgatgcatgtcacctcacactatgctctacaatgatcaaaaacctaattattgaaacaaatcattttctaaagagtaaaatgaataaagaataaaacactttcaaagtgaaaggcaagccagaaatcgtcagccagacaatgaagactgaattgaaaataggacaagtttttcaaagctaatacatttatttagaaagttcatcaagtgttctaaaaaaagaattaattttcctgcttccttcttcatttaatgtagcatcatctccttaacagaaattgtactgttgcatgcagcaaggtcacctacatgttgaaaaaaattataaaatataattctcaaactgtatttaacatgaatatgaggtgattaaagttggcattacattccaaaatatatcaaaagtgagatcaaggagttccagttccaggtaagatggaataaacacatcccaccttgttaatctcactgaatgaaactacaaaatactgacagaatgaatggagcagctatatgaagactcaggagtaaataatagcatatggactagagaagacaccagaatctgatgcatcatcaaactgtcagtaagtttaccaccttttctccatccagaatcccctggcctgggattaataaagcctgaaacctagaaagtaggcactggtaacaacagagagcaagctctaagagaatccctctaaatataaagtgaggtgggtaagggggaggggagctgggggtaaggagtgtctccttcctaatgttcagaaagagagggggaaactgctcctttttttttgttttccccctttctctgttcctcatgtcccaattcccaaatgatctggtgatggtagtgggtgcaacagtggcagcagcaggaacctaaaactcttaagaaaagagagagatgaaccatcctcaccaaataaaaaaactctgggccaatcttgttgacttctgtcttcctgttacttggatccagacacagttacagaaaatggagtaaatgaaaaccaattttctggccaaaagacagaaaagactgtcccagggatctagaaaataccatggatataacagagagaaaagaactcaagaaagtaacagctgtttttgaactcctaactcacccaagctgaacgtatgtggatttaaacccaagcagcataccaccgactctgaaaactgaaatataagataaacctccacacatgtcacagactggctactgggtagcgcatattgaaaaagtataaatagtaatgtaaagttttgaaaacagaactgaagttaaaaaactacaacctacagaaagctaattggaacttgtgaccaacctgaacccaactggatcaactgcctgtaaaaataaaaatattggctgggcacagtgactcaagcatgtaatcccagcactttaagaggtcaagatgggaggactgcttaaagctagtagttagagaccagtctgggcaacaaagtgagatcctctctctacaaaaaatagaaaataaagtagccaagcatagtggtgtgtcactgtagtcccagctaatcaggtgactggggcaggaggatcccttgagcccaggagttgaaggatgaaggaaagtacaatcatgccatgcacttcagcctggatgcgacagcaaaaccctgtctcttaaaaaaaaaaaaaaaaaaaaaatccaaaaaacaaaaacaaaaacatcaacattttccatagcatttaaacaaaagacaaagttttgtaacataatattcaaaatgtacagaacacaatccaaaattacttggcatagagagaggtgggaaaaataacactctcatgggaaaagacaattaaaagaaaacaccaccaagatgatacagctgggtgaattatctaaaatgaattacctaacaagcagacaaagatttaaagccagtatatatatatatatcgatatatatatatatagatatatatatagatatatatatatatagatatatatatagatatatagatatatatagatatatatatagatatatagatatatatatagatatatagatatatagatatagatatatagatatatatatagatatatagatatatagatatagatatatagatatatcccaacaagtataagcaaatacttttgaaacaaatggaaagccaaaagatcacagcaaacaaacagaagacataaagaacaaccaaatggaaaccaacaaaaagtgaaaacggaaataaaaatacactgaatagactcaacagaagaatggaaataaaagagtaaagagtcagtaaacttgaagataaaccactagaaattacccaacctaaaaaacaaagagaaaaacattgaaaaaaaaatattaaaggcttagggacctgtgaggcagtaccaaaaacccaacattcacatcaagaatgcaagaaaaggaaaatcactgcagaaaagaagaaaaaagaaagtagaaagaagaagaaaaagaagaagaagaagaaataatgggtggaaacttcctgaaatttggtgaaaggcataaactgctacatttaagaagttctcaaaacctcagacagaataatcccaatgaaatccatgcctggacacacatcagagtcaagctactgaaagttacaaaggaaaaccttgaaagcacccagaaaaaacaatgatgcattacttacgagggggagggagtttaatgatttgaatcaccggtgatttcttatcagaaaccatgcaagtcagaagaaaggggaacaacatccttcaaatgctaaaatggaaaagaactgtaaacctaaaatcctctatctagtgaaaatatccttcaggaatgaatgtgaaacaaaaggtattcaaagtggaagaaaaatgatgagaattcttttccagctctaaaaaaattcttaaatgaagttgtgtcagaagaaaaacaatgttaggaatgatggaagatcaacagaaacagtaaatgcctgagcaaacatagttaactattctcatcttgaattctttaaaataggtttggcattaaagcaaatatttataacactttctgataagatttccaatacaggcatatatacctcaaagacatcatgggtctaggtccagaccggagtaataaaacaatattgcaataaagcaagtcacacaaaatttttggtttcctagtatatatgtttatattatactgtagtccatgaagtgtgcaacagcattatgtctaaaaactgtacatacttgatttaaaaataccttattgctaaaaatgctaacaatcatctcagcaaggcttcagcaagtcataatctttttgatggtggagggtcttgctttgatgttgatggttgctgactaatcacaggatggtagttgctgaagggcagggttggctgtggcaattccttaaaatgagataacattcaagtatgccacactgacactcctttcacaaaaaatttctctgtgtacaagatgctatttgacagcattttatccacagcagaatgtctttcaaaattggagttaatcctctcaaactctgccactgtgttatcaactaagtttatatactattttaacaatgttcacatcttcagcaagagcacattccatctcaagaaaccacattctttgttcatccctaagaaacaactcttcattcaaaatttatcataaaattgcagcaattcagtcatgtcttcaggctccacttctaattctataatagttctcctgctgtttataccacacctgtaatagttacttcctccacacaagttttgaatccctaaaagtcatccatgagggttggaatcaacttcttcacaatcctgttcatattttaacctccttctatgaattacgaatgttctttatggcatctagaatggtgaatcctttccattactttgcccatatccatccaagaaatcactgtctgaagcagctgtagccttatgaaatgtatttctaacagaataagacttaacagtcaaaattacttcttgatcactgggttgaaaaatggatgttgtgttagcaggcatggcaacatttatctccgtgtatttccatcagagttcttggatggctacgtgcactgtcaataagtaagtactatgttgaaaggaatctttttatctgagcatttggtctcaacagtgagctcaaaatattcagtaaaccatgctgtaaacggatgtgctgtcatccaagctttgttgttccatttatagagcacagagtagattcagtataattcttaagagtcctggaattttcagaacggtcagtgagcactggtttataaatttatagtcaccagctgcattagcccctaacaagacagtcagcctgtccttggaagctttgaagccaggcattgacttctcctctctacttatgaaagtcctggatggcatctactttcaatagaaggctggctcatctgcattaaaaatcttttgtttagtatagccactttcatcaatgatgttagctaggtcttctggataacctgatgcagcttccgcatcaccacttgctgcttcgccttgcacttttatgttatggagatggcttctttccttaaacttcatgaaccaacctctgctagcttcaaacttttcttctgcagcttccttatccctctcagacttcactggcttgaagagcgttagagacgcgctctggattaggctttgagttaagagaatgttacgactggtttgaccttctacccagatcaggcaaactttcttcatatcagtgacaaggctgtttggtctaatttcaatactgttgagaaacagggaggtccaaggagaaggggagagatgagagaacagctggtcagtggagcagtcagcacacaggcaaacataagttacctgtcttatatgggcgctcttcgtggtgccccaaaataattacaataataacactaaagatcactgatcacatatcacaacagatataataataacaaagatatttgaaatactgtgagaattaccaaaatgtgaaagaaacatgaagtaaacacaagttgttggaaaaacggtggcaaacctgcttgatgcagaattgccacaatcttcaatttgtaaaatatgcagtatctacaaaacacaataaactgaactgcaataaaaagaggtatgcctatatgtgtacatttaacacaagataactgcaacataaagggggaaaggtaaagggacatacatggtggtaagacctctatttcacttcaagtggtaaaatatcaattctaagtagactaaaattttaagtatgtataattcttagagctaccactaaaaacattagtcaacgtcttgtgtcgttccaccttcatttcaagaagggtgagtaaagtacagtaagatattttcagagagcccacattcacataacttttattacagtatattgttataattgttctattatttgttattgttaatcttttctgcacctaatttataagttaaactttatcatgagtatgtacatataggaaaaaacatgatagacatagagtttggtactatctgtagtttcaggcatctacttgaaatatatcccacatggaaaaggggtaactactatacccagttcccttcaaatcagtccaagttggccagttaaaatggaatactaaaaaaatgttcaaataacccaaagaaggaagttacagaggaacaaaaacagagggaacaaacagaaaatagacttgaacccaaacatatccatatttaaaatatgtgagatgtagcaaaagcactatagtattaaatttcttctatcagaaaaggtctcaaatcagtaatttaaacttgcaccttaaactaaaaaaggagcaaagtatatacaaaactggcagaaggaagaaaataaaggaacagaaatcaatgaaattggaaacagaaaaacagataaaaatcaatgagaccaaaagctcattctttgaaaagatcaataaaatttaaacctcttgccagactgatgatgtagatagcctgaatagccttaggactatttgaagaaattgaatttgtagttaaaagccttccaaaaaagaaacctcgaggcccacataatttccctggtgaattctaagaaatatttaaaggagaaataacaccaaatcaacacaatctcttccagaaaatggaagatgaacacttcccaaatcattttatgaatccagcattatcctcatgcaaaaaaaaaatagtacatgaaaagaacaaatttatattctgctcctcatcaaaacaaaaactatggtacattcaatcatataatgaaatactgctcagcaataaaaaggaatgaactagcatttcattcaacaaattgtatgcatcttaaaggcattctattttgtgaaagaagccagtctcaaaaggcaacatattctagaattgcatttacatgcaaacctatagtgatgaagaacttgttagcagttacctgggttaggggaatgtatgacaacacagtttttggcgggggtgggatgatagaaccattgcaaatcttgactgtagtggtaatacagatctatacatgtattaaaactcacagaactatacacctcaaaaagctcaattttactgtatataataaaagttaaactttcttaaaaagactaacatgagagcaattttttgaaaatattatgaactaaaatataaattgttaacattttcaggaaaggcactttttcactgtcaacttcatagtttcagttgttccaattcttataactactgccaacacagaaggcacccaaattatactgccacaagatgagcttgggagggggtgtttgaatgttttatctctgctttctccatttcttcagcactgacagttctgagagacaacagatatctataacctgtacagacacagagattaaaaacaacaggctcaatttaacaactgcactaaattctaaggcagagttgcagaaacagatcagttccaaaaccctaatgatagcatgggtgatcaccaaaagaagacatctattatgactcccagttaggttacactcttatgtgacagtcatccactctatgggaagaatatatttacaacgcagtactttatttaagaaaatacaaatgagtgccttttatgtgcctggatagtttaccatgagagtctgaaaaatcatcaaatgacaggcttccattacttctccaaataagaaacaactgtaaacagtagcatatgtcctttgataacttcaatatatttatgcaattgttgtctaataaccccacccctgcttaagttatggaggacagaacacaaagagttggttacacaatcttcatttatcctcaagattctcatccccatttactgaagtacaatgacataactaatttatatgctaagggcaaacctaaagctctcttatatttatttccgccaggcaatttctgaatgcctgttacaggtacttttaagggatgagttatacatttggaaaagtagagtttacacgtagaaaactaaactttatgcctattagtgacaaaaagcaaaagagcagtgagatgttacagactcattttacaaccaaacttcccaagaagactacaggagcacttgggtcaacagcactgtattttcacatctgggaggcagaataacaaagagaagaaaggcatcttggatggacgtatggaagtagaggaagaactggtgaatttttatccttttaagaaaaacaggaaaactgtcaactatatttttacttcaacacttggtgtaccctggaaagacttctgagcagaaatgacaatgcctgtccatctactcacctcccaaaaaagggagatgggaaaattgtgtagggcacagaaaatacttgcaaataataaagaaagctctcttagttcatttgtgctgctgtacaaaaacaaacaacaaataaaaacaaacaaacaaacaaaagacacttgagacagttaatttataaaaaatagaaatttctcacacagttgtggaggctaagaagtctaagatcaaggcatcagcaggttcagtgcctggtgaggatccggtccctgcttccaagatggcacctgttactgcatcttcaagtattaggtggtggggcttttaggaggtgattaggctgtgaggctatgccctcatggatggaattagtgccttataaaagggccctgttagttctctccagcccttatagaaggcactaattccatccatgagggcagagccctcacagcctaatcacctcctaaaagccccaccacttaatactgttgcattcaggattaagtttcaacatgaattttggagagggcataaacattgaaaccacagaaaaatcctaagagttaaagggggagaattagtgaaaataaatgaccacataaaaatgcttgtcacagaaaaatgagaatggatttaataggaaaaaagggatgatgttcaaaacactgcttctgaaattctaccccgttctgtttaaacaagatttttaaaactttacagagtttcaattccagaaattagtttattttgcacaaatgctgaaagttactctttcgttggtttcttgagaactgatcactttcttcatactaatcccttacaaattggtacaagtagttattataaaaccaagacagaaaaaagcaattatcttgcacagtgtaaacaggacatctactcttttctctagctatgcctattatctgaatttcttaaacacaaactcatccttctaggtatctcagagataagtacaattatgttacataaatgtatatgtatcaatgtgccctcatatgaatattttacacataatttaaagaagcatttcacaatcctactcctatgaaatacaactctaacccagataccgattgtattacatactatgcaaacttaaaattaaaaaaaaaaaaattctgccacattagcataaggcatgaatagatattgggattctttcctaaatgtaatcatatcacaaatgctacaaatgcccataacctagatttttgtgtaagcgtttcatattatttttggctactactttctaacaggtcacgaatgatctcatttaacttttatagaacctggtgaaagaggcatctcaattttacatacaatgaaaataagtaacatgcccaagatcgaaaagccagcattaagtagtaggactggaacccattagcaatttaccaacaaataacacaaatattaatccaagtcaccagaaatcatgagtattcaaacaacaagaagtggtaacattcttaatgattcaaatgactgcaaaaatgttaagcttttaacctgccttctttatcactatattactaggatccaacagcatgccttcaaaggaatgcccaattatttatggatatgtttagcaaccatagcacatgttatttgtcaggcatgattctaaacacacttagtccctctctctacatatattaacaaaccactatgatcttgagagattaacttcattttacagtgatactgtcattacccccattttattgtggaaacacctagcaagtgatggagctgggactgaaattcagataatcaggctcccttatgctcttaaccattgacactaaacggcctaatacacaaaaggatctctataagggtcataagttacccaacaactcacctgaacatcatatccttacagtatttatgtaactaattaagtaacatttatctgagtccagtggtaataaatagcagctaactctatgttccattctcttaaattagctctatttagtgagtgactctcatgcccttttagtgcaaagaacctgagagtagaataactggattaagactgtcctgctccaccaggttccaaaatacctgtgtttgggaggagtgttcctcctcccaaaatacactaataggaaaaactaaactgatattagtaagatactagttatcaatgtcttaggacataacctaatatatcacatcatttagaatagtttgttttagggaaacagggcaggtgatttataaattaacaaaataaagaaatattgtcaaagagtatatatagttggtttttggaagagacaactcagaccaaaataatgctgttagagattgagtgatattcggattatcacctaaatgtaatcttattataaatgctacaaactgccaactaccttttcaagtgaaatttctaactggccagtcttctgctatgttcaccatgactaacacaggatatgatttgttcgacaccataaaagtatatcagtaagacatgttaatgagaaaggaaacagggatgaagagtcaaaaacgatgaatgaactcatccctaaaacaaactattctaaatgatgtgatgatgtagagaacagtcttacaaatccatgccaaagaaataaccctgatattaatccaagtcccttaaagttgtatcaaaataatctctaaacaaatagccccttacagctctgagattcctgtctcccaaaaagatccaaaaaccgaaacatcattctcccattttctgaggaataaatataatccgtcatccttgaataaatacgtttttgttttttatctcatttccccaagttattctagttacagattaactctagactgttcacctatctctaacaaaaatttaaaaaattagccgagtgtggtggcatgcctgtagtactaggtactctggaggctaaggcaggaggattacttgagcccaggaggttaaggttgcagggaactatggccatcccatagcattccagccaggggacagagtgagaccttgtctctccccatacctcccaaaaaaggaagaaaatagaggaacaaacattattatattaaatgtaaataatgtaaataatcgtgcacaccaattaaaagagattatcaaactggattttaaagaaagactgaattatatgcctgtctacaagaaactccctttaaaaataaagataggttaaacatatagaacaagatatgccaaataatgcaaacaataataaacgatggttggaatggctatattaatatgaactatattttaaacctttttaaagagtctaagtggatttgtttaccctccattcagttttaattatatctagttctgtggcagttttgaaacaatgaagctatttcgtttcatccatctccctcatattactcaagctgatgtcttaagtaactggacatgcacaacagtttctaaagaaatatgacctattacattaaaactgtcctatctgaagggttttctatgatgaagttttcaggtgagtgatagcttataaattttttgagtcattaatatttattccccattataacagcttacagaatcattcttcttgacaagccatctaggcatacaaaatagtgctatacgtatatttacattaaaaaatcacctatcggggccgggtacagtggctcatgactgtaatcccagcaattcaggaggccaaggcgggcagatcacttgaggtcaggagttcgagatcagcctgaccaacatggtgaaaccgtttctactaaaaatacaaaaattagccgggtgtagtggtacacgcctgtaatcctagctactcaggagactgaggcaggagaattgcttgaacttgggaagcaaaggttacagtgaaccgagattgtaccactgcactccagcctgggtgacagaatgagactgtgtctcaaaacaaaccaaacaaaacctatcatttgtagactgtttcattgatcccagagaatttttataacagtgttgttttggccgctgtctttcatgtttgtacttctgttttggtttactttaagctgctaaataactactgtggtcagggtactgagcctggtattggaatataaagacggattaagatactgtatcacttcccggtacaaggagtagacttggagacataggatacagaagatgaacaagatagcatatgccaagtgccaaatgtgagaaataggcaaagagtttctaagacatttttttaaatgtaccagtgggggagtaactaacgactgaggcaagtaaagaaaaataatgataataaagtgcaaaaagttaatgttcttaagtccaattaggacttacgttgtgtttccttaggtggacttcaagtctatctctctcccatttatttgttttgaaagtggtttataagatgtttaaattggggattttgagcttaatgtagtagcagaaaggtggcagtggtggagagatggaaagtacgagaaactagttaggagaaaatggaaagaagactagatatcaaaaaagaaggcctgattaggactaagctcccctagggcacagacctaatagacacatagatatcaacaaacctggagttcagaactatgggtagagtgaatgcctacaatatactacgtaatgaactacacattctggcatgcctttccacatttaatcctcaaaataccagaacacgatacatttaaaaaattaaaacaccgtcaatactgaacaacagaacactgcattaaaaaggcttaaaaatcacccactaaacaaagctaacttaagagtatgaacagagacagagttagctgctattaccactggacttagataaatgttattaaaaaattaggtgaggaaattgagatactgattagatcacctataaaaggtgacaatcagtcatctaggacaaccagagttcaaaaccaggtctgactgactcctaaacctaaaacacacacacacacacacacacacacacacacacacacacacaaagactgaactaatttttaccttactgtcaaaattacaataaaaagacaaccctaaaagtacatctgagaagtctagggtaaaagaaaggataaaaaaggaagaagtttagtcttatccctaatagagatgtgagtcttaagagggtttaaatttactcaagagggtttaaagattgagaacacttttaattttcactaaaagtgttggtataataatcttttacaaaaaggaataagtataaactttaaaagaacacgtctgtatgctgctattctggctggaggcattggagcccaagttagtgagcaaaatgctcatgttacgaatagtgagggaacccagattaagattctttttaccttaataaaaagaaaaagggattacttctttttagactccttcaacttggaacagtcccccagtcttgactttcatgaccttgtttgtactccttaaagcttatagattagttctgttgcaaaatgtcttccaatttgggtttgcctgatacttccttttattttttttcagatgtagttttctttctgtaggatgccagatatttccttatggttagattcaggttgtacactatttgacagtaattatgatgtgtttttctcattgtgtcctgtcaaatggcatacaatttctgtttgtctcattactgatgatgtgcactttgataacttgattgaggtaatatcatccaagcgtcttcactgtaaagttacttttgtcccattggtaattaacatgcatttttgtggaaaagtattttgagactgtaaaatagcccattccttattaaacttgctatttatttattccgagattatctcagctttggctagtgaaagcctttcaagatagtttctgttttcttttgacttgctcttcgcacttcctttttttttttttttttgaggtggagtctcactttgtcgcccaggctggagtgcagtgtggtgatcttggcccactgcaaactccacctcccaggttcaagcgattcttgtgcctcagcctcccatgtagctgggattacaggcatgggccactacacctggctaaattttgtatttttagtagagacaggattttgccacattggccaggctggccttgaactcctgacctcaagtgatccacctgccttggcctcccaaagtgctgggattacaggtgtgagccaccacacccagccacttccttacttttggacataagaaaatgaagctcaccttgtactttccctgccccagcactggaatcaaccattcctccaaagagtggttgcttttagtggagaaaggtatttagaaaacaagatttggatgctctaattatttcaatgtctatgtgtagaaaaccatgaattggtaccaatttctccaatttcagtccgcaagatttgttcttgttttctccattaccaaatttataactcccttctcaccaggagaactctgactcattatcattacttactaaatttgatcaaccccctgcatgtggccagtttcccattgcctttgctgttccctaccttctttgcataacttttttctctacttaggctctgacatcctgtcctgggatgcaccccttaccccatacttcttagataccccatactgaagattttaccattctgtttgagctctagtaccttaatctgatctagaggttcctctagatcagtgaaacaactgaaggccgaaagtcagatggacccagctatagatacttagcaacttctctgacacttaacaagtcatttaacttctccagagccccagactcatttctgtaaaatggactaacacagtcaacattgcaaggctaccgaaaagatcaaatgaaaatgtatgtaaaatgtctacaacagagtggctgacacatagtaaatatctgataaacattagctatcttctgtaatatgggtgataatttcttaaactttgatctcaatacttttagatctagttaagcaattagagaagcatcaatctgaaaataagaaccttactgtcctgcttgttcaaaaggccaatgagcttcacattgttacactcaacagaattttttttagttcttaccttattaagctcttatcaacacttgacccaactctctcttcttgacttctatctccttgtaacattctctttctttggtttctgtaacaccccactcaccctctacttctctgatcttcacggtattctctgggagctcacattcttccagcaaagttttttaaatgttagaggtcattgtggttccatcctaggccttttttcccccaagttatattccctcacctaggcaatttcatccatacctatagttccaattacctgtatgggagattccagttttccatttacagccaatactcttcctctgaatttcagaaccatgtatctaattgcttacaggaacttctacctgaaagctccaaaggtactttaagcctgatatgttaaaaccaaaagagctctggtccttatctggcacaacccaggaatgtaatccagaaatcatctttcaaatttctttctccctcactttcaatctattaactaaggcctgctggtctcaaatcccatccactgagcccatctccacaattatcatcctaattcaagctatcctcatctctcccagactactaaaaaagcctgctaactaattctcccagatctcttgctgcctctctcctccctttcaatacacatcaccacaatcctagttttgccttctggaactataagaaattaatatggcttctaaatgacaacatttttaacaataagatagttatactgcttgatatggtttggctgtgtccccacccaaatctctcttgaattgtattcccataattcccacgtgttgtgggagcaacctgttgggagataatttgaatcatgggggcagtttcccccatactgttctcatggtagtgaacaagtctcacaagatctgatggttttaacagatgtttccgcttttgcatcttcctcattttctcttgccaccaaccactatgtaagaagtgcccttctcctcccaccaagattctgaggcctccctagccatgtggaactgtaagtccaattatacctctttttcttcccagtctcaggtatgtcagcagcatgaaatcaggctaatgcactgctctactcttagctgaggcattcttagctccttctatattaagacaaatgatagtttcaaggtcacatactgttatactcctctaaaaacacagaccccttaggctgggtgtggtggttcattcctgtaatcccagcactttgggaggccaaggcgggatgattacttagcccaggaatttgagaccagcctgggcaccaaagtgagagctgtgatcacaccactgcgctccagcctgggagacagcgagatgctatctgaaagcaaaaacaaaacaaacaacaacaaaaaacaaggacccctgaaatgaacatggcccacatgcatggatataagtaacttggcagtttatgctacagactgagacttgcttagtctaaagtttcaaaccacaatcactatttgtaacgtttacagctgaaagcaggttaattcattaacttacactgaaggcattgttcaggtgtttaggtgacaaatactgacaaatgctgatctcacagaagataaatcacagtgaagaaaataaacaataaacctaagttagattacacaatatgttgcaaaatgataaatgcaatggagaaaaatctagcataaaaacagatacaaaatatcgggggaaggctgttgttttatacacagtagttagagaagaccacaacagcgtaggggaaaggagattggagaaagggtgaggagatgaagtcagagaggaagaagagacttaaatcatagagccttgtagaccataggagtatggaatttactatgactgagaagggaagccatttgagaaaagaagttacatgacctgacattttatcaggatcactctggctatggagtgttaaagactgtagatcagcaaaggtcacagtgactttttaggaagatatttttgaaagcaaaatagtggttgtgtttttacgttatgtattgaatttttatgtgtctatgtactaggatttcatacattaagttcatagacacaacttaaaaaaatacaatgcaaagatgagttttgggaatagcaagagaatgatactggatattttaactctgggctctactcagcactactaacagttattactgctcagaagcaagacaaggtgcaaggttattaacttattttgggggacagagtataattaaaaatctggattttaagtttatttcactgggcaaggtaagtcaaggtacaatttacatcttaaaagacaaaagcaggtgatagcagggcttgctaaagggaagttacaatgaaaattattctacagttgactttctttttattacttttatgcctgctactctctttaattaaggtgctacaactatctctgatatactttaaaagttcagtattaagttgatgggtagtatagtactgtattttctgattactaaaagatgttactgatgatgaatcaacagtatcatgtaactgcactgattcatcctatctctgctgaataaaagcacaggttttccagaaaactgtctaagctctagttggtgccaaaggacgatagagagctaagtaactcctgaaaagtttcgatcttaacacactagccctattaccacatgaaggtattaacagaaaaaattaaaaaattatccgtaaaattttctccatgacatgttttctggcaacatatttagaaactttaaattttcttctacagttttcttcccctttatactgaagaatgtctttaaagcatgagtatacttacagtaagcaaacattcaaattttaccccagtgaaatcttaaaatgtactcaaactctcaggcaaaaagttcactatctgaatgtgaaaaactgaatgactgttaaaatatctgcaagcaccaaaaaatattatagctaaaatgcagctaccctaagaactgtttttaaaaaactcacattgcataaaaaatataaattcagattatccgataggataatataaaacaaaagaaatccaaagacagtttcaagatttcatttctcttgcttagttaaaacaacaaaaacaaaaggcccatgaactttttcttgcatcttttaaccaaaatagtgacatgatcaagccaactgccaaagaaacaggaaagagaaagcaattgtttagaaacagacttgattacatgtcaaaattttaatacaattactaataaaatacaaaaaccaaccgttattttaaaatgtactgccctgatattctgctgctgaggtaggtggtgatatgtagaaattaatttttcttttaaaacgaaaaaataatgcatttattaatatgcttttcccaaaattcggggaaaattcccaaatcggagaaaaaaatttaacatcagcatctactacacaaagcattaaaaacatttttcagcagttttgcttaagtatcttaggtcagtggtagcatgttagccaaaatgtaatccaaaatgaatgaacaacagtcagctggtagacactgtatgtaatacaatacggaaatatattggaagtatttcaaaattcaacatttgaatccgtgaatgtctaaatcaagtactctaaatcaggcgtctacttttgaaacaatacttcaaaatacgtgttggtggcaagaccgccagccatctgtaggaaatctttttaatggttcaaaattcctaggtctcagaaggggcgactgattaggctaaatttatatctcccggccccgtagttgtcagcccaggtagcgaatttaaaacactgggggtggatgagtagtttgaagttcagatcaaggagtgaaaaaggctgatgcttagaagcgccggctcttccccattcgcgcactcgagaggtcacggcgtagtaaagtttggtttcactagcgggcttggacgctcgcgaccaaagtctcccaagaaaagccgacaccgcggtcgggagcgcccggaagctcagcaggacacgtttccactgcagggaggagggtgtctgtggcggttctggcgtggagccccttcccccccccccgtaggaccctgcacccggacggggacaggcttcgccagctaaggcggcgggagacgcgtaggccacaaggaggaaatgggacagagtgcgacagagaggcggcggcggcccagggccgggccgagcctccctcgcggggcagcgagagggaaaggggccctcccggccgcagcctcccccacttcgagaggtagctccaactttcctcccagcgcacgacgtcgcacgggccgcgcgagattccgaaactttgtcagccctcgcgtcgccctaggcccgctccagcgctctgcgccggccgctaaccctcgtctctcccagacagctgcccaagcccatccaccccgcgggtcgaccagtgtttacctcagaccgaggtcgaggcgctcggtccggccgcggccccacagtaggttcccaggtcccagtcactccgctgccaagttccccaacatggactccttcgtccgctttgtggtgttacagggtctctaggacactgactccgctggctcggtccggaggcggcggcgaagcagggagcgacccaggttgcgctgctccgcgcggcttaagccaccgctactcccccttcccccgccttgtctagcctcctccctcccctcccctccctgcgcgtctccctcctcctcccttccctcgctgtcggcgcgctaaggtgacgacggcggcagccggactcgccacattctgcttactcgctcgctctggccctgagtgcatgttcgtagtacccagttgggccgcaggggggcgctggcaaactgctgtttgagaccgagaagcgtggtgggtggagtcacgtcacgcggcctgtgagcgggaggaagggcagctgcgctggaggggccttctgggaaacgtccttccagcaccgcccttcgcccacactgcggatggtgcgcatgcgcagcgcgtggactttggcctctgccctcctttggcagttttacaggctgcgtcgcggaggacaatgaaagaggctttaagggaactggacaggaaggattttgcgcagggtgtgctccttatctttatggtaatctgatattgaaaagagtgtccgcatgtttgcggtggattgagtgttcacctggctgcgctgcccacctgaaatgcagcctgtggagtgaagagtcggcaatttggaagcccacctttcctcctttctggtgggcatttttttagatgccagggggagagctttcccgcctgactccccgagcctaggggctttcccatgtcttaaccccacatcacaaaattaaatttgggccaggtgcgcggtggctcacgccggtaatcccagcgctttgggaggccgaggctggcggatcgcttgagctcagcagttcgagaccagcttgagcgacgtattaagatctcgtttctacaaaaaataaaattaaccggccgtggtggcgcgcacctgcggtcccagctcctcgggaagatgaggtgggagaatcgcttgaacccgggaggcggaggttgcagtgagccgagatcgttccactgcactccagcctgggcgacagagcgagaccctgtctcaaacaacaacaaaaactttatcattatttacttaaaaggcctccgcgttgtggttagatagtgacgtgtgtgccatcctccactttttcccccggcgggttgttaaatgttttgttttacctcggaggtattttgactttttcaaagtcactgattatttaacctcctagtttctcttctcgtcgactgcagcaagcttccggttgctctgcctgccctcagtgtcccccatctaccagctgaccttccagtcctcccacccacgcccttgtcctgcttgcggctcccgcaggactaagctctgctccccgcgcgcggctcacccaggtcccagtcgctttcagccgcgcgctcacacgttttcctgtcgcctgcccccgttctgttcgcgcgtgctgcgctctccagccaccctgacgcctgcccgggatgagtttcctccccactttgccgcggccccgccgaccgaccgcttcactgccgccttcctgcattctcgcagactacgttgcggcgtcccctgctcccgccctgaggacgtcgcttttctggcactttcatcctatgcattctgttgagtctgctcactgtctcacactgtgaggattgggacagtgtcttatcactttcataacagcgtctggcacttgctgaaggaacacatgaatggcggtcttgtcgctgtcaaagtctttggagtttttcagtgtactgtttttgatatggggtttgggaatttaggtggctttactgtatttgggatatttgaggggaaaatgagctagaggcgttaaaatgctttcttctgatggaacaacaaaattcttatgaaggacctttccctgtcaaaatcagagcaaatagtaaaggatatatactatttggatataaagaatgattataaaggatgattgttaagagaaatagtgaaaattagtgtggaaagctataaccagatcaacatttatgagccatccaacagaataagggtgtagcttttttatgtatacaatctctaggattcactctagagagtgtaactcctgatatggactcctggtgcaacatgcttctgtgtatgttttatattttaaaaaatctatatatatttaaaatctaaatatatttttaaaaatctcagttttgttttaggaaagtgttttttctcaaaatttaagcccaaatgataaaatctgccaaatagaaaactattttaaattgataataacagtatagtttcatcaaaactaaaaataccagatcttttgatgtatttgtttcctagcagagaattaagttttcacgttcttactgttggcctcctagatatcatgtgagcatgtcttaaggaaaaatgctcttaatgccactgtggtttctaccttcatgtgcaaatagaagagagtggtggtttgtaataggccattctttccagagaaaagttcatgtgtatttctgtatatgcagcatcctccttattatgtttggatgtaaagatttattattctctctgatgttttcatattttttaaatttacaatataataaagaggtacagagttctaaatcaataaaagatgggctataaaatggaggagtaaagttgatatatgaaccatcattgtcaacattttagatttgattttaactgtaaaaagcacaaatgatatgcatcataaaacagccttaaactgaatgtccacttggtgtgttgcactttaccaggcacttaaaatatcagtcctgtcacatagcaacagaaacccacagtggcacgtttaaaaatgggtaatcaacgtattgattttgatggagctttttcagaaataactgctattttaatttaacttataaatagaatacaatatcaagttcaaattaagggaggaaatcatgctgtaaatatactggattgaaaaacatggttctggccaggcatggtggctcatgcttgtaattccagcactttgggaggctgaggtggttggatcacttaaggtcaggagttcgagaccagactggccaacatggtgaaaccccatctctactgaaaatacaaaaattagcccgcatggtggcatgtgcctgtaatcccagctactagctactcaggaggctgaggcaggagaatcacttgaacctgggaggcggaggttgcagtgagccgagatggcgctactgcactccagcctgggtgacagagtaagactccatctcaaaaaaaaaaaaaaagaaaaagaaaaaaaagaaaaacatggttctaatactgtcacttaacaccttttcagttttgaataaatcacctaactttttggtctttagtttctataagaggacatttttattttaatgatctctggcatttttatggcaataaaaatgtgtgaattcaaaggacatactgtctgagcaacatagtgagacctagtttctactaaaaataaaattaaaaaaatgaccagctgtggtggcgtgcactggaaggattgcttgagcctgggaggtcagggatgcagtgagctgtgatcacaccaccacactccagcctgggtgacagagcgagaccctgtctcaacaaaaaggggtgatgtaaattttaaaattcatgtaaggaaaacatgaccaaatatacaatatccacgtgaggaaaaaatagtttgcaggaatttttttaaaaaccagtggtggctgggcatggtggcacacacctgtagtccatctacttgggaggctgaggtgggagaatcgtttgagcccaggaggttgaggctgcagtgaaccatgatcatgccacctcactccaggctgggcaacagactaagaccctgtcgccaataataataataagaatagttatttcatgtcacaactatgaagtattttaatcaggatgatactatccaattattttccatgtggaattaaatttatttcagcaacaattaattggacatctatttgggaggtgctttgagcttgtatataaatgaatacagtgtctcacagacagtatagtggtttcaaatatgtacaaagacaaagttgcattccttgaaagaaaatagaaaacaaaaaacaaaggaagaatataaatataaaaagaatataaaataataaaaacaaagcctggggagggagatggaataaaagaaggagagaatagaaaggaaactgtgatgattaattttagatgtcaacttgactggattaggaatacctagagaactggtaaaacattattttggggtatgtcagtgagggtgtttacagaggagattggcatgtgagtctgagtggactacaaggggaggatccgccctcaaagtgggcaggcactatccaatcagctgggagcctgggtagaacaaaaacagtctctgtcttctggaactgggatacactcttctcctggccgtggacatcaaaataccaagctctctggcctttggattctagtgcttaacaccagcacccctgccatcaggtcttcagacttggactgaaccacactcccagcataccagcatctccagcttgcaaatagcctgttgtgggacttgttagcctccataatcacatgagccaattcccctaataaagcccccctcatgtgtctatatatcctattagttctttttgcctcatatctaaaaatagttcaaattctaagactacttcttcatttcagtttatatttactctttttaaaggtaataagcattcattttaacaatttaaataacacagaagtatgtaaaatatactcagaagtaaataaagaaaaagactgttttcttctccgtatcccagtcctagacaaaaccaatgttaaagattgaagtttctctcaatacttattctaatgttttaaaacacttggaagttttcatttgtatatttacaaataatcacgccatatatatttttcttcaactctttctaactcagcagttaattataaatagctcattctttcaactagctgcataatattatgtagaattaatgtaccataatttttttttttttttgagacagggagaactctctttggagaaccctaatataggaaccaaagacaatttcattaaagaagtggtaacccaaaccaaatacagacaggtattattccaaatttgaagactctagtacactctcaggttggtcttccatccccgacaccacctcttctacatgtttatcactcccctgaagtctcaacctcacagccactgctgctgagccccttaaccctgaacccagcaaaggatctcaccacagtcattataagagagaaactcctcaacttctttccctctaccgacaaagtctatctagaactgtgtacatccatgactacttgtcttcctctatcacagaggaagaactatctagtctcttgtttaacccattcatgcctgaggttgcaattttttttattttttgagacggagtctcgctctcgcccaggctggagtgcagtggagtgatctcggctcactgcaagctccgcctcccgggttcacgccattctcctccctcagcctccagagtagctaggactacaggcgcccgccaccacgcccggctaattttttgtatttttagtacagacggggtttcaccgtgttggccagggtggtctcgatctcctgacttcgtgatctgcctgcctcggccccccaaagtgctgggattacaggcgtgagccaccgcgcaaggccacaattttttgaatttttgcaatcagacctcggcgatgatcttgagcagtaggatataaataactcccacatgcttagcgttccaataatggaacactaggcatggcttagctttctacttgtgctgcagatctgtttttttcagactttgatttatagaccattcacatttctaacaatttgaaaacagatatagggctggtaactttttaatcttgacaaataactatatatttgtaaagtccttccatatttgtcaccatgatttcttaagtacattttcaagccaaaaaaaactaaattttatgaaatactattctgtttgtttacatttccctgtggaacagtgaagccatcacagcccttgtacattggggctctgctctgaaacagctcccttctgtcccctcaggatgtggctccgtgagttagttggtcttcgataggtttaatgtctcctttactaaagactaacttatgtctctttgctccaggtttaaacacaatttaaattctaagactacttcttcatttcagtttctatttactctttttaaaaggtaataagcatgcattttaacaattctaacaacacagaactgtatagaatatattcagaagtatataaagaaaaagatcattttcttctccctatcccagtcctagacaaaaccaatgttaaaagattgacctttctttcaatgctttttctaatgtgttttagaaacacataggaggtttttatttttatttttacaagcaatcacactatgtatgtttttcggcaaattttctaactcaacagttaattataaatatttagcttatttagctcattcttttaactagctgcataatattatgtagtattaatgtaccatatatatatatttttttgagatctttctctatcatcacccaggaatgatgatagctgactgcagccttgaattcctggactcaagtgatccttctgcctcagctttgccagtagttggcactacaggcatgagctaccatgcctggctaattttttcttttttaacttttggtagaaacagggtcttgctatgttgcccaggctggtgtccagctcctggcctcaagtgatcctcctgccttagcttcccaaagcactaggattacagatgtgagccaccacacttggcctgttgtaccataatttttgaaactatttctgtattgataaataatacagatttctccagattttatgtcattacaagtgatgctggaataaatatccttatatgtatatcttttttaaattatgcatttttgtgtagaattgatcctaaaagtgagattgtcaaaaccatagatacgtgcctttaaaaatacattttaatagatactgcctgcagagggttgtgggattttatgttttgttgggatttttttggtaacagttttcagatgaattagtcttcttcctctcttaatctgtgggttaccaatggaattgggtcctccgttggcttctacattggacttcaactcaggactggctaacaagaatgtagtaccccactagttttaatgttctgtagttcagggataggtacatgaatcaattcaagccaagcagaattacatcgaagacttttgttctatgctgggcttgtcgatgtgaatatgtaagctcccttcacaaagagagacccttactgagaatgacttctcctcagagaacaaaagtagacatgaaaagagactaggttctaatgataccatttaggtaacctaaatacagctgtgtctggactttcaattatgtgacttaataagtaacttttttgagttgggtttgctgttacttgtgaccaatgctgttatgactgacacactgccagattacctctacctctagaattattttagttcattttccaatctaaatgtagaagaaacccatttcccacacccttgccaggactaacgcatgaatcttaaatttttgtcagtctgataggcattaaatgctatttcactgttgtttcaattcgctttttgctgactgctagtgcggttgatttcttttcgtatatttttggactgttcatagtcgttgtatttttgtgttgagttttcatccttttctgatctgtctatatgatcccttgtgtattacaactcttaactcctggcattccatatgtgcaggtactattttttttttcataatcatctttggactttgctcatggtagcttttgtcataagaaggttttaatttttatattgtcaagtctgacctggaaaaagtcactgtgacctcatacatgccaaatacagtgaactctttttttgttttgttttgtattgtttttttgttttttgaaaaggagtctcgctctgtcacccatgctggagtgcagtggcacaatcttggctcactgcaacctcctctgcctcccaggttcaagcaattctccttgcctcagcctcccgagtagctggcactacaggcatgcaccactatgactggctaatttttgtacatttagtagagaaggggtttcactattagttagccaggctggtctcaaactcctgacctcaggtgatccgcccaccttggcctcccaaagtgctggaattacaggtgtgagccaccacacccggcctacaatgaactctttatagtcctcaacaagcaattatctcatattgagtacctactgtgtaccgggctctacactaggcatgttgtccttgcccttaaagaaattacggtttagtgcagcagtcaagcagatgaacataattagtatgtagttgatgctgatgttgggtttgtgttaggggctgaaatatgtcccctgaaattcatgttttgaagtcctaactcccagtaatgggaacataaccatattggatataaggtctttaaagaggtgactgttttaaaatgagctctttagggtaggcctcaatccaatatgactgatgtccttataggaagaggggatacagacacagacatgtgtgcacacagaaggaagaccataaaaacagagacaagacagccatctacaagttaagtagagaggcctctgaagaagcaatcctgccagcaccttgatcttggacttgaagcctctagaactgtgagaaaataaatttctgtttgttgaagcctcccagtctgtgatttttttttatggcagccctagcaaaccaatagagtttgcctccacaacatcccttccattctaaccccttgtgtagtagtcatgtgattgtcggcgggggcaaagaataaaacacaacaccctctccctctccctccccctccccctcttcctctccctctcccctttcttgggtctccctctgttgccgagtccctctccctctctctccctcttctttcctcggtctccctctgttgccgaggctggactctactgccgtgatctcagctcgctgcaacctccctgcctcgggctcctgtgattctcctgcctccacccgtggagtgcctgggattgcaggcacgcgccgccccgcctgactggtttttgtatttttggtggagatggggttctgccgtgttgaccaggctggtctccagctcctgacctcgagtgttctgcccgcctcggcctcccgaggtgccgggattgcagatggagtctcgctcactcaatgctcaatgttgcccaggctggaatgcagtggcgtgatctcggctcgctacaacctccacctcccagccgcctgccttggcctcccaaagtactaagattacagcctctgcccggcggccaccccgtctaggaagtgaggagcgtctctgcctggccgcccatcgtctgggatgtgaggagcccctctgcccggccgccccatctgggaagtgaggagcgcctatgcccggcctccccgtctgggaagtgaggagcgcctctgcccggccaccccgtctgggatgtgaggagcgcctctgcccggccgccccgtctgggatgtgaggagcgcctctgcccggccgccccgtctgggatgtgaggagcgcctctgcccggccgccccgtctgggatgtgaggagcgcctctgcctggccgccaccccctctgggagccgccccgtctgggaagtgagcatctctgcccaggtgccccgtctgggaagtggggagcacctctgcctggccgccccatctgggaagtgaggagcgcctctgcccagccatccatcatctgggatgtgaggagtgcctctgcccagccaccaccccgtctaggaagtgaggagcgcctctgtccggccgccccgtctgggatgtgtacccaacagctccaaagagacagcgaccatcgagaacgggccatgatgacgatggtggttttgtcgaaaagaaaagggagaaatgtggggaaaagaaagagagatcaaattgttactgtgtctgtgtagaaagaagcagacataggagactccattttgttctgtactaagaaaaattcttctgccttgggatgctgttaatctataaccttacccccaaccccatgctctctgaaacatgtgctgtgtcaactcagggttaaatggattaagggcagtgcaagatgtgctttgttaaacagatgcttgaaggcagcatgctcgttaagagtcatcaccactccctaatctcaagtacccagggacacaaacactgtggaaggctgcagggacctctgcctaggaaaaccagagatttttgttcacgtgtttatctgctgaccttctctccactattatcctatgaccctgccacatccccctctccgagaaacacccaagaatgatcaataaatacttaaaaaaaaacaaaaacaaaaaaaacacaacaccaattccaggaatcagccctgactattttagatcattcaaggtaatcctatacttcttgctacagtgggtagtttaggaaacgcaagcattcctttagccaatttgtgtcagtaacacttgaagagctggtgactgagaaagacttccttgttcttcagataaagctactaaaagtgtgctctcttcctgtttggatgatgagaggtgagaatttaaacctggaattactgtagctactctgttatcataaactagtctagctttggaataatgctgcctctgtggaaggcccagaagggaggtggaacaaaactagtttcttgttgaaattagtaagccactgatcaaataaatcctgatacctgcctagttatgtaagccaataagtccccttcattatttaagcaattttgattttttaaaaatttacaatactaagggtcttcgcagttaagggatatgtggggaaaggaaactgtcacaggtcaaattccctgggaaacactttaagataaagattagagtgcagaaatgtcattggtgggtgctcttagaatccgcctgtagagagagtaaagaaagcaggcttaggcaaaggaagaagttgacctgcagtgaagtccaacagaggcctcagccattcctacagggaactctgaagactttatgccatctcattgaccaatcattttggctgtacccagaaatgtgaggaggccctcttcagcagagggtaagtgatagtgaaggattcagttgagagttgtcagcctcaaacactttcagcatctggtggaatgactgcttcattcctggattgggggaaatctacagtacaccatgcatgatatccactactgtctacctctatgaatataagatctaggagcagctcttccaaaattctgtggggcttccaagaaactggagaaacttactagaagaaggaggttggtgggattaattacagcctcgaaagctgctcctggggtcataattggtgctgatcatttccttcttccactacctattctagagtcccctcactctctgctggtctaggtagctgctatggactgaatgtttgggtatccccagaatttgtatgttgaaactagtcaccaatgtgatagtattaggaggtgggtgatttggaagtgattaggtcatgaagacagagtcctcaagaatggaattagtgcctttataaaagaggtcccagacagctgccttgcctcttccaccacgtgaagacacagcaagaaggcaccaggaagtgggccctcactaaacactaaatttgcttgtaccttgatcttggattttacaggttacagaactacaagaaataattctgttgttataggtcatgtaatttgtgatatttattataccagcccaaacacactaagacagtagcttacctagtggaataactcaaaccctcttcagtgagggggccaagtccttcatcaccaaattcttcccaggttgtagctgctgcacttttccatggaccatgtaaattgggcaagcaaaaaccaagagaaaaacaaatgggtcacttgggtatcaaacatattatttcctatcccttttgtggaacagctgccctactgaaatcagaatcaattaccgttgccagaatggtgactcctttccttgtttcttggaatgagaagactaaaatgaccaggcagcagctagagtttaatgggactcttcctgtgtctgctagtggaaacattttctctctcgtagccaaaatctctaacttacggagaaagaaggtacgacttccctaaacaaatccctgggaatcataatatatggagatattcctatttgcactctttagctcccggattcttgtattcttacttttgagaatatcaatttagagtgtacactgagtcctggggtatgatgcctcctcacagggtatcctttgcaagctagcaccccagctgaaactttaacaggtcatcccaatgctcaatcagtacagtttcaaggtggtgtagtatattgtaggaccagtggaacccatggtcctgtgcccactgctgcaccaaatcttaggtcagtggatcaaacaatttaagccctcagtggtactacctgagacccttcaggcaggagatccaacttggaatatgtttaagttccaataaagataaattgatactacttccaggatggaatgagtcctgtgtagacaacttgccaccaagtagctggtaagtctgctgaaggaatggtgctgcattgggggccaagcattggccttgttgctggcaaattggacatttgacagtggtggtagctagatcagccttgttaattgggaaccatgctattaggcccatgtataacctccatctctgcacctgtggctacccttgtcatgtgcctattgggccaatactagtgtagccaatggcagagactggctgatgtcatctggccagggcattgttccttatggttgtctagtgcttattctgtgatggattctctctgttgcctattaacacatgaagcaaagatcttcacatttcatatccattttatagggtcatccacatgcctctttcccagaactctttatccccaatctttgtctttccagcccctgaccaaacagtaagccttttgctagtgcccataaattaatgtataagtttactttgagctacaaaccaaagctctgcccacttagagatattcccctcactactgtctttcaggacactcctaagtgattgcctgtggcacttgcacatcaggactgtcacctttgggtccccccaaaaactagggcagcaatggaaaaagggcaggctaggccaagagtgaggaataaacagtctttattggctttggactaggagtccttgggtcttgagtatctctgtgtatttgtcgatattcttcagattcttctcagcctgtttctgcagcctcataaactgctccttctccctttgcccctccccattctttctcctaatggatcttgaccttctccttcctcttctcctccagaatggctgtcactggttggtacttccaggcaaatttatgaaccaggtgccccaggtaggcaaacttcagtgtgggcttcaggtgcacaaccttgagtagagtagaaatcaccatccacttttgcaaagggcagggcacagggggtgtggatcccatcaaataccttgaggtggtccaggtggccaggcctcacttggttttatggggcaatataccactcatggttcagccaaaagatgcagttaggtgcccgaaagtagaagagacccagaagtggtagggtctaaagacagagttggtgctcctggtcttgtggaaggttagatactgaaacttgttcctgtagaagttgacaaaaatgctgatgtccttgcagtgcaggacctccagcttcctgcccagcagtacttgcttggccattatgaccaccaggcaactcaggagaggcctaggccatcgatcaccagaacctgccccttcaacatcttcaacagccacttggaaaaggccaggaactattttaccaaagggatttaagtctgcactgcagatggcatgaccttgcttcataaccatagagatctgtgttgtgattcttcgaatgggatttgatgtaaacttttttatttttacaaaggcaaggaaattcaaacattgaaatgcttaagaaaataaaaatctttccaaatcctataactggagacaatttgtcgattcatcaatatcctagtgagcattattttaaaccttttactatatatttatacaaatagaactacgtctgtaatttattttttatttattatttactctgtttatagagacagggtcttgctctgtcacccaggcaggagtgccatggcagaatcaaactcactgcagcctccaactcgtgggatcaaatgaccctcccacctcagcctccccagtagctgggactataggcacaccaccacatctggttgttttttgtttgtttgtttgttttttgtagagatggtatcgctgtgtttcccaagctgaccttaaactcctggtgtcaatcctccctcctcagcctcccaaggtgctttggttataggcatgagctactgaacccatccaaattgctgctttttgattaaacactatttttatataacataaattaaccagtttgctatagataattcttaattgagtggtactgccctctagagtatgttttgtgtctcgactatttacatgatgaaatacatattttgttataaattactgcttttttcacattacagttagtatattttgttgtatgtacctatgactttcatttcaggactgtaagggagtgttacaaagtatttattataaaaagggcatgaagtcagctgggattgagaagcactgcttgtagatggacacagagtatcttcaattttcaatactaaaaatattctgatgaacatctttgtatattcatgttttgcagtgggtttgttaggccaaatggtacacatgtgcagaaatttggcacattgtaccaattcacctatataccaacagggcatgagagtgccagtttcctcatatattcaccaacaataatgttgccatggtttggatgtgattattttgccaaaactcatattgaaatttgatccctgatgtggcagcagtattcagaggtgggacctacttggggatgtttgggttacggggacaccactgtcatgaatgccttccggctgcaatgagttcttcctttctcaggaatggattattttacatcagagagagcagcttgctaaatagtgcctgggttccttggattctctctcttgcttcctctctcaccatgtggcctctttgcatacacctcccccaccttccactctctaccatgagtgtaaggaagcagtacaagaccctctctagatatagctgcccaatcttgcactttccagccaccaggatcatgaaccaaacaaatctattttctgtataaattatccagcgtcaggtattccattacagcaacactaagtggactgtgacaaatgtagtcctcttgcatatgccagtcactcttcccttaaaaactagttaagattttcttaaaatttctattctgtgtcttggggtagagtccttcaagtgattctgaaagttccaggattttactttatttctagtaattcctgggtttaatttctgactttaattgatttctcttttccattttttaaaaataacagctatactgggatatacttcatacactacacaattcacatatttaaagtgtacacttcagtggtttttagagacatgcacagagacatgcaactgttactacgatcaattttagaacatgtttttcttttcttttcttttcttttctttttgttttttgagacagggtctcactcatttgcccaggctggagtgcagtggccagtctcggctcactgcaacctccacctcccaggctcaagtgatcctcccacctcaactgcccaagtagctgggactacaggttcacagcaccatgcccagctaatttttgtgtttttggtagagatgaagtttcaccatattgcccaagttggtctccaactcctggcctcaagcaaaccactgacctcaacctcccaaagtgttgggataacaggcgtgggccactgtgccctgccgcaatatttttttcatcaccctctaaaaccccatatacctcagcagtcactccctattttctcataaccccccagtcctaggcaaccactaatctactttttgggtggatttaccctttctggatattatataaaaatagaatagtcaagtatgggggcttttgccactggcttcttttacttagcataatgttttcaggatttattcatcttacagtatgtagtagtacttcttttctattgttgaataatagtctgttgtatatacatatcacattttatttatccactcatcagttaatgaacatttgggttgtatctacattttggctattatgaataatgctgttatgaacattcttgtacaagtttttgtgtagacatatgttttcatttctcttgggtatatatctaggagtgaaatgtcatatggtaactctatgtctaaccttttgaggaactgccaaactgcttttccaaagcagctgcaccatttgacattcccaccagcagtgcatgagagttccagtttcctcatgccctcaacattgcttgcaatagtctgtgttgttggttattgctattctgttgagtgtggattggtatctcattgtggttttaatttgcctttccctgatagctaatgatgctgaacatcttttcatgtgcttgttggtcatttgtgtatcttctttgaatgtcacttagatcatttgcccacttttaattgagctatttggttttttattattgagttgtaataattcttaacatattgtagatacaagtctcttattagatatgtgtttgcaagtattttctcccattctatggattgtcttcattttcttgatggtatcctttgcaacacaaatgtttttaattttcatgatgcccaatttatcctttttttcttcccttgagtgtgctttggtgtcatatctaagaaactattgtctcatctaatgtcacaaagagttatgcctatgttttcttccaagaatttagcagttttagttcatacagttaggcctttgatccattgatttttgcctatgtatatgcataaattttctgtacatgcaattttattattttgcttctggatatgcagttgtaccagcatcatttgctggaaagattatcctttccccattgaattgtcatgacacccttttcaaaaaccaattgaccatgaatttgagagtttatttctagacacttaattctcttccattgatctatatgtctatctttaatgccagtaccttaccattttggctactgtagttttgtagtaaattttggaattgggaagtgtgagtctttcaactttgctcttttttttcaaggttgtttttcctattctaaagcaaattcaaacttattctaaaggaaattcaagagaatttccatataaattttagggtcagcttgtcaatttctgtaaaaaatttaactgggatttttacaacgataggttgaatctgtagatcagttgagaagtattgccattttaacagtattaagtctttcaatccagcacatggaatgccttttcatttatttaattcttctttaatttattttaataatgttttatagtttttaggatataggttttacagttttttggtttaatttattcccaactattttatacgttttgatgctattgcatcagttttcttacttttattttcagattgttcattgcagcatatagaaatataactaattttcatatatcaatcttgtagcctgaaaccttgctgaacttatttattagtttgtaatgatgttttagtggattccttaggattttctatatacaagtttgtgtcatctacaactatagttttacttctttctttccaatctgaatgccttttacttctttttcttgcccaattgccctttctacaacctccaatgcaatgttgaataaaagtggtgagaacagacattcttttcatttattgatcttaggaggaaagctttcagtctttcatcattaattatgttagttgtggcttttcgtagatatctttttttttttcttttttgagacagggtctcactctgtcacttaggccggagtgtagtgagtggtccaatcttggctcacggcagcctcaacctcccgggctcaagcaatcctcctactttagcctctggagtatctgggaccacaggtgtgtgccagcatgcctggtgtttttttttttttttttttttttttttttttgatagagaagaggtctcactatgttgcctaggcttgtcttgaactcctgggctcaagcaatcctcccaccttggcctcttaaagtgtggagattacaggagtgagccaccatgcccacgcctgtaatcttaacactttaggtggttgaggagggagaagtcggaaggagatgcctgatgaaagacatatcttttatcaggttgaagaagttcctttgtattcttagtttgttgaatgttttcatcctgaagggattttgtcaaatgctctttctgcgtgtattgatataattatgtcatttttgttccttatcctaatgatatggtatattaaattaattaattttctaatattagccagcttgcattttagggataaatcctacttagtcatggtgtataattctttttatgtgtttctggattccatttgctagttctcttctgtactttgcaattgattctttgtcaatgtccagatattaggccaaatggggggtatgtccacttcctgatatttccccagataagactgttttggtcatttttcactcattctggtgcctggaaatggaactctttatgagtcttgctagggggaaaagtcaatttcttactgtaagaattaaaacaaatttttattactatatgagtttaatattatttcttactataagaattaaaagctaggcatggtggctcatgcctatagctgggaggccaagatgggcagatcgcttgagcccaggagttcaagaccagcctgggtaacatggtgaaatcctgtctcaaaaaaaaaaaaagaaaagtcaggtgtggtggtttgtgcctgtagtcccagctacagaggaggctgaggaggcaggattacttgagcccaggagttggagcttgtagtgagctgtgatcacaccactgcacggcactccagcctgggcaacacagcaagaacctatctcaaaaaaaaaaaaatagaatttaaaaaaatttacttttgcaatcttccttggtgctagggaagaggcatatgatcattcagacacacgttaattaatatttaatttgggagtgaatgacacctaaagtaaggtctttctctctttctacagcgatactgttagaatagcagaatcaggcttgaggcatgatttagggtgtttttctcagctatttagtctcaaccctagttctctagttctcttagtaattcatggcactgcccagttttttttacttttatttttctttttgatcaccatgaacaaacaatttccttttagtaagtcccgtattgcttaattcagccagggtccacttttattaagagcaactagtagccttgtcagataaaacactcacacatggcattgttgttagttgccttatactaataattcaggagatgatgtcagagattacatcaatgaagaaccatacagaaaataatttaatatcaaatatttgactttcatttttaaaagaatagcattgtccatttctcccaacatggccccagccttccacaaggtgctttactccattctctttacattttcttctcccggctccatccctaaatccttgatcatttcttaagtagaggagtttatcttactcttttttcttgccaatcccaagtaagttttaaagaacttttcacaaataaaagcacctcttttcctaaaacaaaatggttccccttttgtttcattccacctgatatggtttggctctgtggtcccacccaaatctcatctcaaattgtaatcctcacatgtcaagggagggaattgtaatctccacgtgttgaccgagggaggtgattggatcatggggcagtttcccctatgctgttcttgtaatagtgagttctcatgagatctgatcgttttgttttttttttttctttttgagatggagtctcgctctgtgcccaggctggagtgtagtggcacgatctctgctcactgcaagctccgcttcccgggttcacaccattctcctgcctcagcctccggagtagctgggactacaggcgcctgccaccacgactggctaatttttttgtatttttagtagagacggggtttcaccgtgttagccaggatggtctcgatctcctgacctcgtgatcctcctgcctcggcctcccaaagtgctgggattacaggcgtgagccaccgcgcccagccaatgtgatggttttataaggcggttttccctgctgttgctggctttctctcacccgctgctatgtaagatgtgtctcttccccttctgccataattgtaagtttcctgaggcctccccagtcatgcagaactgtgagtcaattaaacctctttcctttataatttacccagtttcgggtatttctttatagcagtgtgtgaacagaccaccacattagaattgcatgttgctttgtcattgccaatctgacaggtaacaaaagatatcacacttatacaaactcacatttgttgcatttattgttgttgttttgggacagagcctcactctgtcacccaagctggagtgcagtggcctgatctcagctcactgcaacctctgctttctgggctcaagcaattctcctgcctcagcctcccgagtagctgggattacaggtgtccaccaccatgcttggctaatttttttttatttttagtatagacggggtttcaccatgttgaccaggctggtttcaaactcctgacctcaggtgatctgcccgcctcagcctcccaaaatgctgggattacaggcatgtgccactgtgcccagcctattgcatatttttaaattagagactaagatttcttcttttctgaattgtctgttattttaactatttttccatgttggaatattagtctttttcttattcttttgtagattcttttaagctcttcatatacagggaatattagtacatagcataaatattgcaaatagttttccaggttgttatttggcatttgacattgtttatgatgaagttttgcttattttcctaaaaaccaaaacagaatttttggttttgtttctaagaaataaaagctttcaagcttttcctttttgacatctagatttcatgtcatctttagaaaagctgcccccactgcctttggcacaaaaatcatataactgtttatgtgtcttttttctccacctgtaattcattaaaaattagaaaactgatgtccagattgataatacgacttgcccaaggtcttacaactaattaaaggaaataggctacagaaaagatggtgctcctactgaaagcagtaatgcataattagtggtacacttcttaattaaaaattttaatgttaagtgagttttttaccctttaaaaattatggctattttctggaagcttttttaggaaataaaaggaaatactctcttaaacagtgataattcaaaagacacattgggacttattacacaaatgaatattcagagtcataattttctttattaaaacatatgggagaccaagcacagtggctcacacctataatcccagcactttgggaggcttaggcaggaggattgcttgaggccaggagttcaagaccaccctgggcaacatagtgggaccctgtctccacaaaaaataaaaatgaaaaaattttattttaatttacttttttttggtttctgtttttgttttgagatggagtctcactttctcacccaggctagggtgcaatggtgcaatcttggctcactgcaacctctacctcccaggttcaagtgatcctcctgctttagcctcccaagtagctgggactataggcatgcaccattacacccaactaatttttgtatttttagtacagacggggtttcaccatgttggtcaggctggtctcgaacccctgaccgcaagtgatctgcctgcctcggcctcccaaagttctgggattacagacgtgagccactgtgcccggcctgatttctagttttatttcattgtggacggaaaagacttgtcatatgatgtctgcttttttcaaattgtgtagacttgtttcattacttgagatatggtctattctgcagaatgttccatgtactgatgaaaagaatgtatattctgcagcagctgggtaaaatgttctgtacatgtcacttaggcactttgatctcatgtgcagtttaatttcaattttttttgttgattttctgtttgtatgatttgaccattactgacaatggggtgttaaaaccccctacaataatattgcagtctatctctccctttatatctattagtgtttgctttatactcttgggggctccattgttgtttgcatacatatttatttatttattttttgagatggagttttgctcttgttgtccaggctggagtacaatggcccgctcctggctcactgcaacctctgcctcctgtgttcaagcaagtctcctgcctcagcctcccaagtagctgggattacagacatgtaccactacacctggctaattttgtacttttagtagaaatggggtttcaccatgttggtcaagctggtctcaaactcctgacctcaggtgatcctactgcctcggcctcccagaatgctaggattacagccgtgagccactgcatccagctgggtgcatacatatttataactgctagttcctcttgctgtattgaccccattattattatatagtgatcttctttgtctctttttacagtctttcacgtgtagtctattttatctgacataaatatagctactcctgctttttcttggtttcctgttgcatagaatatctttttctatcctttcaccttcagtttatgtgtgtccttataggtgaagtgggtttcttgcaggtaggatagagttgggtcttgtttcttcatccattcagcaactgtatgccttttaattggagatttaagtccattttacattgtgttattatggataagtaaggacttactattgccatttgttgcttgttttctgattgttttgtaacgcctctttttccttcttcctttcttgctcccttcttttgtgggtaagtgattttctctggtagtatgttttaactctttgcttttaatttttagtgaatctattaaaggtttttgtattgtggttaccatgaggcttacaaaaaacatcttacagatataacaagttgtttaaaaaagacagcttatcttagatcaaaaatacaataatagaaacaatcaaatataaaaaatgaaagcaatacactttagctccttgtatcccgcattttgactttttgttgtctcaatttacataatttatatataataattatattacattatatattatgtaacatataatatatatcattatgcatattatatataattatttttacaaatttttacctcaagtacattttttatattacctatctcttaacaggttgttatgccttttttaaaaaattagatttgcatttcagtatctttgtactagagttgtgagtggattgattgcacacataattacagtattagagtattatgggtttgtctatatgcttaatttttaccttggattttataccttcaaataatttttttttgcatgttagtgtttttcttttcctttcagactgaataattccctataatagttcttgtaagatgggtctggtggtgttaaattttctcaccttttgtgagaaggactttatgcctccttcatatttgaaggatagcttttctggatacagtatactttgatagcagtttttagaattttggcactttcaacttaccattctgctttctcctggcctatatgttctccatagagaagaccgttgccaaacaaattggagctcctttatatgttgattcttttattttgccacctttggctcctctctttgtccttgacctttgagagtttgattattagatgccttggggtagtcttatttggctcaaatctgtttggtgttctctgaccttctggtaccttgatatttatctctttctcaaggtgtggagagttttctgttattatttctttcaataagttttctaaccctgctgttgctcaactccatcttgaacaccagtgattcttacatttggtctttggagataattttccatatcttgaaggcaatctttgttcctttgtattctttttcattatttctacttagacaatgtattttcaaatatcctgtcttcaagttcactgattcttttaaaattgtgtttattttttatttcaatagcttttaaggtacaagtcatttttggttacatggatgaattctatagtagtgacttctgagattttagtacactcatcacctgagcagtgtatgctgtacccaataggtagtcttttatcgctcccccctccccactgagtccccaaagtccattatatcactttgtatgtctttgcgtcctcatagcttagctcccatgtataagtgagaacatacggtatttggttttccatttttgattacttcacttagcataatggcctccagcttcatcccacttgctgcaaaagttactgcagaagacattatttcattctttttttttttttttttttcaagacagagtttcgctctgtcacccaggctggagtgcagtggcacaatctctgctgactgcaagctccgcctcctgggttcacaccattctcctgcctcagcctcccgagtagctgggactacaggtgcccaccagcgcgtgcggctaattttttgtatttttagtagagacggggtttcaccatgttagccaggatggtctcgatctcctgacctcctgatccacctgcctcggcctcccaaagtgctgggattacaggcgtgagccacagtgcctggccttatttcattcttttttatggctgagtagtattccatgatatatatatatatatgtgtatatatatatatatatatatatatatgtgtgtgtatatatatatatatatatgtgtatatatatatatatatatatgtatatatataccacattctctctgtctactcattggtgtcaatgggcacttaggttggttccatatcttttcaattgtgaattgtgctgctattaacatacttgtgcatgtgtctttttcatataatcttctttacttttgggtaggtacccagtagtgggattgctagatcgaatgatagatctacttttagctcttcaagggatctctatgctgtttcccacagaggttgtactaatttatattcctaccagcagtgtaaaagtgttcccttttcaacacatctacaccaacatctattgttttttgactgttttatcatggccactcttgcaggagtaaggtggtatctcattgtggttttaatttgcattttcatgatggttactgatgtagataattttttcatacatttttgggctatttgtatatctttttttgagaaatgtctattcgtgtcttttgcccactttttgatggattttttttctaattcatttgagttccttatagattctgcatactagccctttctcagatgcatagtttgcaaatattttctccttttctgtggattgtctgtttactctgatgactatctcttttgctgggtagaaacttttttgtttaattaggtcctattcacttatttttgttattgttgcatttgcttttggggtcttggtcatgaattcttttcctaggccaatgcccagaagtgtttgtccagtattatcttttagaatttttattgtttcaggtttaagacttaagtctttgatcagttttgagttgatttttgtataaggtgagagatgggaatccagtttcattcttctacatgtggcttgccagatttcctagcaccatttattaaatgggatgtcctttccccaatttatgcttttgtatgctttgtcaaagatcatttggttgtaaatatttggctttatttctgggttctctattctgttccattggtctacatgcctatttttatatcagtaccatgctgttttgataactatagccttctagtatagtttgaggttgggtaatatgaacaaatccagatttgttcttcttccttatggtttctttggctatgtgggctctttttcagttccatatgaattttagaattgtttattctagttctgtataatttgaagtccagtaatgtgatgcctccagctttgttctttttgcttactggggctatttgggctcttttttgattccacatgaagttttggattgctttttattgttctgtgaaaaatgatgatggtattttgatggaaattgcattaaatctatagattactttgggcagttatagttattttcatactattgattcttttatcatcatgggatgtgtttccattcatttgtgtcatttatgatttctttcagtagtgttttgtggttttctttgtagatatctttcaactccttggttaaggatatttctaggtattttaattttattattatttttgcagccattgtaaaagggattgagttcttaattttattctcagcttggccattgttggtgtatagcaggacaactgatttgtgtacattgattccgtaaccttagactttgctgaatttatttattaggcctagtaatcttttggatgagggatgagtctttagggttttctaggtatacaatcatattgagaggtgacagcgtgctggcagtcctcacagccttcgctcactctcagcgcctcctctgcctgggctcccactttggcggcacttgaggagcccttcagcccactgctgcaccgtgggagtccctttctgggctggccaaggccggagccggctccctcagcttgcagggaggtgtggagggagaggcgccagcgggaacaggggctgcgcgggtgtttgcgggccagctggagttccgggtgggcgtgggcttggccggtccgcactcggagcagcgggctggccctgccgccctgggcaatgaggggcttagcacctggtccagcggctgcggagggtgtactgggtccccgagcagtgccagctcacccggtgctgcgctcgatttctcaccaggccttagctgccttcctgcggggcagggctcgggacctgcagcccgccatgcctgagcctcccacccctccctgggctcttgtgcggccggagcctccccaatgagcgccacccactgcgccacggcgcccagtcccatcgaccacccaggggctgaggagtgcaggcgcacggcgcgggactggcaggcagctccacctgcagcccccgtgcgggatccactaggtgaagccagctgggctcctgagtctggtggggaagtggagaacctttatgtctagctcagggattgtaaatacaccagtcggcactctgtatctagctcaaggtttgtaaacacaccagtcagcaccctgtgtctagctcagggtttgtgaatgcaccagtggacattctgtatccagctactctggtggggccttggagaacctttatgtctagctcagggattgtaaatacaccaatcggcactctgtatctagctcaaggtttgtaaacacaccaatcagcaccctgtgtctagctcagggtttgtgaatgcaccaattgacactctgtatctagctactctggtggggccttggagaacctttacgtccacactctgtatctagctaatctggtggggacctgcagaacctttgtgtctagctcagggattgtaaacacaccaatcagcgccctgtcaaaacagaccacttggctctaccagtcagcaggatgtgggtggggccagataagagaataaaagcaggctgcaagccagcagcggcaacccgttggggtcccttccacactgtggaagctttgttctctcactctttgcaatatatctagctactgctcactctttgggtccacactgcttttatgagctgtaacactcaccggggaggtctgcagcttcactcctgagccagtgagaccacgaacccaccaaaaggaagaaactccgaacacatccgaacatcagaaggaacaaactccagacgcgccaccttaagagctgtaacactcactgcgagggtccacggcttcattcttgaagtcagtgagaccaagaacccaccaattccagacacaatatcatcggcaaacaatgctagtttgatttcctcttttccaatttggatgtactttatttctctctcttgcctggttgctctggctaggacttcccgtgctatgctgaatagaagtggtaaaaatgggcatccttgtcttgttccagttctcggaggaaatgttttccacttttcctgattcagtataatgttggctgtgggtttgtcatatatggcttttattattttgaggtaaatcccttctgtgcctagtttattgagagtttttaatcataagcaatgctggattttatcaaatgtgttttctgcatctattgagatgatcatatgttttttgtttttaattctgtttatgtgatctatcatatttactgacttgcatatattcaatcatctctgcctcgatgggatgaaacccacttgatcatgataaattttctttttgatatgctgttggatttggttagctggagtttgttgaggattttttcatctatgttcatcagggatattggtctgtagttttcttattttaatacctttcctggttttggaattggtgatatggacttcatagaatcatttatggaggattccctctttctcttttatttgtttatttggcatgtgtctcaagatattaccccttttctcaatctttttgaatagtttaagtaaaattggtaccatttctttctttgaatgtctggtagaattcagctgtgaatctggtcctcggctttttttgttgttgttggcaattttttttttttattattgattccatctttctgcttgttatttgtctgtttaggatttctatttctttctgatttaatctaggagggttgtatgtttccaggagtttatccgtttcctctagattttctaacttgtgcacataaacgtgttcagagttgtcttgaattatcttctgtatttctgtagtatcagttgtaatgtctctggtttcatttccagttgagcttatttagatcttctctctattttcttgattaatcttgctaagttctatcaattttatcttttcaaagcaccagctttttgttgcatttatcttttgtatttttggtctcaatttcatttatttcttctctgatttttgttatttcttttcttctgctggctttaggtttagtttattcctgtttctttggttttttgagatgtgaacttaggttgtcactttgtgctctttcaggctttttgatgtcggtatttaatgctatgaactttcttcttagcattgcttttgcttttgctgtatctcagggattttgataacttgtttcactaccatcattcatttcaaataattttaaaatttccatcttgattttattgttaacccaaaaatcattcagaaccagattaattaatttttatgtatttgtatagtgttgaggattcttttgtcattgagttgtagttttgttatactttggtctgaaagatatttgagatgatttttattttcttaaatttattgagacttgttttgtgacctattacatggtctatcttggaaaattttccatgtgctgatgagaagaatgtgtattctgcagttcttgggtagaatgttctgtaaatatctgttaagtctatttgttctagaatgtagtttcagtccattgtttctgtgtttactttctgtctcagtgatctttctagtcctgtcagtggagtatttaagtcccccactaatattgtgttgctgtcaacctcattttttagatctagtagtaattgttttataattttggaagctccaatgctaggtgcatataaattcaggattgtaatcttgttggattggtcttttaaccattatataatgaccttttttctttttgctgttgttgctttaaagtctgtttggtctgatataagaatagctcctcctgctcgccttttgtttccatttgcatggaatatcttttccacccctttaccttgagtttgtaagagtccttatatgttaggtgagtctcttgaagacagcagatatatggttttttattttttttatctactctatcatccagtatcttttaatcggaatacttaggccacttacattcaacattaatactgagatatgagatacggttccattcatcatgttagaattacctagatacttttttgttgtgttatggttttataggccctgttttatgctttcaagaggttctatttggatgcatattaagcttttgtttcaagatttagaactccttttaacatttcttgtagtgctggtttggtagtggcaaattccctcagcatttacttgtctgaaaataatttcatttcttcttcatttatgaaatttagttttgctggatacaaaatttgtggctgacagttattctttttaaggaggctaaatgtaagactccaatctcttctagtttgtaaggtttttgctaagaagtcttctgttaatttgaaagttacttgctgcttttgtctcacagctcttggcattctttcctttttgttgactttaggtggcctgatggtcatgttccttggtgtaatctttttacagtgaatttctcagttgtttgtttgtttgtttgtttttgaggttcttgtatttggaaatttaaatctttagcaaggccagggatgtttttctcaattattttctcaaataagtttttcaaacttttagccttctcttttcctgcagaaacaccaattattcttagctttggccattttacataatcctgtatttcttagagactgtgttcatttctttttattctttttcctttatctttttctgactgagttaattcaaaagccttgtctttgagctctgaaattctttcttctacttgttctaatctattgtttaaactttccactgcattttatatttctctaagtgtgtctttcatttccagaagttctgactggtttttctttatgatatgtatctctctaagacacttttcattcatatcctctttttttttttttgagacacggtctcactctgtcactcaggctggagtgcagtggtatgatcacagctcactgcagcctcgactacccaggctcaattgatccttcgatctctcagcctcttgagtagctgggactacaggcatgtgccaccacacccaactaatttttatattttttgcagagatggagtttcacaatgttgtccaggctagtgttgaactcctgagctcaagcaatccacccgccttggcctcccaaaatgctatgattacaggtgtgaaccactgtgcctggcctatatcctgaattgtttttaaaatttctttatggtggttttcacctttctgtggtatctcttcaagtagcttaataaccttctgaatctttatttggtatttcaaagatttcatcttggtttggatccattgctggggagctagtgtgatctgttatagaactctggttttttttgtgtgtgtgtcaccaaaattaacttttctggttccttctcattagggtagactatttctgttaagtattcttgaatttaagatttcttttctttctttctttctacccttaaggatgtgactttaatgtgtgtagtttattatagcctaatttggttggtcgtgcttttagggtgatgactctgtatgagttccttggttatggagagtgtttgtatgatagcttcctcagatactggttgtagaagctacgtacttggtgtgtggataagttcactatctcctatggggttggaatgacagaggtcttttgaagcttatcccatttccgtgtggtgtgcacttatttatttatttatttatttatttatttatttatttattccccagtattctatttactgagttgatgattcaggtctcaggtgagtagggaagattttcctcggtagaaactggttgtagctaaagcaggtgggtaagtgcaatggccagtggcgggcagagatcccagccttgatgatggtagctgggggagctctcaattagatgcactgaggtcttaacaggggaaagggtaggagccaccccagctccccctgccaggccagcaggaaagctgtccacctcccagactcactcctgtcccaatgtttcagctattcagattagacaggcaccccttttcttctgcatgaatgttgatgttccacatagagaagaactgtgactctgcctctcatggaagcctgaacctggaaggtgctcctcctgtggagatgcagtcaccctgcaatgttccaggaaggatgtctgtagatgcacccatgctgagctaccatgggagaagcctcagctgtgtctgtagtggtggacaaggagagaaagaagaccccttcttcaagacccttcatgagcaccaaggctgcctgactgttgggatagtactgcagactttccctgctgagcccagcactgcaattgcatctctacagaaagaaacttcccaccagagtgaagatctggaactcaaagcttgctgtccagattcttttgtcctatgaggtgttcctttcatgtagtgttctccctcttcccctaggagtaggagtttctgagagccagactgcagtgattgctattgctcttctgggtctagccacctgtgaggctgccatactccaggttggtgccaggaaatgtctgcaagcgatctggtgatgtgacctgtcctcaagtctcctagcagtgggtaccagcaccagctctgatgagggtggcaggggagtaacgtaaactctgtgagattccttggttatagatagccttagcgtgctgtctttctcaaatgctggttacaatagtagtaaactggtcatgtggacagactcaggacctcttgttgacaatggtgatagctgaggtcacacactggttttcttcttcctgggtggtatgttagtgtgcctgcagatgctgtaatggactgtcagttaccctccagccagcaggtggtgcctgcaaaagagcagcagcttcagtagtaactgtgggatttgagcttgccttatgttgcccaggggaggtattttggtttctcaggtgatgggtgaggacataaagttccccaaaatttctgtcctttgtgttaagctaccagggtgtgtggagggccataaccgggtggggtctgagtcaggtgggtctgcattctgactccctgtgtgtggggcaagctgtgacccctgttggggtaggaaggtcattcttaagcctctgaggtaatgttccataggtgagtgtaactgctctgctgttcagaagaacttgtacaagaggtggggagtaacatgtggcagtaagcctcacttagatcccacacagttggccaggctgatctcactcccacagtgccctgctagtagcactgggctaagtttcaggtagcctgcactcagaactcaaaccttcctcaggccataaactttccccatgaggataacaaccacagctttcaggccacatccttccccatccacctgcaaggatgggtgcctggctcctgtgctcacaaatatagcatactttccacttgccgtccccacccctccagggttctgaccaagagaatttgtccctacttgatgttatattgtgaaattcagttgggagttgtgactactgtctgagctggttggttgactttgctgaggttcctgtgagatataataaggaatggcttcccttggtctgcactggagattgggaatgcctgcaaggcacttcccactgctgcttctacttttatatttcactgctccctaaatcagttcctgttctgtgttggattaaggccttcacctgtggcctggatttttaagttccttaatggggatatgtatcctggaggcagtctctcccactctaacactctggggacttagtttttggcctgtttcatggtgtaggctgaagcctgccacttctttcaaagagtctgtggattctttcacttttcctgttaagttcctgtattgcttcttggaaaaaagttcacaatgtgaatctctacacctattttgtccttccaagtggagaggcatgctgacattgcctccaattccccatcttgtgggggagaggggaagctcactgattctttcctctgcatgatccattctgctattgaggaccccctaatgaattttttagttcagccaatgtatttctcagttccaagatttctgtttgatttcattatttcaatctctttgttagattttttgataagattctgaattgcttttctgtgttatcttggaggtcattgaattatcttaaaactgtgccttggtgtgtgtgtgtgtgtgtgtgtgtgtgtgtgtgtgtgtgtttggagacagggtctcactctgtcacccagactggagtgcagtggcctgaacctgacctactgcagccttgacctcctgggcttaagcgatcctcctgcctcattatcctgagtacctgcaactatcaccatgcacgtatcaccatgcctggctaatttttaaattttttttgtagagatgaggtcttgctatgttgcccaggctggtcttaaactcctgggctcaactgaccctcctactttggcctcccaaagtgctaggattgcaggtgtgagtcaacacacccagcaatttgctattttgaattcttggtcagagagcttacatattgccatctctttagggtccgtcactggtttcttgcttcattagtttgtggaggtcttgattccctgtttgctgttgtttattgatgatgtgaatctatgtctttgcactgattatttatttttccagtcttctttgactagcttgttttttttttaattggatatttttcttagactttttttttttttggtaattttcctgttgaatttctattttttttttttttttttaagatggagtctcgctctgtcacccaggctggagtgcagtggcgtgatctcagctcactgcaagctccgcctgctgggttgatgccattctcctgcctcagcctcccaagtagctgggactataggtgcccgccaccatgcccggctatttttttttgtatttttagtagaaatggggtttcaccatgttagccaggatggtctcgatctcctgacctcatgatctgcccgccttggcctcccaaagtgctgggattacaagcatgagccactgcacctggccttcctgttgaatttctttcttttttttcccactagattgctgtgtccatttagcactagatagtattttaagcccaggtttgtttcaggtctagaaaaggatcagagtgctgcctgtcccaaatggagaatgccccaaaagtacatcccagcagtatgggaaggctggttaggggttcatgtccaggagacctatggaacacttttcctacagcatggtgctgctgaacattcactctggtttagtatcatctttggctgagttacagagcagtttccagggtaggggatggcagtcccaccatctccctttgtctctggctgtccacagggctatttctcccattaggcattcacaatgcttcctgtgggttggggcagggacatgtcttctgtcatggaactcaacatagtggggaagctgattattcatcttgatctcactttttccagtgtaaaaattgtgagttgaggagaaattttctgcatgtttggtttggggcaaattgagggaaggggtgttatggacatggaagtctgattttcttatcatctactcagaggtttttcacttccctgtgaccccaggaactgctttatcttcatttttgagttctgggatattgctggtgataatctcagcactgtatgccacttttggaactggaagcccctttctgtctcagattgtctttatctctttttcattcttgaaggatagtgttgccatgtatattattatttgattgtttgtttgttttttcccacagcactttgaatatatatcatcccatgccattcagacctgcaagatttctgctaaaaactagtgatagtctcatgaggattccctcatatgtgacatgttgtttttctcttggtgttttttcaaaaatctttctttgtctttgacaatttaattataatatttctcagtgtggatttttagggttcatcttaagttgggttctgtaagtttcctgcatctaaatgtccatttcctttctcacatttgatactttttcagccattatttcttagaataagctttctgcttattttttctctcgctgtctctcttcctcttctgagacttctataatgcttgtattggtctttcttaatggtgtgctgtatatcccttaagctatctttgctgtttttcttttactcctctgatgaataattccatgtgatctttctccaagttctctcattttttcttctgtttgctttactcatacattttacccctcttttgattttttcagttcagctattggtattcttcagctccatgatttgtttggtcctttttaaaattttctctcttagttgaaattatccttttgtttttacattgctcccccaagctcatgaagtattttttgtgacacttattttgatttttctctgaagtaatttatatattcccatttcattaggatcagtttctggagtttaatctttttcttttgtttggataatgtttctttgtttcttaattttccttgattcttcctgttgatatctatgcattagaaaaaactttaccatctcccagtctttctggatttgtcttgtacaggagaagagcttcaccaatcaacctggcccaaacttttgtgggcctctcaaaccttcatgctagttcaaacttctgtctttgttcttagtggcttccagacctttagagtatgccaggttctgtcaacattcttagatagctggaaaagaagccaagtcatcaggtagctcctatagaagttggaagtctaggtgcatggtccaactctttccctctccagggataagctggttgctgaggtttttggggtttttgtttttttatccacttgctctgaattgagccatagagaggagttgtgctgactgcctggatactagttcaaaccactgctttgttctctgtcacttctagaagacagtgtatgccaggccatgtcaactttctaagacaggaagatggaagccagctcctcaggtagcacctaaataatttggggcattagatgtgcagtccaactcttttgctcttctggaagaagctgtgagctagagtttattgcctactctttctgtgctaagccaggggaggacctctggtgattatctgcaggttaattgtagccacactaagcatattagtcatagttctaaattccctttctgataatttcaatatccctgccatattgaagtctggatcttatgcttgttcttctcttcaaaatgtgtcttttgcctctaagtgtgccttataatctttttttgatgtattgcagttaaagaattactataaacggtactttactaatgtggtggtaatatgtggggatggggatgtgttctgtagtcctgtgattaggtctcagtcttttagtgaaactgtgtatctggactatgaatttcccaagtgcttctccatctcccacactctccccaacctcttagatttggggacaagatggttagagtaggctggagttggttattttccttccctcaagtcagttaagctctagcaaaaccccaataatttaggctctggtaaattagtttctctggagagcagacattcttaagaagaacaaaaggttctggcaaatttcaaaaggtttctttcccccttcatcaccataagcatgaaggaattttcctccaatattcactgtgaaaacctggtcaaccttctggattttaaaattcacaaaactatggcttcagccctaggactgggttgcactggagtttttccacactgagcctccggcaatttgtcagttacagttcacattttgctacccaggcattggttctcatggagatttttttcttgggagtttcaactcctgtaagttgggattctctgtctctccaatttgtaggacaattgtttgccctgtgaccttgctcctctgacagatctaagaagagttgttcatttttcagtttgttcaggcttttacttgtaattaggatggcatggtgactttcaatctctttacatgctagagcagagaccaaaagtctcatgatagctttacagtgattaaaacaaaaacgtgaaggaataataaataattgccaaatcaaaaataaaaccattgaaagttagatattatccctttgaacactctatatttaataagacaaacaacaacttgttgaagtttctctctaattgagcgtagaagattctcaaatctcagcttgagatttggccatattttcttctgagagaataaggattctgcataaagcctgatggttgttgatcaatctgtcttcagtccagccttctggatacatttctgggtttcagggacagaaagctacatatttaagtaaaaaccaaaagaactgtttcattaaaatctttaacccatgggttcccaaatgtccttagtattgcactcatagagtgagttataatgctgaggaaacatctgctaatccctgatatgcacagcgatgcagtttgcacaccttgaggtctaagtgtacctctggagaactgctgcatgtggcaaagtctcagtagggattatattgaatataaaggaacagtatgggatggcgttaaatttccacaagtgcttgatagagtagcactagtcatcaggagagaattactttgctagatggaacaacaggagattttttttttttttttttttttttgcagtcccgtggaataaatatggtagaagtttaggacaaatgagacatttcaggaatacttagagacactttgtgagaaatcagagactatgcatcatcatcagggagtaactaggagataaatgtaggccttaataacattgtgtcataattagtgatgccaaatgaaatttaggctgcactatattaatatccatgcaataccttgacttgtgccctccctactcttgttaccataagtaagaagatttttttcttagactgaagtgcaatcattgaggaaatgaggcaaataaggtgaaagaacctctactaaaatcacaactactcatctgctgagaggatgaagtatcactcatattggcttacatacagtgtgaaaggggatagagcaagccaatatttattacccataagtcacattattcattcttcaaaatgatttttttgtattaatctatattgaagaaaggactcttcctaatttcttctaaggaaattgaagaacttccactcccccacccacagcacattttaaaataaagtacaaatctagtttaaagaccaccaacctcgacactgtttcttccaaattaaaacacacaaagaaaactttaatagcatctaatagaaaacgtttcttcattacagaaccccaaagaaagaattcctgtgttctggaggcacaaggaagtgagatgttagataattgaccatgtaatgctgtcctgctgtattgtctcctgaggaaaatactggatagacagtttcccttaagcagagataaagttatttcaagaggaatcctcattgattattttaatatcatattgttttagttctaacatttaacatttcctgaaaattctgaaacattttttactaaagacatttgaaatttatattactcaagggaagaagtgagaattattaagtttctttttaaattatattaaaaatgaatttccctgagatttcttgcttgtttaaaaaaacccatcattctgagtaccttgactaatttagaggcagggacattaattcgtttgcagccttgaattatccctgaagctaaaagggtttctacagtcctttaaaagaacctactctcatgactttttctcagatttactcacgtcttccagagacatcaggaatcaatatagggcatttgtccatattagcaacattttctttaaaaatttattcattggtagagggctagcaagatggctgaataggaacagctctggtctgcagctcccagtgagatcaacgcagaaggtgggtgatttctgcatttccaactgaggtacctggcttatctcattgagactggttagatagtgggtgcagcccatatagggcaagccaaagcagggtagggtgtcacctcacctggaaagcataaggggttggggaactccctcccctagccaagggaagccatgagggactgtgtcgtgaggaatggtgcattcccgcccagaaattactcttttcccatggtcttctcaaccctcagaccaggagattctctcgggttcctatgccaccagggccctgggtttcaagcataaaactgggaggctgtttgggcagacagcaaactagctgcaggagtttcttttcatacccagtggcacctggaatgccagcgacacagaaccgttcactcctgcccttaaaccccacaacaggaattaatcaacctcgccttcaaggtgtacaataatagagaagaggtagccagacagcaatgcatttctgagttacagctacttgcctccgctgtaagacagcccacaaccacatctccagcatacaaaaacttcagaacatccaagccacagctcccaggggctccttcaaaacatcctcatgggccttgcttcaaatgccaaaagcctggccagtgggccaaggaatgcccacagcccaggattcctcctaagccgtgtcccatctgtgtgggaccccactggaaattggacagtccaactggcccaaggctctgactgactccttcccagatcttctcggcttagcagctgaagactgacgctgcccaatcgcctcagaagcctcttggaccatcacagatgctttggtaactcttacagtggagggtaagtctgtccccttcttaattaatatggaggctacccactccacattaccttcttttcaaaggcctgtttccctcgcctccataactgttgtgggtattgacggccaggcttctaaacctcttaaaactccccaactctggtgccaacttgggcattcttttatgcactctttaagttatccccacctgcccagttcgcttattaggccgagacattttaactaaattatctgcttccctgactattcctgggctacagccacacatcattgccgcctttttttcccagttcaaagcctccttcacatccttgccttgtatctcctcaccttaaaccacaagtataggatgtctctactccctccttggtgaccaatcatgcaccccttaccctcccattaaaacctaatcacccttaccccactcaacgccaatatcccatccggcagcatgctttttttttttttttttttttttttgagacggagtctcgctctgtggcccaggcgggagtgcagtggctcaatctcggctcactgcaagctccgcctcctgggttcacgccattctcctgcctcagcctcccgagtagctgggactacaggcgcccgccatcacgcccggctaattttttttgtatttttagtagagacggggtttcaccgtgttagccaggatggtctcgatctcctgacctcgtgatccacccgcctcggcctcccaaagtgctgggattacaagcgtgagccaccgcgcccggcccggcagcatgctttaaaaggattaaagcctgttatcgctcgcctgttacagctggccttttaaagcctatagactctccttacaattcccccattttacctgtcaaaaaactggacaagtcttacaggttagttgaggatctgcactttgtcaaccaaattgtcttgcctatccaccccgtggtgccaaagccatatagtctcctgtcctcaatacttccctccacaccccctccatagcccattattctgttctggatctcaaacattctttcttcactattccttgcacccttcatcccagcctctctttgctttcacttggacagaccctgacatccatcaggctcagtaaactacctggggtgtactgccacaaggctttacagacagcccccattacttcagtcaagcccaaatttcttccttatctgctacctatcttggcatagttctcatgaaaatgcacacgctctccctgctgatcatgtccagctaatctcccaaaccacaatcccttctacaaaacaacaactcctttccttcctaggcatggttaggtacttccacctttggatatctagttttaccatcctgactaaaccattatgtaaactcacaaaaccaaacctagctgaccccacagatcctaaatcctttccccactcctctttccattccttgaagacagctttagagacagcccccacactagctctccctgactcagcccaacccttttcattacacacagctgaagtaagggctctgcagttggaattctcacacatggaccaggactgcgccctgtagcctttctgtccaaacaacttgaccttactgttttagcctagccctcatgtctgcgtgtggtggctactgccaccaatagttttagaggccctcaaactcacaaactatgctgaactctctttctacagttctcataacttccaaaatctattttcttcctcacccctgacacatatactttctgttccccggctccttcagctgtactcactctttgttgagtctcccacagttaccattgttcctggcccggacttcaatccggcctcccacattattcctgataccacacttgactcctatgactgtatctctctgatacacttggcattcactccatttccccatatttccttctttccttttcctcaccctgatcacacttggtttattgatgtcagttccaccaggcctaatagccactcaccagcaaaggcaggctatgctatggtatcttccacatctatcattgaggacactgctccgccccctccactacctctcagcaagccaaactcattgccttaactcgggctctcactcttgcaaagggactatgagtcaatatttatactgaccccatatcctgcaccaccatgctgtttcatgggctgaaaggtttcctcactatgcaagggtcttccatcattaatgcctctttaataaaaactcttctcaaggctgctttacttccaaaggaagctggagtcattccctgcaagggccatcaaagggcatcagatcccatcgctcagggcaatgattatactgataaggtagctaaaaaaagcagctagcattccaacttctgtctctcatggccagtttttctccttctcattggtcactcctatttactttcctactgaagtttccacatatcaatctcttcccacatgaggcaaatggtccttggaccaaggaaaatatctccttccagcctcacacgcccattctattctgtcatcatttcctaacctcttccacataggctacaagccgctagcccatctcttagaacctctcatttcctttccatcttggaaatctatcctcaaggaaatcacttctcagtgttccatctgcaggccccctcccttccctatgcatcaagctcgggaatttgcccccacccaggactggcaaattgactttactcacatgcctcaagtcagtaaactaaaataccacttggtctgggtagacactttcactggatgggtagaggcctttcccacagggtctgccgtcatttcttcccttctgtcagacataattcctcagtttggccttcccatctctatacagtccaataacgggctggcctttattagtcaaatcacccaagcagtttctcaggctcttggtatttagtggctcctggttttacctcaagtcgccacccttaagtctctctttaagtggatagaacatcttcaatggcaaggtaccctccaatcctttcaccctgatgaagtcctattctttacttttatatttactcttattctggttcccattcttatgccaccctctacctctccccagctatctccaccacactatcaatctcagtcactctctcctagccatttctaatccttctttaacaaacaattgctggctttgcatttctctttcctctaaaatcactgaggcctcgacttactcactgctaaaaaaataggggggactctgtatatttttaaatgaagagtgctgtttttccctaaatcaatctggcctggtatatgacaacattaaaaaaacccctcaaagatagagcctaaaaacttgccaaccaagcaagtaattatgctaaacccctaaacccccttggacccccttggacactctctaattagatgtcctaggtcctcccaattcttagtcctttaatacctgtttttctccttctcttattcggatcttgtgtcttccatttagtttctcaattcataccttcatgcgcgtccttgtgaagagaccaccaaacaggctttgtgtgagcaacatggctgtttatttcacctgggtgcaggtgggctgagtccaaaaagagagtcagcgaagggagatggattatcattagttcttatagattttgggataggcggtgaagttaagagcaatgttttgtgggcaggggtggatctcacaaagtacattctcaagggtggagagaattgcaacaaaccttcttaagggtgggggagattacaaagtacattgatcagttagagtggggcaggaacaaatcacaatggtggaatgtcatcagttaaggctatttttacttcttttgtggatcttcagttacttcaggccatctgggtgtatacgtgcaagtcacaggggatgtgatggcttggcttgggctcagaggcctgacaaatacaaaactgcatccaggccatcatcaataattctatacgacaaatgctccttctagcaatcccacaatatcaccccttactacaaaatcttccttcagcttaatctctcccactctaggttcccacatcacccctaatcccgctcgaagcaaccctgagaaacatcgcccattatctctgctgccccaacactttaccactattttgtttatttttcttattaatataagaagacaggaatgtcaggcctctgagcctaagctaagccatcatatccccagtgacctgcaggtatacatccagatggcctgaagcaactgaagatccacaaaaaagtgaaaatagccttaactgatgactttccaccattgtgatttatttctgtcccaacctaactgatctatgtactttgtaatctcccccacccttaggaaggttctttataatcttccccacccttaagaagattctttgtaattctccccacccttgagaatgtactttgtgagatccgccccatgccctcaaaacattgctcttaactccaccgcctattccaaaacctatgagaaccaatgataatcccaccaccctttgctgactcctttttcggactcagcccgcctgcacccaggtgaaataaacagccttgttgctcacacaaagcctgtttggtggtctcttcacatggacacatgaaacaccctgaaaaagggactgaagccagtgagccaagtggtctagctcagtggatcccacacccacagagcccagcaagctaagatccactggcttgaaattcttgctgctagcacagcagtctgaagccgagctgggacactggagcttggtggggggataggcatctaccgttactgagggttgagtaggcagttttcccctcacactgtaaacaaagccacagggaagttcaaactgggtggagcccactgcagctcagtaaagccactgtagccagactgcctctctagattcctcctctctgggcagggcatctctgaaagaaacgcagcagccccagtcaggggcttatagataacactcccatctcccagggacagaacctgggggaaggggcagctgtgggcgcagcttcagcaggtttaaattttcctgcctgccagccccaaagagggaagcagacctcccagcacagcactagagctctgctaagggacagactgcctcctcaagtgggtccctgacccccatgcctcctgactgggagacacctcatacaagagagatcctgctggcatctggcgggtgcccctctgggacaaggcttccagaggaaggaacaggcagcaatctttgctgttttgcagcctctgctggtgatacccaggcaaacagggtctggaggggacctcagcaaaccccagcagacttgcagctgaggggcctgttagaaggaaaactagtaaacagaaaggaatagcatcaacatcaacaaaaaggacatccacacagaaaccccatccaaaggtcaccagtatcaaagatcaaagatagataaatccataaagatgaggaaaaaccagtgcaaaaaggctgaaaattccaaaaaacaggatgcctcttctcctccaaaggatcacaactcctcgacagcaaaggaacaaaactggacagagaatgagtttgacgaattgacagaagtaggcttcagaaggtgggtaataacaaactcctccgagcaaaaagagcatgttctaatgcaatgcaaggaagctaagaaccttgaaaaaaggttagagaaattgctaactagaataaccagtttaaagaagaacataaatgacctgatggagctgaaaaatgcagcatgagaacttcgtgaagcatacacacgtatcaatagccaaatcgatcaagcgatagaaagggtatcagaaattgaagctcaacttaatgaaataaagcatgaagacaagcttagggaaaaaagaatgaaaaggaatgaacaaagcctccaagaaatataggactatgtgaaaagaccaaacctacgtttgattggtgtacttgaaagtgacagggagaatggaaccaaatttgaaaagactcttcagtttactatctaggagaacttccccaacctagcaagataggccaacatccaaactcaggaaatagagacaacaccatgaagatattcttcgggaagagagcaaccccaaggcacttaattgtcagattcaccaaggttgaaatgaaggaaaaaatgttaagggtagccagagagaaaggttgggttacccacaaagggaagcccatcagactaacagctgatctctctgcagaaaccctgcaagccataagagagtgggggccaacattcaacattcttaaataaaagaattttcaacccagaatttcatatccagccaaactaagcttcataagtgaaggagaaataaaactctttacaaacaagcaaatgctgagagattttgtcaccaccaggcctgccttacaagatctcctgaaggaagcactaatcatggcaggaaaaaaacagtaccagccactgcaaaaatataccaaattgtaaagaccatcaacactgtgaagaaacagcatcaaccaacaggcaaaataaacagctagcatcataatgacaggatcaaattcacacataacaatattaaccttaaaggtaaatgggctaaatgccccaattaaaagacacagactggcaaattagataaagagtcaagacccattgatgcgctgtattcaggagtcccacctctcgtgcaaaaacacacataggctcaaaataaaggtctggaggaatatttaccaagcaaatggaaagctaaaaaaaaaaaaggcaggggttgtaatcctagcctctgattaaaacagactttaaaccagcaaagataaaaaaagacaaagaagagcattacataatggtaaatggattcaatgcaacgagaggagctaactatcctaaatacatatgcacccaataaaggagcacccagattcataaagcaagttcttagagacctacaaagagacttagactctcacaaaataatagtgggagattttaacaccccactgtcaatattaggcagatcaatgagacagaaaattaacaaggatatccaggaattgaactcagctctggaccaagcagacctaataaacatctacagaactctccattccaaatcaacagaatatacattcttctcagcaccacattgcacttattctaaaattgaccacatatttggaagtaaaacactcctcagcaaatgcaaaagaatggcaatcataacaaacagtctctcagaccacagtgcaatcaaattggaactcaggattaagaaactcactcaaaactgcacaactacgtggatactgaacaacctgctcctgaatgactactgggtaaatatatgaaaatcaataagcataatcaatcacataaagagaaccaatgacaaaatccacatgattgtctcaatagatgcagaaaaggccttcgataaaattcaacatcacttcatgctaaaaactctcaataaactaggtattgatggaatgtatctcaaaataataagagatatttatgacaaacccacagccaatatcatactgaatgagcaaaagctgggagcattccgtttggcacaaaataaggatgccctctctcaccactcctattcaacatagtattggaagttctgaccagggcaatcaggcaagagaaagaaataaatcatattcaaataggaagagaggaagtcaaattgtccctgtttgcagatgacatgattgtatatttagaaaaccccattgtctcagcccaaaatctccttaggctgataagcaacttcagcaaagtctcaggatacaaaatcaatgtgcaaaaatcacaggcattcctatacgccaataatagacaaacagagagccaaatcatgagtgaagtcccattcacaattgctacaaagagaataaaatacctaggaatacaacttacaagggacgtgaaagaccccttcaaggagaactacaaaccactacacaaggaaataagagaagatacaaacaattggaaaaacattccatgctcatggataggaagaatcaatatcatgaaaatggccatactgcccaaagtaatttatagattcaatgctatccccatcaagctaccattgactttcttcacagaattagaaaaaaactactttaaatttcatatggaaccaaaaaagagcctgtgtagcaaaggctgtcctaagcaaaaagatcaaagctggaggcatcatgctacctgacttcaaactatactacaaggctacagtaaccaaaacagcatggtactggtaccaaaacagatatatagaccaatggaatagaacagaggcctcagaaataatgctacacatctacaaccatctgatctttgacaaacctgaaaaaaacaagcaatgggaaaaggattccctatttaataaatgttgttgggaaaactggctagccatatgcagaaaactgaaactggaacccttttttacaccttatacaaaaattaactcaagatggattaagacttaaacgtaagacctataaccatagaaactctagaagaaaacctaggcaataccacttgggacataggcatgggcaaagacttcaggactaacacaccaaaagcaatggcaacaaaagccaaaattgacaaatgagatctaattaaactaaagagcttctgcacagcaaaagaaactatcattagagtgaacaggcaacctgcagaatctgagaaaatttttgcaatctcttctttcgacaaagggttaatatccagactctaaaaggaacttaaacaaatttacaagaaaaatcaaacaaccccaacaaaaagtgggcaaaggatatgaacagacacttctcaaaagaagacatttatgtggccaacaaacatgaaaaaagctcatcatcactggtcattagagaaatgcagatcaaaaccacaatgagataccatctcgcaccagttagaatggcgatcattaaaaagtcagggaacaacagatgctggagaggatgtggagaaacaggaacgcttttacactgttggtgggaatgtaaattagttcaaccattgtggaagacagtgtggtgattcctcaaggatctagaaccagaaataccatttgaccaagcaatcccattagtaggtatatacccaaaggattataaatcattgtactatgaagacacatgcacatgtatgtttattgcagcactcttcacaatagcaaagacttggaaacaacccacatgtccatcaatgatagacgggattaagaaaatgtagcacatatataccatggaatactatgcagccataaaaaggatgagttcatgtcctttgcagagacatggatgaagctggaaaccatcattctcagaaaactaacacaagaacagaaaaccaaacactgcatgttctcactcaaaagtgggaattgaacaatgagaacacatggacatagggaggggaacaccacataccagtgcctgtcagggtgtcgggggctaggggagggatagcattagaagaaatacctaatgtagatgatgggttgatgggtgcagcaaacaacccatggcacgtgtatacctatgtaacaaacctgcacattctgcacatgtatcccagaaattaaagtataataaaaaaataaatttaaaaaaattattcattggcaatactagcatggaatgtgacagactatctcttgggtgcattttgtcgcagacattacttttagatgaaaatcccaacactcttagttatcctaattttaaagcataggcttgggtcgaagcctttgtgtgttaaatctagtaaagttagacctctgtcatgacgatcaaggtgtcatagtggttctggtaatagtaatagtttttttttaatagtagattcacaaattcgaacattgatctaactaaatcttttgtatgataatcatatatggagtctagggatccaaaactgtggtgttaataactccacattctccgcagttttttagggtagcaggcttcacacattttctaatttttcatacatttttaaatgtcttttcaacaaatccttttattgtttttcatgtttgactaacagaggaccattggtacacctttattcctctttctcaaacacatttacctaatatttcatagttttaaagttcaccatgcttggtggttattcatttatgaggtgtttaaaaaagacaatgcaaagatatagatctggacccagaatagccaacgcaagacccccctcccctagaaaaaaaatggaaaaaaatgggaggactcacactaacctattttcttttttgagactgagtcttgctctgttgcccaggctggagtgcagtggcatgatcttggctcactgcaacctctgactcctgggttcaagtgattctcctgccttagcctcctgaatagctgggactacaggtgtgtgtcaccacgcttggctaatttttgtatttttagtagaggcagggttttaccacattggtcaggctaatcttgagctcctgacctcagataatccgcctgcctcgggctcccaaagcgttgggattacaggcgtgagccactgcacccagctgacactgccttattttaatacctactctaatgctgcaataatcaagcagcatgtattggtgaaagaatagacacatagatcagtgaaatagcatatattaatagaatcaggaaatatattggcacaaatatagtaaaatgatttttgataaaaatgcaaagtcaattcaatggagaaagaatagtcttttcacaaatagtgctggaataatcaggcaaccatatgcaaaaagaaaaaaaagtgaacctaggcacagaccttactcattacacataagttaacttaaaatagattatagacctacaaaataaaaatttatgaagcttgaagaagaaaacatatgagaaaatctacatgattttgagtttggtgatgaggttttagatacaataccaaaagcatgatttgtaaaagaaaaactttgatacattaggttaatacaattaaagacctttgctttgcaaaaaaacactgttaagaaaatgaaaaacgagtcatcaactaggaaaaaatatttacagattacatataaggtaaagaatttgtatctaaaatgcacaaagaactcttaaaactcaacaataggaaaacaaagaaaccaatttgatgattggagagatattagtgaaaatggcagaaaagggaactccaaaagtccatcattccacaaaagcaatgaataagctgacaaaaactgtcagaattaactgtgtgtgtgtgtgtgtgtgtgtgtgtgtctgtgtgtgtgttgcgagggtgggggtggagattatggaatctaattaaagattacaagaaaggcgaccattaataaattatacacagcttggtacaattttccttggaaccattggtatcatttctcactccccagcatggcagtgacctttaagaaccacagcccttattcctggtatatattgctggtacctgaaagagcaatataggtgttattctcaaagaatagtggctgttagttttgacctgtctggtggcttcctaaataccagctcagagctttgcatttattttgcctaacttataatgcaaatgtatttgctgctgccacctggagcaaggaataatagttgggatgaacaacagagaagctaaaaagcctggaaggcaagagtagagaagagatgctttgtggaataaagaccttgataaattcctgcatattatggggaatctagaaggcatatgttgcccagtgctgggtgcattttatgaaatacctcaggaggccttatgtcttcatctctatctgaccctcagagtccacacaaacagcaagggaaggctaaggtagagttgtaaactgcttggctcattgccctaacccacacagggagtgttggcaaagacagggagagttttgtcgttgctgttccatgtgtttaaaaaaatctctatcaaatcactagctgaccactaagttaatgaaacagagacttcagtggctacatatgacaaaggacacagactttagaaaattagtttggaaagccattaatcgaataaacaagcaataactatgtaaaccaaaaataaaattctaaggccctctgaccatctaaaaggacccctcctctcagccaagggcattccaaagttaacctaaaaaactaattcaggccattatgggaagggggattagatgtgcctcattataccctcctccctttcagaattcaggaaaaaccaaccagcgttaacatcaacctagaccttaagtctgagaagaaacatttgcaatctattctttcagaagcctactacctggaagcttcatctgcatgataaaactttgatcttaacaactccttattgtcatatcattattttctgttgatttcaggtctttagataataacttaactctttcaaccaattaccaatcagaaaaattttaaatctatgtataacttgaatgcctctgcttcaagttgtcctgcctttccagattgaaccaatatgcatcttataggtattcactgatgtattatgtctccctaaaatgtataaaagcaagctgtatcacaaccaccttgagcacatgtcatcaggaccttccaaggctgtgtcatgggcacatccttaactctggcaaaataaactttccaaattgatttggacctgtctcagatacttttgagttcacagctacaacaagcagcagtaagaaaccttttgagggaggagaatgttataatattgctacattttagattttgaaatgtctagtttcaacacaacattacaaagcaggcaaagaaacaataaggtatggcccatacataagaagaaaaaaaataatagaaattgtctctgaggaagctcagccattggacttattagactttaattcaagtaatttaagtgtgctcaaagtgcttaaggaaaaaatatatacagaacaaaaataaaccacaagaaaaatgcctcatcaaagaacatcaaagagtaagaaatttaattatttttttctttctcggggtcttgatctgttgcccaggctgaactgcaagtggtgttatcatagctcattgcagcctcaaactcctggactcaagcaatcctccagcctcagcctcttatggagctgggactacaggtgcatgctactgcacgcagctaatttttcattttttgtagagatgagttctctctatgttgtcaaggctggccttgaactcctgaactcaagcaattatcctgctttgacctcccagcatgttgggattgctattatgagcccctgtacctagccaaagagtaagagattatagaaaggtatcaaatagaaattctgaagtttaaaagtacaataactgaaatgaagcattcactgaggagttcaacagcagatttgagtgtgcagaagaaaggatccctgaacttgaagataggcccattgatattatccagtgtgagtagaagaaagaaaaatgaatgatgaaaaaataaacagaggtaaagatacttctgagtcaccatcaaacatctaggattaaggcagagacaggaccatgagaagaagtaatacatgcgctttgttgggcagtgcttagatagggctgcatgaaagatgttcctcccaagaagaaatcttcaagacaacatcatgaacccaccgcctagaaaggaaacaggacaagagcactcccagggaagaagtgaaaataggagaaggggcttagatgtctaggtgatgttgctaagtagcaatgtgggaagtcagagagcttcaaaaagtagcagtgggtttgtttgtttgtttttaaaaatagttatagggtttgtcttacctatggttaaaaaatattgagagcagtttcagaggatgtgtaaagtgagtaggttgtaaatggctaaaaattgtttagactatatccaaaggaactggatgtgtgagaatttgtgtttggcaccagtgggctttgggctaatggtcttgggctgctgtcaagaagtaaacaacatgggaattattttaggccagaattgaaggaccatctccaactcatttacataacatataaaaacatgtgtcccagaggagagaagagaaagaggccgaaagaataattgaagaaataatggcccaaagggatgaaagacatgaatatacacatctaagaagctcaaaaaactcttaagataaactcaatgaggtacacaccaagacacattataatcaaattgtcaaaagacaattcttatagactgagttgtagtcccttccaaaattcatatattaagtcctaactcctaatgtgacagtattcaaatatagggattttaaagaggtaactaaggttaaataaggtcataaaggtggggtcctaatccaatacgactgatgtccttataaaaagaggaagagacaccagagatgtctctttcagtgcacatatacagagaaaaggccatgtgaaggcatagcaagaaggggccacctgcaagccaaagtgataggccttaccagaaaccaaccctgctggcaccttgatcttatacttccagcttctagaactgtgagaaaacaaatttctgctgtttaagcctcccagtctgtggttattgtggtcctagcagggtaagacaagcaagaattctatattttgcaagactatgctttaaaaatgaaggcaaaattaagatattcccagataaactttgacagtgctagtagacctgctcagatccacatgaagaaataaaaacactggtaaaaaccaacagctgggtgtggtggctcacacctgtaatcctagcactttgggaggccaaggtgggcggttcacaaggtcaggagatcgagaccatcttggccaacatggtgaaaccccatctctactaaaaatacaaaaattagtcaggtgtggtggtgcacacctgtagtcccagctacttgggaggctgaggcagaagaatcgcttgaacctgggaggcggaggttgcagtgagcctagatggcaccactgcactccagcctggcaacacagtgagactctgtaacaaaaaaatataaattaaaaaaaaaggtaactaacaggtaaatataaagtcagttttaatgtatttttgatttgtaactttcctatatgatttaaaaggcaaattcataaaacaataattttaaatatatgtttataatttttaaaccaatgtacaaagatgtaacttgtaacagtaacaacataaaggctaagtttttcgcatactgctgaaactaagttggtatgaatttgaaccaggttgttataaattaagatgttaattgtaattgctagataaccagttagaaaataactaaaaaatatgtagtaaaagaaacaggagggaataaaatggtacacaagaaaatatctatgaaacagaaaaagctttcttcccccaagatggcagattagagactttcagcatgcctcagccacttggaaatagcaagatagtacatgaagatcaacttcgtgagctttaatttaagaaggaaaataggaatccactggcatcatgaaggacagtctgagtcctggaaaggagaatgccagcaaacagcttccatgatggtgtccagctgatataagtgagtgaagccccagtacgtcagacagtcagagggcctcgttctgtgactcaccttgccactgtggatctcagcatcccaggctgtaggagagcactttgtttctcccaagccctgcagctaacttggggagaggcttggagacaccgtgaatgaaaaacaccagggagagctgcagacattttcctagacccagcgctgagagcaggatgccatttttaaacttggcgtgtacaaagtcagctgttccttggtgagccagcagcatggctgtgcaggcattttagtcccaggccacagattgcagcacttgctctagagctgagtaggagcctccatagccagaaatgaggaaagtgtctcaccagtaggctctggaatcatgttctcccctgttgcaagcctagggtaggaggagagctgctgtagctgcagtttctcctgggtggcaagatttgcagccagggccagcttggtgacctggaagtggtctgtgtgtgccattgccgggtcctccatcctgctctcctgagatagagatggagcagggccctctctgctctacccctgggctgaaatcaggcatttggagcacctgcttgcctggatgagcagcctgaattttcccatccttcctggacatagatatttcgcagcaggctctttctgctctatacccaggtagatctgcaggcatttggagcacccattcacctgattcagcagactagcccaccctttctgtgcagaggtcatggtgcagtggggctctctctgcaccatgtccaggcagatctccaggctttcagagcattcactcacctgtattaccagcctgacccactccacccttcctatgaagagatcatggtgcagtggggctgtctctgctccacacgctggcaaatcttcagacatgtggagcacctgcttgcttagtccaacagcctgagccaccccatccctcctgtgcagagatcttggaattcggggccctctttgtcctttgcccaggcagatctccaggcattaggagtatccacttggagtgattcagcagcctgagccactccacctttcccagacatagatcatggtgcagtgggactttctctgtaccacacccaggcagatctctaagcatttgcagcattgtctaacgtggatcagtagcctgagccatcctacccttcctgtgcagagatcctggtgcagggtggccctctgtgctacacaactaggcagaccttaaggcattcagagcacctgcttgcctcattcagcagtctgagtcatcccacccttcctgtgcagagatccttgtgtgtggggccctctctgccacacacccaggcagatctctaggcatctggagtactcactctcttggattagaagtttaggccatctccaaaccccttgcagtgaatctggagccaagttttcccaacatcatgcctaggcacacctctgggcacttagtgggctgcccactggattctccctcagtgctggtgctggtgcctgctattgggagaaaagaaggtgcacctgccaagcctgcccctgtccttcatggccctacacctccccagggttgagcagggagctgagaccactgtgcgttccataagtcagaccatttcctgaggcaacagagagcttctgccagtaaataaggatcaagtatatacccagccatgttggctatagccagctcttacctataagcgccatctaatgggcttgcaagctaaactgcacagcccaatataaaacattctgaaagaagtgcatagggctatagaacaaagtcaaaataccctacccagcattcactacagttacccctccccactgggaagggggtaaaggaaaaggaagagaaaaaaataacattatagggaaagtgaaaaaaaagaaaaatcctacccacatgaaaataattacaaaaattagaagtgcaagtgtctccagatgacaaggaaccagggcaagacttttggcaccatgaaaaatatgaatgtagtgacaccaccaaaggattccactagctctccagcaataatccctaataaaaatggaaactcagaagtgatagatgaattcaaagcatggattgcaaggaagctcaatgagatccaaggcaagaccaaaaatcaacacaaagaaatttataaagaaatccaggaagtgaaggaagagataaacatcttaaaaagaaatcaattacagcttttgaattttaaaactcacttaaggaatttgaaaatacaatagaaagctttattgataaattggaccaagcagaagaaagaatttcagaatccgaagattgctcttttgaattaacccagtcagacaaaaatagagaaaaaagactctaaaaatgaacaaagtctttgagaaatatgggattatgtaaagtgatgaaacctatgaaattattagcattcttgagaaagaaggagaaaaagtaaacaacctggacaatatatttgagggaataatttgagaaaacttctctaatcttgctagagagggagacatccagatacaagaaacccagagaacacctgaaaataccatacaaaataaacatcaccaaggcatacagtcaccagattgttcaaggtcaacactaaagaaaaaacttaaaggcagctagagataaagggcagatcatgtacaaatggaaccctatcaggctaacagcagacttctcagcagaaaccctacaagccaagagagattggtggcctatattcagtattcttaaagaaaagaaattccaaccaataatttaatatcttgacaatataagcttcataagttaaaactacataaagtctcttctagataagcaagcactaagggaattcattatcactagaccagccttacaagagatcctgaagggaattccacacatggaagcaaaagaatgatacctactaccacaaaagcacatataagtacatagcccacagatcccataaagcaaccacacaataaaaactacaaagcaacaagctaacaacttcataataggatcaaaacctcacatgtcaatactaaccttgaatgtaaatggcctaagcatcccacttaaaaggcagagggtggcaagttgaattaaaaaacaaacaagacccaaggtggattgcttgagcccaggagttcaagaccagccttggcaacatggcaaaaccctgtccctatgaaaaatacaaaaattaactaggcatggtggcatgcacctgtagtgtcagctacttgggaggctgaggtgggaggatcaccttagcctgggaggctgaggttgcagttagctgagattgcatcactgcactccagtttgggtgacagagcaggactctgtgtcaaacaaaacaaaacaaaacaaaaccaagacccatctgtctgctgtcttcaagagactcatttcacatgtagtaacacccataggctcaaagtaaagggttggagaaagatataacatgcaaacagaaaacaaaaaaaagcaggggttgttattcttatattggatacaatagactttaagccaacaacagtaaacaagggcaaagaagggcattacataatgataaagagttcaattcaacaagaagatttaccagttctaagtatctatgcacccaacattggagcatccatattatagaacaagtactctggacttacagaaagactaagagagccacataatgataatgggggacttcaaaacaccactgacagtgttagacagataatcaagacagaaatgtaacaaataaattctggacttaaactcgacacttgaccaattggacctaatagacatctacagaatactctgctcatcaaacacagaatatatattcttctcatctacacatggaacatactccaagattgaccacatgttcaggcataaagcaagtttcaataaattcacaagactcaaaatcctaacaattatactcttggaccacagtggaataaaaatagaaatgaataccaaggagatctctcaaaaccacacaatttgcctgtaatcccggcactttgggaagccgagacaggtggatcatgaggtcaagaggtcgagaccatcctggccaatatggtgaaaccccatctctactaaaaatacaaaaattagctgggcatggtggcacatgcttgtagtcccagatacttgggaggctgaggcaggaatatcacttgaacccaggaggcggaggttgcagtgagctgagattgcaccactgcactctggcttggagacagagcaagactccaatctcaaaacaaacaaacgaaaaacaaaaacaaacaaaaaaagccccccccaacacacaattacatggaaattaaataatttactcctgaattactttttataaaacaacaaaatcaaggcagaaataaaaaaattctttgaaattaataaaaacagacacaacataccaaaatctctgggctgcagtaaaagcggtgttaagaggaaagtttacagcattaaacgcctatctcaaaaagttagaaatatctcaaattaatgatcaacatcatagctagagaaactaaaaaagcaagaaaaaactaaccccaaagctagcagaagaaaataaataactaaaatagagcaa

SEQ ID NO: 493 - DNA, 59315 bp, Homo sapiens
ctgaccaacatggaaaaaccccatctctactaaaaatacaaaaattagctgggcatggtgcgcatgcctgtaatctcagctactcaggaagctgaggtaggagaatttcttgaacccgggaggcggaggttgcagttagctgagatcgcaccattgcactccagcctgggcaacaagagcgaaactctgtctcaaaaaaaaaaaaaaaaaaaaaggaaaaaaaataagttgggcattgtagtaaacgcctgtagtctcagctacttgggaggctgaggtgggaggattgcttgtgcctgcgaggttggaggctacagtgagccatgatcgcaccactgcagtccagcttgggtgacagagcaagatcctgtctcaaaaacaaaaagccggcctggccaacatggtgaaaccatgtctctattgaaaatacaaaaattagctgggcatggtggcacgagcctgtagtcctagctacttgggaggctgagcaggagaattgcttgaactcaggaggcggaggttgcagtgagccgagattgcgcctctgcactccagcctgagcgacagagcgagactctgtctcaaaaaaaaaaaaagcaaaaaacaaatttcatctgagtgtgtttcatgtagttggtgtgatctacatccctccttttgttcttattccgatctttggtttggagagcaattgtgaggaggcatgaaatgtatctggagatagctatgagctgcagcctgctgattttcatgtaattcttggctacttgccagtatggttggggttaaactgtttccagggtaggaaaaacacgaacctagcattttgatatgaaaacaaacaaggctactttgtacttgatgaagctcaagttgcagatccagtgagagcccattaactattggtgaaggcccactgacagtgttgagtttcagagacccctgcacattctggagatggcagcgaattgttgtgcagcctacgaaagtaataaatatttctgcagtgattgtcaacaacaaaatgattttcttgtttggggggtggggaggcaagaggcagaaaccttaggaagctgttgcaaaccagtttcagcttctgctacttttatttctttccatttaaagctgggtgcagtggcacatgcctgtagtcccagttactcaggagcctgaggtgggaggctcacttgaacccaggattttgaggctgcagtgtattatgatggcccctgtaagtagccactgcaccccagccagggcaacataatgagaccctgtctctcaaaaaaaataaaagactgaggctgcaccaatgacatggggtggagtcaggaacctaggactctttctggcccactttggagaccgagagcaggattctgtgaggttgaggtcaatgactgggaaagccccaaagttctcatctgtatcttccttccacctcccccaacctctgcaataaaacaaaatcaactccaagattgaccatattttagtagtaaatatcaaacaagcaaaatgagggcctaaaatactccactaaaatagaaattcctatatttgatattcatgctgctactgtaatcatcagaaagaaaaactgtgctggtcaaagatactcactcattagatgtgtacatgtgtagggccttgacattctacccccaactaatctttgcgtcatctttttctgcctttggacgtatgccccatgcgtccttgtttccatacttttattcatgctctgctctgcgtagtgtgctcattttatccactgaaaccctacgtattatttcagtatccatctctttggggttttttagtttgtttgctttttgagacgaattcttgctctgttgcccaggctgacatgcattggcatgatctcggctcactgcaacctccgcctcctgggttcaagcgattcgttctcctgcctcagcctcccaagtagctgagtttacaggcatgtgccaccatgcccggctaatttttatatttttagtagaggctggttttgccatgtttgccaggctggtcttgaactcctgatctcagatgttccacccaccttggcttcctaaagtgcttgagccattgcgcctggcattagttttttgtttttttttttttttttttttttttgagacggagtctcgctctgtcgcccaggctggactgcggactgcagtggcgcaatctcggctcactgcaagctccgcttcccgggttcaacgccattctcctgcctcagcctccccagtagctgtgactacaggcgcccgccaccgcgcccggctaatttttttttgtatttttagtagagacggggtttcaccttgttagccaggatggtctcgatctcctgacctcatgatccacccgcctcggcctcccaaagtgctgggattacaggcgtgagccaccgcgcccggccagtttttttttttttttgagacagagtctcgctctgtcccccaggctggagtgcagtggtgtgatctcggctcactgaaagctccacctcccgggttcatgccattctcctgcctcagcctcccaagtagctgggactacaggtgcctgccaccacgcccggctaattttttgtattttttagtagagacggggtttcaccgtgttagccaggatggtcttgatctcctgacctcgtgatccacctgcctcagcctcccaaagtgctgagattacaggcttgagccattgcgcttggcctcgtttgtttttcaagagaaaaggtctcactctgatacccaggctagagtgcagtggtataatcacagctcactacaacctcaacttcttgggctcaagtgatcctcctgcctcagcctactgagtagctgaacctacaaggtgtacgccgccatgcctggctaatttcttaatttttgtagaaacagggtctccctatgttgctcaggctggtcttgaaatcctggcctcaagtgatcatcccacatcagcctcctgaagtgttggggaaccactgtgttcagctcttgataaaattttctttgaaaacaaaaaccttctttggccattctgtccctcaacagcatcccttctttgttttcttttttctttcttttttttttttttactggaagctgagaggatcatccagcatctcttctttgagctcctcttgtgtgactgtgtttgtccctcgcctcaccatgtttatcatagagtgcgtatgtttgtttctgtgtaactaactaaataaatcctccagggcaagactgattcatccaacagtacatctttgttatccccacagcacatcctgggtggactggatgcaactgtaaatatcaggtcacaagtaagggggaagtgacgattaatatcaaaatcctatctgcatatgtgtccaagccattttggagtcatacagacctggttgagattctggctgcactgcctattaggtgtgtgtccttgaacgagttacctaacgtcactgtgtaaaatatgagatgtcaccatctgttggaatcttccctctctgaaatacatgatttgatgtttagcaaaggattacatactgcagttaagaaccgtttacctaactctctttcctgaaagactcagtagtaggaaagcaccatgggtttttatagataccttgtggaagagataagctctgtgacttgtaaaacgccttgtcctgcccagaagcaggagaggtgtgtgttttcttgcctcagcaggcctgctacatgcctgcctttgtccagccccaggacatagataaagctagtgttcttggtttctagcagttaagcaacctatagtgtttctgcctggcagagttctgggtttgggatttatccccttgcattccccaaaattattacttcaggattcttttgttaatgcctagcctcacacccatgacatgaagatgtctcagtttaacttttgttgtgacactcatgttggtttgaggtttgagttagtattcattctctcctttcttgagttagaactctgaggcatttaaatgggtgcgtgcccaaaccggagaaagataagaaagatctcttatcttagacattctgtgtctgcccagcagcctctgctcaaagctcctggaaataaaatggccttacgcctggagattatctcctaccctagaagcctggcagttactgtcctgttctgacaaactctctttcttcagatcccttgattgtaaaataagatacccctagaccttcagccctagtcgccgtcagcctcagttgaccagatggcaaaggtgtgggaacagctcaccaggttcccaagagccatgtcctaggaaggtctccagcctattccttgtgtgtggatctgttgtgcattaggaacagatgagaactttagggctttcccagtctttgacctcatagaaccttgctttccaaagtgggtcagaaggaccctaggaccctgacttcacactccagaacaccaccatcatatccagtgtgcatggcagtctcataaacagggttccagagcgctgaccagggacctgcctgtctgcttaacattcacctgaccctcagttctggtttttgctgtttgttttttccttgtttgtaacttctgatattctaatagctgacgcctgtgtgttcataaaggaaagagcctgtggagccagagtcttcactcaaatccttgctgtctcacagccagctgtgtgaccttgggcaagttacataaaccccatttgcctccatttctgtaactgagtaatagggatggtaatagccacatcatagggttgttgtggctgtgagatacttagcatggagtctggctcatggtcagggttgaacaaatgattatctctcccctaccccaccccagaatttaaagattataaatatatagactgcctacaaaaatgttgccaaaagatacttaaacaaattttctacagtaaaagaatgaattcaggtagctgtgagcatgtatgtttttgcagtatgtcttaaattaatccggtacggcacagtggttcgtgcctgtgatgtcagcatttgaggatgctgaggtgggaagattgcttgaggccagggattcgagaccagcttgggtaacatagcaagactccctatttaaaataaaattttagggaggcacggtggctcagtcctgatgtcctggctcataaggaggcgaggtgaagcgttcgagaccagcctgggcaacataggaagccctcatctataatgacagaaaaaattttaaataaaaatttaaaaagttaatctgaggccagacatggtggctcatgcctgtaatcccagcactttggttgaggtcaggagttcgagaccagcctggccaacatggtgaaaccccatctctaataaaaagacaaaaattagctgggagtggtggcgcacacttgtagtcccagctacttgggagtctgaggcagggggatcgcttgaacctgggaggcagaggttgcagtgagccaagatcgtgccaccacactccagcctggttgacagagtgagactctgtctcaagaaaaaaaaaaaaaagttaatctgaatccaaagggtagtatttccagcagtactatctctgggggttctctgaattgcagaggaggagactgcctcggtagaaggatatctcagatgctgcttggggccataagtagttgttaatctgcaacatttttttttttttcttgagacggagtctcgctctgtcgcccaggctggagtgcagtggcacaatctcagctcactgcaagctctgcctcccgggttcactccattctcctgcctcagctcccaagtagctggaactacaggcgcccgccaccacgctggttaattttttgtatttttagtagagacggggtttcaccatgttagccaggatggtcttgatctcccgacttcgtgatccacccgcctctgcctcctaaagtgctgggattacaagcgtaagccactgcgcccggcctttttttttttttttttttttttgagacagtctcgctctgtcgcccaggctggagtgcagtggcatgatctcagctcactgcagcctccatctcccaggttcaagtgattctcctgcttcagtctctcaagtagctgggactacaggtatgtgtcaccatgcttagctaatttttctatttttagtagagatggggtttccccatgtcggtcaggctggtctggaactcctgacctcaggtgatctgcctgccttggcctcccaaagtgctgggattacaagcatgagccatgcccggccctttttttttttttttttttttttttttttgagacagagtctcgttctgtcgctcaggctggagtgcagtggtgtgatcttggctcactgcaacctctccctcctgggctcaagtgtccctcccacctcagcttcccgagtagctgagacaacaggcatgtgccaccatgcccagctaatttttgtattttctgtagagatggggttttgccatgttgcccaagctggttttgaactcctgggctcaagcaatctgcccacctcagcctcccaaagtactaggattacaggcgtgagccatggtgcccagccaacctgcaacattttgacaacataatcctgcttaattctaatttagtatgacttcctttttttttttttttttaagttggtgaattcagcattgaatttaattctgcattggcaggcggatgactaaagtcatttgaagaaggatttaccctacctttggctcatcatgtatgaggctggatcacgtacataggagaacccattttttcaggctagcagaaattgttaatgatcatcttgcttttcaaatggcaaagctgactcctttgtcactaggttgtagtaatatttgtataacatggcagaaagtgaactcactttcctgggaatgcctgaatttgccaactcaatctctttttctcctcacccctcagatatcagcgcttagtgaacgttagtgaggggctgtaggcaagaagttgatagaaagaagctgttgtcagcagtcacttttttagaatatattgtattgtactaggtgtaatgccttgggttaaatgctgccttgcacacaagaatttataatctgtgagaagataaaaatagacgaatgctgattagaaacactgtcttgggtagcatcataaaaggatgattcattaggaaatcaggaagtctataatgcaattttgatcatttaggttgtatttttacaagtttttttttggatttctagtaattttgttgcaattccacttctgagatcatcactgatgaatattatttagaattatggggccaagcttagtggctcatgcctgtaatcttaacactttgaaaggctgaggcaggaggatcacttgaggacaagagttcaagcctggacaacatagtgagaccctgtctctacaaaaaataaaaattaaaaaaacttagctgagtgtggtggcgtggtggcgtgtgcctgtagtgccagctttttgggaggatgaggcaggaggatcacttgagcctagggtgacagaacaaaaccctatctcttaaaaaaacaaaacaaaaaaaaaaaaggaaggaagaaaaatatggaacacttcatagcccattagagcaaggtttattgtgtgttttggtcatagtggcatccccagtgcctaaaacaatgcctggcacactgtaggcattcagtgagcgtggagtgagtgaatgaatggtacacttatgccatggcactctttctggagaatttcaggtgccagtctgtcttgttagatcagtgcagattacattgcccatgaggggatgaggatgctgtttccatcagtttgattgccaaagttagtgctgcgtatgttttgtggttctcagtggttgccagggaaccgaggaagtgaaaggaaggggttgaaagcagcctcattgctgttccctgggcggctgtgccttgatgtccagccttgtctgtatggcagtttggcctggttgtgagagtggtgacaaggcctgggatagactgaccatgtcttgagaatatgtatgtgctgaagaatggcttcccagtccccaaacaccggcagcagcaggagccacttcttttacacatcagccaccttttcctctagcaatgaagctgtgatccattctttcagtgagtctcaaggaaatggttcagccagtttggcacattcattttcttgtcaggaaagtcaatgtgaccttgaccatcattggggacctgcggtaaacacgttgtgtgtctggctggattctaatgatcaaacagtgcttttggcacctcactgtgctgtacgtgtcatgtgctcctaatttattgtcctaggttgggggttataggtactaatttgcaagaatcatttctgacttacatggatcatgcccagcacagtgccactaccatggaggccttggataagtatcatgaaagaaaattgttgcagaaaatgaaaggaaagatgaaatatacttgctttgagtcctggacagtgtaattaatttgtagctgaggaagttattgaaaagtaactttttgtaatcccagcactttaggaggctaaggtgggcagatcacttgagcccaggagttcaagaccagcctgggcaacatggcgaaaccccatctctacacaaaaaaacaaaaattagctgcgcatggtagcacgtgcctgtggtaccagctccttgggaggctgaggtgggaggatcgcttgagctcggaaggcagaggttgcagtgagccaagatcatcacaccactgtactccagcctgggtaacagagtgagaccctatctcaaaaaaaaaaaaaaaaaaaaaaaagtaactttcgatttataaagctcctctgaagattgttctccttgagtcatttctggaaatccgaacccaaacatggaccttttgtgctgtgcaagtgttgtctttggtagaggattcaggccgagggagagctgctgtgacctcctgtttcagggagggtagccagaagggatttggcttacaccaccgactagggaaagtcagagcaggacaccatccccagggcccttgcttgtgcaaagcttgcgttagagaactcttgtctccctgagctgaacttagtgaagaaagcacgacaaacctaaggcggtgaacttttctgaaccaagagttggtttaaatatagatgatctgcctttctggcaacttggaggctgcggtgggacttgttgtaccttttataagacaagtgaggaaagatgttggcacctgtacttgcgcagtttgtttatgaaatataaactctccggtggaagcgagggctcgaaaggtcagtgtccaaggtagcgtgtcgtaccttagctggggaaaaggtgcctctccaagcccccgctgcgaattgcctcattccctagagaaagttgggacagccaggcttcatgtcctattatttactgagcaccgactctggcaggggtgggggtggaaaagtttctgtgaaactgacagacactggacttgattttctttcccagggaggagaaacaatactctaggagctacaaagtcagtccttattcagagcagtgttcctgttttcagctttagagacttgatttatgtaccccccagcctgcttagagccaaggggttgcagcagcctgctcccatctgcagcccccaccatcctcccacagtgggctctggctctaggtgggtccagggctgggcatcgcgggtctgcagcacatcctcctcagtattccagtgcagctgtctgaagttttttctgctgcgcctgaactgatgtcatttcccccttggcagacagcttcggctttgctgcgtctgagatatgtcacgagaaggtgggggtgggccagagccaggcagggggagtagcgaggagagcaggagacagtgtgcctgctcggtcccaggactctgtttactttgtctgctttgctaaagaaggccggtgaaccaggaccaccgcacacacaggcccaccaggggcaatgctcattccaagaccttaacttttaagagccctttgttccaacgttagtgtggacgatgctcttgcaggatgcctttccttttgggtcttagacaggtaattgtttctgcacggatcgggtttggaagggaagaaggggtgggagcttgtttattgtactactgctttgggtggagggaatattttagcaaatgcctctcagttagaccaggccagctcccacacagaactttccagtctcccttcttgtttgctagttgctccttactttcagagccaccgtgttcttaaccctctacgtccccgaggtttctctagggctgaccagttctgattttccatcagacactgtaaaactgctttggaaacttcacggagaaacagctgaagaatggggctggggaaggggagaggcagagtgcgattcttgctccaaaccccttttattccttctccattttgatttggctagttagtggagatttcctcacagtcctctggttctgaagggactctgtgttgggggtggggtgagggctccgttcttcttttaaaggaaaggctttcttcctttcaagcatgtgcctggggctgtgcagctgagggacgttcccgacgcctcaggggaaggggtgtggaattgaccccattttggccttactgaccagtttttcaaaaagacccctgtggcagagacttgattgctcggtgagccgccctttgaagtgggagcactgcattcattccagccggtaaagcagtgtggaatgagagaacagtagcaagccaccaactgctgtctgctgagaacacagctgttgccaactatttgttccagggcttctgagagtcagacacccccaccccctcttcgtctgagaggcatgtctgtatcggaatgtgtaactgtaaccagcagctgctggccataaggggtggggagggagcacacaccctctgctgcctgttcctgggtgaggaaaagccacagatgagctcacagcagaagccctagaggggagctgctagggaccactggttgccctcactctgagaaaagtgctaggtggacaactctcccttgagttgcctacagttctgttcaaaggaagctcctctgaaaagccccaaacattccattacagctcttgttatcttcagagtgttgcgttgacacagctgatgggcagagaggtgaccactctgaacatcccttctgcccccacaagaaaggctgtccttttttttttttttttttttttttttgagatggagtctcactctgttgcccaggctggagtgtagtggcgttagctcactgcaacttctgtctcctgggttcaagcgattctcctgcctcagcctcctgagtagctgggattacaggcatgtgccactatacccggctaagttttgtatttttagtagagacggggtttcgccatgttggtctgactggtctcgaactcctgacctccggtgatccggccacctcagcctcccgaagtgctaggattacaggcgtgagccactgtgcctggccagaaaggctgtccttttaacctatgggcagagtgagccctggagaggatttcaagcagtgttggaaataggatgaagctggatgaagcgtctcatgctgtgtcagcaggctggtagggtgaaaactgcctaacagagtggaaagagtgggctgggagctggaaagacctgcgttcatatcccagcttccctgaggtcttgggcaggcccttaactgttctgaacctcatctctgaggtcacacagggattccacgaaagaatgtatgtgaacgttagcacctgggctggtagagagtagacataactcttactttgatctactcattcccaaaggatgcaacactgcaggggtgcaggaaacgagaagcgaagggactgataccttgacaggagccaggtgtgctgggcaggagcccacagccaggggagtgagctcttgcatctgtagtcagtgactgccattgtgcagtgacgtacagctgggaggccacctcttactctaccgagacactgttaatcttatatactgaggtggcaagagggcgagggcttgtgtccagttacttggacatgtagtgagagaatgaagcagtgggtagcattaaactcttcaaggagagtgaagggttgggatggttgttttgggaaggatctgagaggatcaacagcaggtgaacctttagctcttgtgtctgaacagttgcctggtggaaggcagaatttagaagacctccgaaggcccttcctgccctaggcttctgtgactcaaatgttgcctgtacaatcttggagtagttttggttacatattttgtatatttctagtattttctgtcagacagtgtaactatgttctttattggagccatgtagccttctaaagatcacttggtgataattctgtttaagaaaaaatgacacataatgcacacacacacacataaaattcatctttatcgtacatatgtatgcactttgatttatttttttcccttaatccatatgattgttttttccccttaatcctgtgtcttatgtggtaggattattctgtttgtacagaggtgcatgctgaggcttagagaagttaagccatttgcccagcattgctcaattgtctagagaaagggtaattgaagatttttgttgctgttttttaacttgagtctttcccaaatcctggatttttctcactacctagactgtgcggctcaatgtctgagagtagagtatgattaatgcattgttctccttggggcatgtttctttctagcctgcctaggtaggagataaaatgctgcttaccccttaatcccagcttttcaggaggctgaggcaggagaatcgcttaaacccgggaggggaaggttgcagtgagccgagaggccccaccattgcactccagcatgggcgacaagagcgagactccatttcaaaaaaaaaaatcattcttgttgagtctcgttcttgtcacccaggctggagtgcaatggtgcgatctcagctcactgcaacctctgccttccggtttcaagccattctcctgcctcagcctcccaggtagctgggactacaggcatgtgccaccacgcccagctaattttttgggtatttttaatagagatggggtttcaccatggctggccaggctgatctcaaactcctgacctcaagtggtccgctcgcctcggcctcccaaagtgctgggattatagacatgagccaccaggcccggccaaaaaaaatgtagattctttatgtctgggccagggccccagaatatgcatttctgtgaagttccccaggtgtttctgatcccggttgtttccggccacactttgagagactgtcctccagagctgggcggcatggaaataattacaagccagcatgctgagactacaacagaggaacgcccagggactgggagagcagagcgtgggggcaggtatctgaatcaggctaggagaggctttcctgagaagccgatatctgatctgactcttgaaggatgaggaggagagtttaccagacatgtgagttggggaaagagcattccggacagatcaggttgggagagttgtttttgttttcttctgcagatgacaagggaagctgtcattcatctcttgagtcttggcattgaatttgcctggggcaagataaggaccttagttcaccaggtatgggtgtcttttatgggtaccaagaaggaggaagacctcagggcccttctttctaataatgagcatggcatgatttcagtgtctgtaaagggcagataaactgtaggatttattagttctttcatgcaagggacagttagacagctcatggaagctacagtgttgactaaaaaaaatgctttttgtgcttagatgagccagagctcagaagaagatagtcacctggtgaactttttgggtatggcactatataccaaattttagatataacaaacaattaggcatgctatccctttattatctgacaagatcagaaaataggttttctggttaagagaaattccattatgtgtacctaacaaagggattactaattttcggagaacagtattgcaacagaatgttcttagtcatgatttgaacgaattctatttcatgtttatccagaagatattgattgggtaatgtcgaaggtttcttaggagcaacactcagcatctgaaaagtcctgtgcacctgttctacccaaagcatgttgtggatacaaagaggtataaactccatccctgccctcaaggggtttacagtcagctagggaaagtagaataagtgcacaggtaatgaggacattctgcaggtggtagcaaatgacactagaaaagaatagaatgccgcagttcagaggtgtgaagaggcaacccttctgcaggtggcccttcccacagtccaatccagtagtatcagttgttgcactataggtgctaggtgtgtggaaggaccagtgggtggtaagttctagttgatggaatgcaggctagatccattaagacactaattttacatcttgcaccttggaatattgcctttctcagtgggaaagacccattgtcctccaagttgtccacaccagtgagatgggatgatccctgatactggaaatgaataatacccatcaaagccctcttagggtcccttttccaggttggaatttgtcatggaaagaggcacagggggcaactcctggcccaaggggctgtttgtatttttgaaagggtgagctggtccctgggctgatgccgaatgtgacaaggcaactagaatgttgcatggtacttactccctgggcataggaagtggctttagagtctcacaaggagagcagtggaaaggctgtgtgatagccagctaaagctgcagggtggagccatgactgtggagagggaagggggggaattgccggcttccaatttaacccctcaactgctgaatgttagccagcattgacttggggtatttattatttcaccacagcggccacccatgagggaggaggtcttatctcctttttgctgtaaggaaactgaaacccagggagaagttatctgttccagaacccagggctaatgtgtggcaggaggggcctggagtacaagtcttcttggtgtctgtctgcccctgcccgttgctctggcttggtacccatatccacagtccactgcaggcctcctcctccctgcctgctctgtgcacagcagaggaccgaatgttgactaccagttgctgttaccctcgggcccaacctctttccaccaggttgaggacaaattaagcaagatcttgcttggaaggaaactagctgtatatagcagcaaacaccaaggtgacacttgtttgtgctaccaaaagttgaagccagaatccttatctaaactgatttgtgaaagtcttgtgacagctccacagaacacctcatttccctactgtcaccacaggtgagaaaggtggtgcttacgcaagccctttcaggttaattttttttggggggggtggggggagggatggagtctcgctcttgctctgtcacccagactggagtgcagtggcgccatcttggcttactacaacttctgcctcccaggttcaaggaattctcgtgcctcagcctcccaagtagctggtagcacctgccaccatgcccagctaatttttctatttttaggaaagatggagtttcaccatgttggccaggttggtctgaaactcctgacctcaggtgatgcacctgccacggcctgtcaaagtgctgggattacaggtgtgagcaactgtgcctggcctcgggttaatttttgaacccccaaccatctctgttgaaagaagctgcttttttttttttttttttttttttgaggaacgtggcttgtttttcattgcatctctgttatcagagcaaagagaaagtgtactggacagtaacttagtggaaaagaggactgtgcctgctgattttgaaacattatccaggatggagccaaagaaaacagtcacttcctccagtgatagcccatgagtttgacccgccccctcccaccccttttccatgaagaggtaaattttagtccaggaaaacagaatactttggggctatttaaaaaaatgctttgaaatcccttcttctgccctaattccttagcactagtaagatactagtttcttacctcttcctctctagggcttcttgactcttatttcttgctaatttgtagcaacagtgggttgaaagagccctgagaatggacctgcctgagccatttctgtgcccctctgtagccattgtttctctgggcagagctcacctgaacttgaaccccagacctcacaagaggcttctattgctggttgctggaaatggtgataaaatcctgtgaggggaggggcagtgcagggaaggagacttggctttgggaatggctggagtgtgacatactgacttcttttcctgaaagtggctgagggtttgccgggactgtgttgcacataagacttcggtttcctctggcattgcatcaaggaggccagagtatttattattgtttggttttcttgcttaacacacaagacttaaggatctcccaactgtgatgcacggtctcgatgtggtttcaaatactgtccaattgatcttgtggtttccatcgagggtgtgaaatccctggttacccaccaggcaggcagtggtttgaatacctgtgatctcccacccctctgggtgtggttctggagtgccgtgggaggttaggacaggctggggcggaccgccagcacaaatagaacatacagtcattcctgcgtctctgtgtaaggttccagattcatgggccaggctcggcttgtgctgggttactgtaaaccaggatgagagagccacagccagagagccacggttcattctcgcactggtcatgtgaaaatcacacccccacagccttgccttaggctttgaaggaccccttcatgctgctgcttgtaccatgtagctaagaggcacgagggatgaccagctcctatggttacttgactcagcggtcgctaggttcaggactttgtgaagggtttttggccagggtaggtatgcttgtgagactgacatcagtcctgcccacggggaatttagagcggggtggtggcagggagtctgtgaggcactcggagaacaagactggctaaaacacggttctgtacaaaatattgtgctgcagtttggctaaaacaggggctctaaactgggacagttttgcccttcccccataggggatatttggcagtgtccagacatggttagctgtcacagctaggggagtaggaagttgctactggcatatctagttaatagaggccagggatgttgctaaacatcctacaatgtacagttcagtcccgtatgacaaataattacctgactccaaatgtcagtagggctaaggtggagaaaccttggggtagaaaccacagactcatagtagtccactctgcttgggaagcaggagtcacaggactgagggaagaagtaccatattgttttaataaaggggaaataggtagagctttcctgctgccttctaagcagtgtgtgttcattatctgcccagaaatttagaattttcacattggttgttcctttaatcactaggtactctgtcttattaatgacaggtacagagtcattttttgtgggccagtagatatgaccaagcccatctgaaatatggatatgaccaagtccatctgaaaagtcggatggaactgacgtttcatcccttactcaaataaccgggattactaccccccaggaggagaggatctcagtggtacccaaatgactttgtacatacaacttaaagaaaaagcaggcatagttattttagcagcagcccatatttcaagccaggtacctattgctgtgggttgggtttattgtaatctatcattagtaacatactaacacccccactcccccaaggttttctacatcactgaagtctattttaatcttaaagtccaagctctcagagttccaaaagttcttgtttcttttttttttttttttttttttgagacagagtcttgctctgtcgcccaggctggagtgcagtggcacaatcttggctcactgcaagctctgcctcctgggttcacgcctttctcctgccccagcctcccaagtagctgggactacaggcgcccgccaccacacccggctaattttttgtatttttagtagagacggggtttcaccgtgttagccaggatggtctcgacctcctgatctcgtgatctgcccaccttggcctcccaaagtgctgggattacaggcgtgagccaccgcgcccggcgaattttttaaatttttaatagagatgaggtcacgcttttttgcccaggctggtctcaaactcctgggctcaagcagtcctcccacttcagcctcccaaagtgctgggattgtaggcctgacccactgcacccagcccacttttttttcttttttttttttttttagggcggggacagagtcttgctctgttacctgggctggagtgcaatggcacgatctcaggtcactgcaacctccgcctccaggttcaagtgattcttccgcctcagcatcccaggtagctgggattacaggcacccgccatcatgcccggctaaattttgtattttgtagagacagggtttcaccatggtagccgggcagatcttgaactcctgacctcaggtaatctgcccaccacagcctcccaaagtgctgggattacaggcgtgagccactgcgccaggcaccagcccacttttttttttttttttttgagacagagtttcgatcttgttgtccacccaggctggagtgcagtagtgcgatttcggctcactgcaagctccacctcccaggttcatgccattctcctgcctcagcctcccgagatgttgggactacaggcgcctgccaccacgcccagctaattttttgtatttttagtagggatggggtttcaccgtgttagccaggatggtctcgaactcctgatctcatgatccacctagctcggcctcccaaagtgctgggattacaggcgtgagccactgcgcccagcctcagcccactttttaaaagttgaaaaacaacggtgccatgtaggcatagaactcattagtgggtccactggggcttaagggccactagtgcaatccccacttttaagaggggagaggcagtgatacaactgtgggaagaaaaggacctacttcatggcaccaactgtgagtggatgacagtaggctaaactgcccctctgctctgcctgagtgccacctgctactcacctgctccgctgcatgctacctgctatttcagccctcagctctctgcaccagcccttgctaaagaagccatgcttctcaatggacttactctgtagcagaagaggccagtgatgaggaattcctggggactgcttttccttctaagtgtccaggggtgaaagagtggtccatgaaccagggtccagtgcctctgtagcctgccagactccacaggcctgcatgccctgggacattgacaagtagaccttaataaaaccatgggatatgttgcaacttccgatttttgctgtgggattttcctaccagggtcaagtagctttttctgaatttgttattcaggttcctaatagcaacacaggaaatggattttaatttttttgctggctgctctgtttgggggctgtttaatgaggatgtagttgcagtgcagctttggcagtaacagtactggtgtggatgggagcgtagctaacatgtcacttctttttaaaatttatgtgtatgatctattatatgttttaatggaatgaggcatagagagtataaataatgtgccttgattctatgtaggtactcttgtgggtaactgtgttgggacacgtttgggattctagaaaacgaatatgagtctatttcatgtttagagagcaggaactgtttattgtatgttctttttagatccagggcagtggttctcaagcttgaatatacataaacataaccaggggagcatgttttaaaaggcggattttcagtccctgcccctagagggtctcagtctatctacattcttgacaaatatttcagatgatctggggcccatggaccacacttttgggaaacacatccctattttgttgcatttgttgtctaagcatgttcattgttatgtgggggcaaattcacttatttataagatgcccttattgtcctgattcactgtgttgcccttcctcagattcttgactagtgttagtctttgggagggaccagaccagattgttccaggatgccctgtgggttgaagtcagtggacctctattgtccccactactacccctgggactcccctttggggaccatgacactgtgggctcatcttgaagcagcagccatctcttttgatcctaggcttttcttacattggtcacaagctccagtctttggctttactctttagggtactctatagctaaagcatgggggactgggtcctcttaagcccagggagctggagtccagagcccttaaggagtaaaccacactatcagatctgagggatgaggctgaaccttatcagaagatttactggcttggttaggggaacctacccatgtagcccaggctatttgttcttttggaaaactactgaattcagccaaacagcataaaaatccattcctagtgtcccattgcatgcaagacaaagtcttggttaacttcttagcagtggcttgccctttatggggaaggatggaattgagtaagctcttttagccaaagcttatggaataattgtcaggtgtggtatatactagaaaggatacgaaagtagtacatgacaaccccaccatcaaagaaagggagattagactgggcacagtggctcccgactgaaatcccagcactgttggaggctgaggcaggagaatcacttgagcccagagtttgagaccagcctgagcaacgtagtgagatcctgtctctacaaccaataaaaaaaattagctgggtgtggtggcgtatgcctgtggtcctagctaattgggaggctgaggtgggaggattgcttgagcctgggaagttgaggctgcagtgagctatgatcgtgccactacactctagccttggtgacagagtgagaccctgtttccagagggggaaaaaaaagagaggggagactagactaacacatgggaagcaataggccaggactcctgctgcatcatcccccttcttgagcttactttcttcatcctcagcccttctgtactctccttctacccaatttgaaaatgtgtgcccttgaacagttctctttatttccctcaggtctttgaacagtctaaaaaaccaatagtggtcaggcacggtggctcacgcctgtaatcccagcactttgggaggccgaggtgggcggatcacctgaggtcaggcgtgcgagaccagcctggccaatatggtgaaaccctgtctctattaataatacaaaaaattagctgggcgtggtggtgcacgcctgatgtcccagctactcgggaggctgaggcaggagaatcactggaacctgggaggtggtggttgcagtgagccgagatcgtgccactgtactctagcctgagtgacagagaccctgcctcaggaaaaaaaaaacaaaaccaatactatcagggagaacgtgatcttaactttctttctttctttttttttttttgagacagtctcactctgtcacccaggctggagtgcagtggtgcgatctcggctcactgcaacctctgcctcctgggttcatgccattctcctgcctcagcctcccgagtagctaccacgcccggctaattttttgcattttttagtagagacggggtttcacagtgttagccaggatggtcttgatctcctgatctcatgatccgcctgtttcggcctcccaaagtgctgggattacaggcatgagccaccacacctggctgatcttaactttctaattgtaaaaatataggtaaaaatataggtgaatacatgaagctttgcctccttaccacctacaaatatgtttctaaggacctgggcttgaaagtgctgcattttcagaacttgaagattctatctaggatagaacaaaaatagctgattctaagttaaagttgtttgctgtcttatttagccatttcaaatgtctgctttatgaaaactgcgttatcctttagctacagagcattaccaaaatcatttagaactttttcctagtagatatgcagtgctagactttggtctcctttctagaaagccattcctggttcaagaatggaaggaaagtttgttttgttgcttactctgcaagagcagccacaacctggctgggggggataaataaaggctcaaggtaaagaataagtatgagagttgcaaaaatatttatatatttattcaagtctccaccataacctaagggagggactagccaaagccaacaatgaattcataaactgtggtactttggagattattttattttattttattatttattttttactgagacggagtcttgctctgttgctcaggctggagtgcagtggcacaatctcggtttgctgcaacctccaccgcctgggttcaagtgattcttgtgcctcagcctcctgagtagctgggactacaggtgcgcacaaccacgcatggctaattttttaaatatttttaatagcgatgggttttcgccatgttggccaggctggtctcgaattcgtaacctcaggtgatccacctgcctcagcctcccaaagtgctgggattacaggcatgagccactgcacccagcctggagattattttaattgttatacaaagcctatgagatctgacctcagctgaattcttagctcccctttcacactgctttccctgagatcactgtactcagctacactagtcttctttctcttccttgagcacaccaagcttgtttctgccctggtgtttttgcgtggatttgatatttcttcttcctggaacactgttctcaccggtctggttaagctggctctttttcagcagtcagggctctactcagatgtcacctactcagagtggcctttcctgaccaccctatctaaaactctttgtctcattatcgtgttttattatcctcatggagcttattactgctagtgaaattataattttgcttgttaattgtccgtcttcccaactggaacatatttaaaaatctttttgcctttgtcactctgcagtttcatacagtgtacctaggtgtgggcttcttattatctggaaattttgtatctttttttttttttttttgacagtctcactctgtcacccaggctggagtgcagtggcatgatctcggctcactgcaacccccgcctctcaggttcaagcgattttcctgcctcagcctcccgagtagctgggactacaggcgcccgccaccacgcccagctaattgtatttttagtagagatggggtttcacagtgttagccaggatggtctcgatctcctgacctcatgatctgcccaacttggcctcccaaagtgctgggattataggcatgagccaccacgcccggccgaaattttgtatctttaatcagtcttatatagaaaatttttagttatccctttaaatatttcctctcctccattcttttcttctcaagcttctttctcatttttcatttccatgttttctcttgtagaagcactttgatggtaattttctcagatctgttctctagttcatcaatttcctctttaacttggtctcctctctgtgtgacccatctgttgagttttttctttcaataactatttttctacaagttttatctgcctgttactatttcttgtttggtagtgttcttttcttgtgtttttaattctttctttttggctttaatcatttgagatatgcttgtatcttatagggactttttttcagggggtcttatcctgctatttgttgaatttgtcatcttgtttgtaatggattagttttgcatacatttttatattttggattgtgagcttatcttcaacagaactttatttttatttttatttttgagacagtctctcactgtcgcccaggctggagtacaatggtgcaatctcggctcactgcaacctctgcctcccgggttcaagcaattctcctgcctcagcgtccggagtagctgggattacaggcgcccgccaccacgcccagctaatttttttgtatttttattagagacaggatttcactatgttggccaggctggtctcgaattcctgacctcgtcatccgcccgcctcagcctcccaaagtcctggaattacaagcgtgagccaccgcgcctggccaacagaactttatgtgtaggaatcctttgtgccgtggctgagggtagatctgttcagttttgtatttctgccagatgttgcaggtttattgccagcctgggactactttttgtgttaaatttttggcttggggatcctcagaccatgtagtagtacaattcaaatctgaaataatctgtgatcacacattattagaggagatactgttttcctcccacttcagagtttttattgtcactatgtgccagtgggctaatgttttttctaatctgttctccccctctgagggcgccagctttgtactggttctcagttccaattccctgtttcaggtgggcccaagatcaacaaactaccccactttctaggtcaactggaaaggcctgatctcatttactactgtggtttctagttcccgctgtcgtttttggtcccaggtgatcctccttgctttcttgcaagttcagctttgtaattaaaagtgattgttgtatagccagggttttatagcagaataatttttagttacctacccagctatattgccagaagcggaaactctcccctcccaccccccgaatctcttgcttattgctatagctatagcatcccacatagtgcctggcacatggttgggggaagggggtcaatacatatgtgttaaatgatttggagaactgaacatttccattaggaattagttcttggccaggcacggtggctcacacctgtaatcccagcactttgggaggccgaggtgggaggatcccttgagcccaggagttcaagaccagcctgggcaacatgaggagaccctgtctctatttaaacaaacaaaaaaagatttagttcttcctgcagggaaagccagaggtgatgctccaaattaattcatatccagcagccaagatatttggtgtcctgtgctttagcatcccaggaaggacttcaattcttatttttcactcttaaactttaaagtgttttcctaaggacatgacgctgttgccattagccagttgctagcagagttttccagacccataaattggcagattaaaaccatgcctggggaaacattactgcccagtgtgtctttttatgctggcacttagaaagtttttacgctgattaaattgacctttacagtggctcagctaagaatagcaactgtaagatgtggaaactgttgaggaaaatgttgttagtcccacagtttatactgccaccaaagagaggagataattttttgcatatgtgcaaaaggcatactgtttatcctttccagtgtaaaaatgttttttccagtttggtgttggtcttgcttgtctcttctttatgcctttgttttctgtttggtaaccatgtgtgccttgtctctcagagctggtcactgtggcaccggggctgaaggcacatacctgtaatagatggggctcctagtagccactaccacggtcattcccgaggtgaaaggcctcgcgtaagcgcattcattatgcaccaaagttcctttttgacaagttgtacatttctagctttctggggttttgttttagccatggagttttgtgcaaatgaaaacattgccaggaagatgatatctttaaaatgcaagtatgatcttgttacctccctgtacagagtggtccccacctacctaactttcctatctactacttctaccatctccttctagccaaaagggctttgcttgtagcgttttctctgcctgcgatgttcttccctgtcctcttcctagttacttttttttttcttttctttttttttttttttttttgagacagtgtttcgctcttgttgcccaggctggcgtgcaatggtgcgatctcagctcaccacagcctccacctcccgggttcaagcgattcttctgcctcaggctcccaagtagctgggattacaggcatgtgccaccacacctggctaatttttgtatctttagtagagacggggtttctccatgctggtcaggctggtttcaaactcctgacctcaagtgatctgcctgccttggcctcccaaattgctggaattacagacgtgagccaccgcgccgcctagttactgactttttaaccgtactgtcaatctcagttcaagcttaccttcctcccagaagctgttctggaccttcttgaccagttcctgggtcttttactcactgtcacctaatctgcacttttccttcccaacatttattgtagtcgcagttttatctgcgtaagtattttaccatctttcattagactgtaagttccgtgaggatggcctaaacaatataataatgtgtaatgtgctttgaagatgcttggaagaaaagcataagctaggtgtggtggctcatgcctgtaaccccagcactttgggaggccaagatgggacgattgcttaaggccaggagtttgagatctgcctgagcaacatagtgagaccctgcctctaccaaaaaagtaaaaataaaaaagccagatatggtggcacatgcctgtagtcctagctactcgggaggctgaggcagaaggatcacgtgagcccaggagtttgaggctgtagtgagctacagtcgtgccactgtactccagcctggacaacagagcaagaccttgtctccaataaatacgtaaatagtaaaagcataggataatcataaagggtgctgataatttttcatatttgacctttccattgcattctttccagttcctttttcttttcttcttcatgtgtctggagcagcccacattgccacagagaacttggctgttctgaaacaattctgagtgaaggcaaagtgctttttggatggtctttcatgctcagcaatagtggctcacagaataatgttgatagtaggagcccagagaatttaattagcccaaggtcacacagttaatagccctactgtaaaagctgggctttgaacccagatccagctcactcttttttttttttgagacagggtctggctctgtcacccaggctagcgtgcagtggtgcaatcatggcttgctgcagcctcaaccttctgggctcaagcagtcctcccacctcagcctcccaagtagctgggactacaggtgtgcaacatcacacccagctaattgtattattatttttttggttgagatggggttttgccatgtccaggctggtctcaaactcctgggctccagtaatctgcccaccttggcctcccaaagtgctgaaattataggcgtgacccaccacacctggccccagcgaactcttaactacttaggctttgtgtagatcttaagccaccgggaggtgtttgagtcctaggtgtgcaacaattaggctcctcatataaggaggggtggaagatcaccaggcagcatttccacaccactgttctttgctgtggatttgcatgagaggagacatagatttcatgatatcttgcattggcttgaggctgctatgtcagggtggaaaggggatggggaggataataaaaccttaaagttgaaggagacggctgggcgtggtggctcacgcctgtaatcccagctactcgggaggctgaggcaggagaatcatttgaacccgggaggtggaggttgcagtgagtcaaaatcacgccactgcataccagcttgggcaacagagtgagactccatcctccccacccccacaaaagaaaatttaaggagacattacaggtgatcttaaccagacctagggccattgagtaacttgcctaaagttcatttctgtgtagtgatagagctgggatctacaaaaattagccgggtgtggtggcgtgcacctgtagtcccagctactcaggaggctgaggcaggaggatcagttgagcctggaggtcgaggctgcagttagctgtgatcaggccactctactccagcctgggcaacagttagactctgagtgaaaaagaaaaaagtaggggggtgcgaggagagctggggccaaacccaaggctcctgggttttccataccactattgactgacaccagcatgtctctctgaaggaactcactttggcactcatatctcactatctcctgaatcctccttcacctcttccttgctagaggtacaccttctttcgtaccgctgcagcagaaaatgacagttcccataaccaagactatcccaggcagctcagggactctgtatttagaggagggagaaggaccacaggggactagatatatagatggccacaacttgtgatggttcaacttagtgatttttcaactttatggtggtgcaattgatacatgcagccagtagaaatcatttgtttttcatttttaatacagtattaagtagatgacatgagatattcaatactttattgtaaaataatttgtgttagaggattttaccaaaccataggctgatgtaagttccgagcagtttaaggtaagctaggctaagctatgctgttcagtagattaactgtgttaaatgcatttttgactgacgatattttcaatttatgatgggtttaccagaacatgaccccatcgtaagccgagaaacttccgtactgtgttaaaaactgtttgaggaacactggattaaatgatgcttccactgttctgctctccctgggaaagcggaggcagaacggtgaagcagagtgaggtcttgtttattccaggccccctgcctcggtgcacagaagatccgagagaaaagctgactgacagcagtaggtcatgaggatgccacttgtttagatttcaaatgcattccactctatgtctcacttaagaccagttgacagccatgtgttccgagcctgggctgcctctggtgaattttcctgagacagaagtgtcattggattctttcttgtgccaagtgtaggcaccactgcctcttttagaaactatgtggacactttgaactgtgctcttttaagccagtgccggaagaatggcattcgcagggcctggtaaactggggagaaactttctgatgtttttatgaaaggcatgttttgctctgaagtcaaagagtgtgtgttctggccaaagtagcaagcatagatctgctttttccacacgcaccaggcttcagaggagaagttgactagatagccagtgtctcattttgtttgtggtgggcatgggatggtgaaaacggaaggaggaagaagtacaggggacaagatatttagatggtccacaacttgcgatggttcaacttaatggtttttcagctatgatggtgtgaatggcatacatggccagtagaaatcattctgtttttcacttttagtacaggattaagtagatggtatgagaaatccaacttgatagccagtgtctcattttgcttatggtggacatgggagggtggtggtggggcggcgggggaaggagcacatagaaggaactctgcgtgcaatgttgtgagggcctcattgtcagggtttatgaatttctcgtttccttctttctaaactgtcatatcagaatgtaaagtttttaagaccaagaaacacctaaagatttatggtggaaacgtgcactaagccggggaactggttttcagtcctgtgctttctcttgtcctctccgtgtggcttcaggtgccagtcctgtttctgcccagcctctagccctgtagacagtcactggagtgcctggtgtatacccttggccaagtagacagtgtagtaaagcatggcccagagaggaggagccgaccatgtgacttcagtttccactggcagctgtccgccggatgtgcactgtgggcagggccagcctgagttgccgcaaatactgtggctttagtttatttgctgagcagggcttttttccttcttaactctgagcttcttggggataaggacaatgtcttattcatctttgtatcccttgaacccaacacaatgcttggcacaaagacagcgtccagtaagtgactgtgttattgtttagaatgaagaaatgttgaaggccacatatagcagatgccttacaggtttcgtcatctgcatagtggccccaagtacattttgggctgaggttaacgttggtctgggaggtattttatatcttacatgtgaaacttttttttaaagttcccctccatcctcatccaccagtgctgtggacagaatttggcagacagctagatggccactcagtagtgccctttatgtgagtgtccctgacaagggacagtatgaatcctggatccagtcaggattctttttcaataagcaaaaatgatctagcagattgaaattagactgggttatctgagcagttcggccctttattgaaaagtaaagaatttcagttgtagattttttttgttgttgccctctttaggatcacactgtgaattaaccttggagagaaagtgttttaaaaagaagaatggaataactgagcagatgctaatcctagaatacataccgctttaattattccaggaagtttcacagaaaagccagttttatttaaaatgtactgctaattaccagggaatcatcaccctcctaccggctgaggttagcaccggaacatgaaatgtttctacttggacctaaagtgaggcagcccttgcctgtcctgtctgaggaaaacttcactctgccaattgcttttgtgtcctgaatctcctctcctctttaataaaccatattttttcccctaaactctgttgttgttgtgtaaatcttttaaagttttttttgtttgtttgtcttttttattttttatttttgagatggagtctcgctctgtcgcccaggctggagtgcagtggcgtgatcttggctcactgcaatctctgcctctcttgttcaagcgattttcctgcctcaacctcctgagtagctgggattacaggcgcgcaccaccacgcctggctaatttttatatttttagtagagacgggatttcatcatgttggtcaggctggtctcgaactcctgacctcgcgatctgcctgcctcggcctcccaaagtgctggcaatacaggtgtgagccaccgcgcctggccaaagttgattttcttaatggaataaacattgatacaaactgttttgggggctggtgaatagacaaccaggaggacaatgatgagaaggaaagtgttcaaaagctgtcatttaatatgctaacatgcttttttaattttttaggataaggaagcctgtgtgggtaccaacaatcaaagctacatctgtgacacaggacactgctgtggacagtctcagtgctgcaactactactatgaactctggtgtaagtccttgcttgggtgcctctcagtatcccagggtcccagttactgcctctgcttagtgggaaactctgggcattagcccttttcggattctcttggggacagtgttggtgagtggaatctgtttatgggttccagaagtgcttcctttgtagaggaagagagttctggtgctctttggactttgttagctgaagactagagaatatggtcttagccaggtctgctgcagaagctcttgcctgaggttctcctggctgccctctccattgtgtgctgagcagctgacaacaacttagatgcttccttgggccctcccagaagcccaggtttgcctttctttttttttttgacggagtctcgctctgtcaccaggctggagtgcaggcgcaacctcagctcattgcagcctctgcctcccgagttcaactgattctcctccctcagcctcctgagtagctggtactacaggtgtgcaccaccatgcccaactaatttttgtatttttaggagagatggggtttcaccgtattggccaagatggtctcgatctgttgacctcgtgatctgcccgccttggcttcccaaagtgctgggattagaggcgtgagccaccacacctggctggcttgctgtttttgcagagagaggttgcaagccaagctactatgaatgccaggccactctagatggtcactatgccattttcttgtaaggaccacaggggcttccagaatttcccatagaacctcatggagtgcctctgtttctgagggtccttcggaaaggaacagtctttccctaggtccttgcctatagaggaccttctggagaaagggagtcttgaggctcagctccttttatttcttacccagttctcacatggaagttcctggaggattctccagtgtacctaaccttttactgtcagctaaatcccatgtggaggctgggcacagtagctcacgcttataatcccagcaccctgggaggccaaggcatgtggatcacttgagcccaagagttcaataccagcctggctaacatggtgaaaccccctctctactaaaaatacaaaaattatctgggcatggtggtgtgtgcctgcagtcccagctactcaggaggctgaggcaggagaatcacttgaacccgggaggcggaggttgcagtgagccgaggttgcgccactgcactccagcctgggcaacagagcgaggctccatctaaaaaaaaaaaaagaaaaatgccatgtggaaaccatctttgtcttgccactggtttgactgaagccagaaccacttgcttcttcaagttgcacgacagtggtgatggtgttagggtcttcagggagtgacccaaggttgcttcaactgacactctttgtactctgaccttcctggaactcagacgagacagtgtaggatgctggacaaagaatgagagggtgttgggggggtggtgcttaggacagcgaggccccaggtgactgacattgccgtagttcttacaattgtctcttgagaaaggagactgcaggcggtttccccagatgattctaagccctcatcactgcctccatttggaaacagacttcgggtttgtcaaaccatgaccttgcccccaccatcctatctgcgcctttcccctttctcatcccccccatcaacccctgtgtcagtgatatggcaagaaagcagccagaaggactattgtttggtccagaaaggaaattagactcttggctgggaggtctgtccatctgaaatgcagttgtatttgtagccaacaggagtggttcctccaaacaagacctctccctcaccctcgcttttcccttttgaggactgaggacgggctcatctgcctttctgaggaattccaggagcagtccagtgcaggagagcacaaggctcaagatgtccccaccagacctgcagatatataagcagcagtgaaggagggcacagtcattgttgctattttagaaggggtggggctgagaaacttactagaggacacacagtgccaagcaggtagacagactctgtttaaatgttttaaaatgcagataaccacagggttcaaattctccttcccaccctttgttaaaacaaaagttgaagctgggctgccaaaaagccacagagctgtagtttgtttttctgggtcctggccaggcggcatcagttgtgaaaaggaacgaagttgctcatggccccgtctcagattgacagagcctcctgggcttttggcagagccgactcaggagccacctgaattgggtcaccaaagccagggcaggggggtggagtggtggggacagggagacccagagggcaaggaggtagtctgggaaagcaggtgcctcaccccaagggcttaaagaaagtcagagaaagagctgcatgaacggctaagtgtctctctagctacgggcgtttaggaaaggaggcccagcagagagcagtgtctagacggagagaaaaggtgccccgttaaatgagctggcatgtgttttccacgttctggaggcatgggagacataaaagcaaaacgcccttctcaggaagtcctccgatctccctctttattgaggtcatggcttctgcctggtgtgtatgggagggaggttgatgttggaacaaacacctgaagttctcatcaaaatggcactttttgttgctttcaaccctgttccctctaactgcctctcaactttgcctgaagtgtgaaagtcacgggctttgggctgatttccttcccaccttcctttggaaagaaaattcctcagccaggaaatcctttggcagagttttcatcagacagggcaactccttaactatagttgcctacaggaaaggcctccgggaaaaaatgccatttctacccaccctttacctctactaaactgcattttcctgtgtgctgaggaaaattctcaattctcacacacatacttacacacacacacggtttacacagacacacaagcacacatagacctgagctctggccggcaacctttcccacatgtcttttcaatgtttcataacccaaaccagttattgggcctgcatgtgttgagaacggcagatcctgtttaataggggcagtagttgaggctattaaggacctgatcgttgttagtattatctccatgcatttttacggcacctgtactttaattcatcattccatcagttattcattcagcaaacccttattccagtgctcttgaactttagcaggcatcagaatttcctgaagggctaccgaaaacacacacttctgggccctactcccagagcttttgattcaaaactgagaatttaaaaacctgagaatgtgcaattgtaacaagttcctagttgatgctgtgacctcctctgggctggaaactggagagacagaattcttaccttcagaaggtaatccagcggggaggggataggatgtgcattggcccaaaccccaaagccactcctccctgttctcatcctggggctctctccactcagcaagctacattttccagggagagatcaaagttgggaatttctgcccttgagatcatttgggagaatttcacccaggcatcagtttcccctggtttgggctttaggagggagaggggtatgtttctggacagtggaatttccctgaagtgacacaaaacaggctattagcaaatcctgtcagtgctgcccaactcgtttttcattttttattctctctctttttttctttctctctctctttcctttccctccctcccatctccctcctcctctctcccctccctctccactcttcctctcccctccctccccacttttcctcccccctccctcccacccttccctacccttccccccacccccacccttcccccaccctgccacccctcccccaccttcccacccttccccccaccctcccctccccttcctccaccctcccctacccttcccccagcctttccctttcccccttccccctcctccttccaccttctccttccttccttccttccttccttccttcctctttttgtgtgtgtgagacaaggtttcactctatcacccaggctggagtgtagtggtatgatctttggtcactgcagccttaacctcctggactcaagggatcctcctgcctcagccacttaagtagctgggactatgagtatgtgccaccatgcccatctaatttttgtatttttttgtagagataaggtttcgccatgttgcccaagcttcgttttttacctgccgtttttttttgttttgtttttagtttgtcttaagatacccattgttagcaagagctcagtaaataggagttgattgaatttccagtgccaagaacagaacctaaaagcagactttggacttgttcctaacctgtgtttcttttttccttttctttcttgagacagcgtctcactccctcgcccaggctgaagtgcagtggcatgatctcgcttcccaggtccaagcgattctcccacctcagcctcccaaatagctggaattacaggtgtgcgccagcatgcccagctaatttttgtatttttagtagagatggggtttcaccatgttggccaggctggtctccaaattctgacctcaagtgatccacctgcctcagcctcccaaagtgctgggattacaggcatgagccaccacactgggccctgtgtttctttatggaatactttttgggggttaaaagggaaattgaaaggaaattttaaaggaaaccctgcccatctatggttaagcctgtaacaacaacaataaacacactaagaacttaccatacatcaggcatagttctgcgtatactacatatattaactcatttagtcctcacagtgaccagataagttagagacctttattctccccgttttacagatgagggaagtaaaaccaaaatgaccaaggtcacaaagctagaatatgtgtttttaagctgggctttgaacccaggccatctgccttttctcttccacgtctgcagtcatgcttgtaggaaagttggctgggctttcagaagaagttgcgagtctctgacgtcttcatttcccaaattcaggccttttccactgtggcagtggcaggagctcttgctgagagcaaggaagggccaggggagccagtcacccaccgtcctgcaggatgggaggagagctcacttacagtatgcttgagcctcctaatggggaatttcctgccagttgaagagtggtgttttcccaagtttgtagtgaactcttggggtttgtagtgtagtcatggggcacatgactcagttcctacactggactgtgattgtttttaaaaacatgttttccattttgcttagcatgacaaatgcaccccacagtgaactcacaattttcaaaacttgtctttgaggaatgtagtctcttggtaggtgtgtgtttgttggggaaaggagggtcatatttctgtctctggtgtgtcttttgttgggttttccttttttttttttttggaggcagggtcttgctctgtctgttgcccaggctggagtgcagtggcgctatcttggctcactgcaagctccgcctcccaggttcacgccattctcctgcctcagcctcccgagtggctgggactataggtgcctgccactacgcccagctaattttttgtatttttagtggagacgaggtttcactgtgttagctaggatggtctcctcgtgattcgcccgccttgtcctcccaaagtgctgggattctagccttgagccaccgcgcccagccaggttttccttttttttaaagttttcttctttgtgcttacttcagcagcacctatactaaaattggaatgatactgagattagtgtggccccggccaaggatagcaggcaaatttgtgaagcactccataaaaaaaagtaaaaaatgtaaaaatgaactttcttccttggttttgaaatctagctaaaagattaaaatttttcctaagttggccaggtgtggtgactcacacctgtaatcccagcactttgggaggctgaggtgggtggatcacttgaggtcaggagttcgagaccagcctggccaacatggtgaaatgccatctccactaaaaatacaaaattagctgggtgtggtggtgcatgcctgtagttccagctacttgggaggctgaggcaggagattcgtttgaacccgagaggcggaggttgcagtgagccgagatcacaccactccactccagcctgggtgacagagcaagaccctgtctcaaaaaaaaaaaaaaaaaagcccttttttttttaaaaaaaaaattatacttctggttcagtgaatctagcctttttctggatcaaggattcctttaaaaatctgatgaacactttaaattctctccccaagaaaaacttgtaatcacactgcagtagtcaggataggctaagttgtgccacaggaacaagcaagtccaaaatcctagtgacctaaaaacagcaggtttattcctcactcacactgtgtgtccatcgaaggttggatgagagttttgtttccacttcaccatcctctgggacccagactgatgtgaaatcaccatctgggatgttgccagttgccaaaacagaaggaagactaatggagggtctcatattagcaagacacattttggcctctaagtgacatatatcacatccaatctcaattcattagttagacttagtcccaaagcctcacccagtcacaagggggtcaggaagttcaagcctacccacatgcctagaaggagaagaagcagaaatacttggcaaacatgaaaaccaatgcatgagattttctttaaaacggggaaaacaaaacaaaacaaaacaaaacaaaaacaaccatgttggccaggtgtggtggctcatacctgtaatcctagcactttgggagccaaggtgggaggattacttgaagccaggagtttgagagcagcctgggcaacaaagtgagaccacccccctatatctacaaaaaatttaaaaattagccaggtgtggtgtgcacctgtagtcctagctactagagaggctaaagtgggctccttgagcccaggagttggaggctgtagtgagttctggtctctactgtactccagcctgggtgacagagtaatacctgtctcaaaaatttattttaattaaattttttaaaaaattgtaaaagctgtgaaatagatcatatatattgcagtataaaagttagaagttggtttacctttaggtagagaactattgaaaaaatgactggtggccaggtaaaaaactagtagagttagatgctggctatcttttttttttttagagatgggatctcgctgtgttacccaggctgacctcacaagaagcaatcctctcatctcagcctcccaagtagctaggattttagttgtgagccactgcgccaagcagatgctgattacctaacgggagaatgtacttttaaaattttaaagtttggccatctctggtatttcacacctgtaatcccagcactttgggaggctgaggcagggggattgcttgagaccagagtttgtttgagaccagcctgggcaaccttgtgagacctcatctcaacaacaacaacaacaaaattagtggggtgtggtggtgcatgcccgtagtcccagctactcaggaggccagagcgggaggatcacctgagcccaggagatcaaggctgcagtgagctgcgttcacaccactgcactctaccctgggtgacagtgagaccttgtctcttaaaaataagttaaaaaaaattggcctggcacggtggctcacacctgtaatcccagcactttgggaggctgaggcgggcggatcacttgagctcaggattttgagaccagcctggccaacatggtgaaaccctgtctctactaaaaatacaaaaaaaaaaaaaccaattagatgggtgtagtggcacgcacctgtagttgcagctgctgaggaggctgaggcacaagaatcacgtgagcctgggaggcggaggttgcagtgagctgagttcccttgccactccagcctaagcgacagaatgagaccctgtctcaaaaaataaataaataacaataaagtaaaaaaaaaaaaagttataaagtaacacagaagtataatggactgtgagattacactgagaaagtaagagaagtataggtaatacaaaatggttgtcagcccagaataatttagacttgactccgaaatacacatgcagccaggttcttaagcagagtgtccaccccaacaaccctaggagatgttatcaaactgcatctgtagccagtttcacctccataactcctttccagcctctccacccttctgcaagggttcctctgccagtgtctactcttaagtcagccagaattcataaagaaagaaacataagttaagcaagtttgactagtgaaccgggaaagaccaaaaaggagactgctaagttcactttatggtctctggttaggaatggattttcctgtctgctgatgggtaacagggaaaaaaatcctctgtctgttctcttgctgcaaggctgcagcatgaagctttggttgaacagcgatacccactgaaagcaattaagtgccgtggaatggtactgccagcctgccggggctggggggcatgtcactgtcctgccccacttggtggagggcagctttgtgaggagattcaatgggggcattccagggggacagagaaagagctgtcgccagatgccacaccctaaatgccaagggatcttttggaaaattgtgtatatacaaataagggggaaaaacatcaaggatttattcatttttacaagtctgttttgtgggggagggaggcatttttttctttttttaaacaaggttaacttgatttaactcattctgacaagagatacatgtggaactacttttaaaattttaaacacaaatttataattacaaagcagatgataaaaaatacacatagcatttggaatggaaaacaatggaagtttttcaagaatagagaacaaacaatattatctattctcatttagtaacaactcatcttaaaattattcctttgatacatttttagttgagaaaaaaatattctttttactacagagaagcacatgtccatcttagaaaaattaggaaatagaacaaaggagcaggtactgtctgtcatccagagttaccccatggttagagcttcctgaccatacccctcctttttctgtccatatatacttttttttttaagactgaatctcactcggttgccaggctggagtgcagtggcgtgatctcagctcactgcaacctcccctcctgggttcaagcgattctcagcctcccaagtagctgggactataggtgtgtgccaccatgcccagctaatttttgtatttatttttagtagagatggggtttcaccatgttggccaggatggtctcgatctcttgatgtcgtgatccgcccaccttggcctcccaaagtgctgggattacagggtgtgagcccctgcgcccagccatacgtactttttttaagcaaaagttaggatcatattttattttgtcatctgctttttttcatttaatatcagaaactctttgtatgtcaaaaataatattatgtgagtaattttttaatgattcatattatttcattgtatagccatattcctagaggaatttaaaaacctacccagaaattattgattaaaaaaaaaaagctagccaaagtaaaattagtcatagatatttttaaaatttaatttgttttggccgggcgcggtggctcacacctgtaatcctagcactttgggaggctgagacgtgaggatctcttgagcccagggttcaagaccagcctgggcaacacagggagaaagccaggcatggtggcatatgcttgtagtcccagctactcagaaggtggaggtgggaggacagcttgcgcccagaaggttgaggcttcggttgagctgtgatcgcaccactgtactccatcctgggtgacagagcaagaccctgtctcagaaaaaaagaaaattaatttgtttctagttttatattttgaaagaaaataatcaaaagaagaaaatttaaatttcttattctgtcatttaaagatgtcattatttttgttttcctttcagttctttccccctcgtgcgtatatgtgtatgtgtgttatgtgaaaagcaaaattcctcattaattaaaaaaaaaatttaaaagccttttgtgccacacatttaaaaattggagaggaggtcttatattggggtttgctgagattctctgagtatgatcccagagacagcacagagggaagtaaagagctgtggggcttggcctctgttccgccacccttccctggagcagggaggaagaagcggctgctaatggccctgcatctactgcaagggcaggccaaagggagggagagttgattgtggcagtgggagatggaattgtacccgattaggattatgtcgagagcagaggaaatcatttacactctctagggaggagatggacctgaggcaattagaatttttccacctctaactttagtgattcttgtattacagaggcatacatgatagagaaaagcacctgatttttttgatgctatcaggagaatcataagacttcttttgtcagggggcccctctgaggccccttgcaagtgctgatcttctgagttgcgggggaggggagatgggcactaagaaagtgaagcattttctcagaaatctcttaagagaggaggaggagaccatcccagaaggtctgcatatttaatgctcacaaaacctataatacggggggacccatcagtggtgctggagagatgccttggcacttgtgccttcccccaaggtgctggaggcgtcctggagtgagagacctgctttgctgtcatcattctgttttgttttgttttgttttgtgacggtgtcttgctcacccaggctggagtgcaatggtgcaatctcggctcactgcagcctccgcctcctgggttcaagcaattctcctgcctcagcctcctgagtagctgggattataggtgcatgccatcacgcctggctaatttttgtatttttagtagagacagggtttcaccatgttggccaggctggtcttgaactcctgacctcaggtgatctgcacgcctcggcctcccaaaatgctgggattacaggcatgagccactgcacccagccattcttttttttgagacagagtcttgctctgtcgcccaggctggagtgcagtggcgcaatcttggctcactacaacctctatctcctggttttaagtgattctcgtgcctcagcctcctgagtagctgggattacaggcgcctgccaccatacctggctgatttttgtatttttagtagagatgggggtttcaccatgttggccaggctggtctcgaactcctgacctcaagtgatccacccatcttggcctgggattacaggcatgagccaccacgcccggcctgttgtcatcattcttacattcctgcccacttctatcccatgtgtctttcactctggcacaagcatttatggaaattgatcacatggcttcaatgtaaattaactgggtgaggcccagccatgccagcttcaaccacgtgggcaccgtccagggacctccctgttccgcaagctgcccctctggctggtactcactgtgtgcctctctgtcttgccttgcccaccccccagggttctggctggtgtggaccatcatcatcatcctgagctgctgctgtgtttgccaccaccgccgagccaagcaccgccttcaggcccagcagcggcaacatgaaatcaacctgatcgcttaccgagaagcccacaattactcagcgctgccattttatttcagtacgtacacccaagcccccatacccaccctcaggagctcaggtgcacagacccagggctcacactgaatattggtggccaggctcctgtaggcatagggggtttgtcctctccctgcccctccgtagagcaaggtcttgaaagtacaggaacaaggggacactccttcagcacagaggagcatgtgctaggggtgcagttccctgaagccactgggccattccaaagctcacagtggctgggttctggctggatctctgcttctttagcacctgcgtacatacctacctacctaacttcctcccttcctccctcccttccttcctccctccctctttctctctttctttctttctttctttccctgcctgcctgcctttccatccctccctccctcccttcttttccttccttccttccctccttccttccttccctccttccttccttccttccttccttccttccttccttccatccatcctccctccctctctctctctctatttctttttttttttttttttttgagatggagtttctctcttgttgcccaggctggagtgcagtggcgcaatcttggctcactgcaacctctgctttccaggttcaagcgattctcccgcctcagcctccaaagtagctgggattacaggcatgcaccaccacacccagctaatttttgtgtttttagtagagacagggtttctccatgttggtcaggctggcctcgaactcctgacctcaagtgatctgctcgtctcggcctcccaaagtgctgggattacaggcgtgagccaccgtgcccctgccctccccttccctcccctcttttcctttccctcccctcccctccccttcctctttcttttcctttctctttcttacccttcctttctttcccttccttcttccctccctcccttcattcatccatctctctctctctctttaatggcagatagtcagataatagaacaataattattaacatttattgagcacttactatatgccaggtactgtgctaagcacctagtccttctagatgtggaattgaaacaattgtgggccgggctcagtggctcacaccgggctcggtggctcagcactttgggaggccgaggcgggcagatcatttgaggtcaggagtcagttataacgtgagtgaattgagacttggggttcattggcctgaattcctcccattttgcttatttctgtgtgatatgcctgagcagaggctgccatgaaaggggcgggttggggggtggcattgggacttctgagcaccaagaaacttagtgactctctgaagagcacttcccggacttccctggggctccttacatgtgacctctcatatggtcagtggaggcccagctgtgccagttttccaaagccagtctacagtgtattctacaaaataaactttcacaattgtttctttacaattgtttctttttttctttttaagacagaatctcgctctgtcacccaggcttgactgcagtggcgtgatcttggctcactgcaacctcctcctctggggttcaagtgattcttgtgcctgagcttcccaagtagctgggactacaagaccatgccatcacacctagctaatgtttgtatttttagtagagatggggttttaccatgttggtcaggctgttctcaaactcctgagctcaagtgatctgcccgcctcggcttcccacagtgctgagattacaggcgtaagccactgtgacccaccattatttcagttccacatctagaggggttaagtgcttagcacagtgcctggcatatagtaagtgctcaataaatgttagtaatgttatattataattaaattatctgtgtcataaggcattcagcacattcaaaagataactcacctagcatgtttttaataagccttggatggcagaggccccttaccctttgccggtcacccatctgctcctgatctgagtcaaggtgaagcttggtttgtgtttccagaccacctccagccacagtagagacaacagagatttctaaccccctagcaaaagaccctacatagtgcatttggaaggttaggaggaagaaaagtagttaagaagtctgaagttagggaccctggccctgaggcctgtgggacttggatgaaggacacactctaagcaagaacatgagacttgtgtgcatgtggaagtgggtccattccaggcagaagttattttttggccatctaccacgtttgcctaattctctgccttaactcccaacaggcgtgaagtccttgcctacgaagcagctttaggggctctcagatttcaagaagctaggttaggcccttcccaaactgcccctctctctctgcagaattgctcgcagctgtctctcctctgctcacaaccaagagctgtagccatcacttgttgggtgctctggggtgggaagagacaatgcaaatattcagtgggagctttgcagtctgcctagaacaatgaccagtgcagtaatttctccttcctacctccccattttagggtttttgccaaactatttactacctccttatgaggaagtggtgaaccgacctccaactcctcccccaccatacagtgccttccagctacagcagcagcagctgctgcctccacagtgtggccctgcaggtggcagtcccccgggcatcgatcccaccaggggatcccagggggcacagagcagccccttgtctgagcccagcagaagcagcacaagacccccaagcatcgctgaccctgatccctctgacctaccagttgaccgagcagccaccaaagccccagggatggagcccagtggctctgtggctggcctgggggagctggacccgggggccttcctggacaaagatgcagaatgtagggaggagctgctgaaagatgacagctctgaacacggcgcacccgacagcaaagagaagacgcctgggagacatcgccgcttcacaggtgactcgggcattgaagtgtgtgtgtgcaaccggggccaccatgacgatgacctcaaagagttcaacacactcatcgatgatgctctggatgggcccctggacttctgcgacagctgccatgtgcggccccctggtgatgaggaggaaggcctctgtcagtcctctgaggagcaggctcgagagcctgggcacccgcacctgccacggccgcccgcatgcctgctgctgaacaccatcaacgagcaggactctcccaactcccagagcagcagctcccccagctagagcaggtcctgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgctgttgagccagaagatgtctcgtgtgaaggctggggtggcggctgtcttggaacctctgtgagcaggaggccctaagccgcagcagtggatagaggtgcagctctctgcctctctgccctttggtctgtgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttttggtggcagttgtttgttttaaactgaccacttggaagaaacaccttggttatctgtggttttcatgccttgtccctgcctctacccccaccccttttgagtcgggtgactcatttttctgtgtagagactcggtggcccaggcaggaggtgaaagcagccatccggaaggccctggggacccttgtgcctgttgctcgccttcaggtcaccagctgagctgcgataggaaaatctgaatggaggcagcaaacagccaaaacaaacattccccacccggccctgtgcatatgaagtctttcttcccccaactcttgaacgatgatgatattcagacgaagcattgatgttatggaagaaagaaagaaacaaacaaaatatatatatatatgtccaaaaacagacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccacctttttttattttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaatgctactgctctttcttgctgcactttgttccctcttcttcttcctcagtcttcaggaaattgcacctcaagatcctaaaccacaagcacttttctccacacagagactgagaggttgtcacacagtcattgaggatagggccctgggccaaagagaaaccacagggccaagggcagctggacagtgctgctgggtccacactctgttctgaggagtcctcccctctctctgtcagggtgtgttcctgatgtttggaatactttggaaagtcccacaaacaggctaaaatcagatcccgagaaagcagagacaagttttgtcagataccctgttgctaaaacatggcttttttttgagacacagtctcactctgccgcccaggctggagtgcagtggcgcgatcttgtctcacgcagcctctgcctcccaggttcaagtgattctcctgcctcagcctcctgagtagctgggattacaggtgcctaccaccacgcccggctcatttttgtatttttagtagagacgaggtttcaccatgttggccaggctggtctcaaatctcctgacctcaggtgatccgcctgccttgagctcccaaagtgctgggataacaggccagccaccctggcctgggactataggcatgagccactgtgcccagctatttttttatttttattttttaaataacagagatgggctgggcgaggtggctcacgcctgtaatcccagcattttgggaggccaagctaggcagatcacttgagctcaggagtttgagaccagtctgggtaacatggcaaaacaccatctctacaaaaaatacaaaacttggctgggtgtggtgctgtgtgcctgtggtcccagctatgtgggaggctgaggtgggaggatggcttgagcccaggaagtggaggctgtagtgagctgagatcacaccactgcactccagcctgggcaacagagcgagaccctgtatcaaaaaaaaaaaaaaaaaaaaagaaaaaaactatatgtatgtatatatatatatatatagagagagagagatagggtctgactgtgttgcccaggctgggctcaagtgatcctatagagtctaactatgttgcccaggctgggctcaagtgatcgtactggcttggtttcccaaagtgctgggattacaggtgtaagtcactgtgcccggccaaaacatggcatttaaaagaaagcaagcactctgagagatcttttttgttgatatgatagacatgggggtatatgcttggccttggaatttaacacacagtataatgtatcgagttgcccactttctgcccagcactgtgtcagaggctcaggataatgtcaaagacatagaagatgaggcctctgccctccagaacttacagtcagaaagacaaaacatggccgagcatggtggctcatgcctgtaatcccagcactttgggaggctgaggcgggtggattacctgaggttaggagttcgagaccagcctgaccaacatggagaaaccccgtctctactaaaaatattaaaaaattagccaggtgtggtggcatgcgactgtaatcccagctacttgggagcctgaggcaggagaatcgctttaactcgggaagtggaggttgtggtgagctgagatcgcaccattgcgctccagcctggacaacaagagcgaaactccatctcaaaaaaaaaaaaaaaaaaacatacttgtgtgaaatagttaattaacaatataagttaagtttgaggtgaagtgaatggtacagatttggagcttttcagggaatagtgggaggtagtttgaggtcttgaatgccaagcaagaggtctcggagctgattttaggtagtgaggaagccaccagtgtgccagaatctgtcattgtgggccaatgattctttcctaatacaaggagagttcctttgttcattttaccatctgcttaagactgacctcttaggtgtaagtgctttttttttttttttttgagatggagtctcgctctgtcgcccaggctggagtgcagtcgtgccatttttgctcagtgcaacctccacctcctgggttcaagtaattctcctgcctcagcctcccaagtagctgggattacaggtgcctgccatgacgcccagcttatttttgtatttttagtaaggatggggtttcaccatgttgcccagactggtctcgaactcctggcctcaagtgatccacctgcctcagcctcccaaagtcctgggattacaggcgtgaaccactgtgcctggccaggtataagtccttgtttgaagaacagcttgctacttctctgcccagggaggacacccctacccagcaagactgcagatgggcaaagcaaggtagtacacatcctaggaaccctccaggaaggggttcctgcctccataagtggagtgctcactggtgggctggcacccagggggtgctggcaagtgagtgttgtcctccctaggccctggcttgcccagcagtcagcgctgttttttctgaaggccagttttagccagacatgccgccacccctgtctttgaccctctggcagaggacattcctggcctctcggtgacactagtggagtggttgctgacttgttctttctaaactgttgggttccttcaggcaaccccagtagggccatgctagcatctagagacagttctgttctaaaaccacgggaaagaactgggagtatatcattcttgcctttgagctaatatctgagtggcacaaaaacaaaatggtgtaactcttaggggctggttgccagaggctgtgcatgtaccctgggtgcccaggtctagaggggacaccatgccattgaaccccaggctggtgggtcactgagttcctcatttctgtaatgaagtatgacgttgtttgtctctgttgccccatgtgaccaagtgcagatggcgacagtaccaacgcccagaactgcaaaacagagtacttttggtgaacaagaatttcaagaaactccacattcttcagtttcctgttttcagccaggggcgaaaaccggggtttgactcggaaaaggagggagaagtgggtttggttggtagcttcttgctgaacctgctgggaagggttgtgggtcttgggaggatttgggttctggcctgggggcaagtgtggcctcactgaagagctgagcctttactgagcacctagcaggtgccaaggcatgagaattcaaagatgccttaggactggctcctttcctttttttgagacagagtcttgctctggagtgcagtggtgcgatctcggctcactataacctccgcctcccaggttcaagcgattctcctgtcttagcctcctgagtaactgggattacagatgtgcaccacgacgcctggctaatttttgtatttggggtagagacggggtttcaccatgttggccaggctggtctcaaactcctgacctcaagtgatctgcctgtctcagcctcccaaagtgctgggattacaggtgtggagccaccacgcctggccctggctcctctttagaagagctaatggtattctcgagaggaaggcaggcacatcggcagttttagtaccacatggaaagcaccacgaagcatgtgtgcacagaggagaatctagccaaactaggggattaaggcaggcttcctggaggagatacctctaaattgagtttatcaggtgaagaaaggtgcaagggaattctaggcaaatgttttttctgcagactattgagtgcttactatgtgcctggtgctgaaaagcacaaaaaagcatgggaggcctagaatgggagactctgcatggcatgtagaaagctgcgagcaatttatcactgcattctgggaagtagcaagagatcaaactggagagagaagcaggttgttttattttattttatattatttattttaattttattttattttattttattttattttattttattttattttaattttttgagagggggtcttgctctgtcacccaggctggagtgcagtggtgcaatcttggcttacggcaacctccgccccccgggttgaagtgattctcctgccttagcctcctgagtagctggaattataggcgcacaccaccatgcctggctaattttcatatttttagtagagatggggttttgctatgttgcccaggctggtctcaaactcctgagctcaaatgatccttctgcctcagcctcccgaagtgctgggattacaagcgtgagccactgcacctagcaaaatattttaatttaatttgtctttattgttttgttggttgacggtttccacaatgccagtcttgtgtgagcatcttagctacatttaaaaaaaaaaattagcctcaggccgggcacggtggctcacacctgtaatcctagcactttgggaggccgaggtgggcggatcacctgaggtcgggagttcgagaccagcctgaccaacacagagaaaccccgtctctactaaaaatacgaaattagccaggtgtggtggtgcatgcctgtagtcccagctactcaggaggctgaggcaggagaatcgcttgaacccggggggctcaggttgcagtgagccgagatcacgccattgtactccagcctgggtaacaagagcgaaactccatctcaaaaaaataaaaaaatgtagcctcaaaacaggtctctgaggtatataggctgcaattattcctgctttattaatgggattgtggcatccagaggacttaactaactttataagatcacatagctaataagtggcagagctaggatttgaagccaggtctaatggctccaaggccaatgtaataaccagaaggcaggacagtgaagagctgtaatgtaggtactcacaagccacctgaagaacttgtgacttcttcctctctctcttctcttctcttttggcccaggctggagtgcagtggcacaatctcagctcactgcagcctcaacttcccaggctcaagtgatcttcccacttcatcctccccaagcaggtgagactacaggcgcacaccgtcatgcccagctaatttctgtattttttgtagagacaggattttgccatgttgcctaggctgctcttgaactcctgggctcaagcgatccacctgccttggcctcccaaagtgctgggattacaggcatgagccttgtaatttcttttcaaaggtgagggagaactagagaacaatatattgagctaagagtaacatggtgaaagatgaaacagacaccatttcctcaggagctaccctatctcctcttgctccagggggcagacccccccacacccagccaggcttcacctccaagagcaattcagtgctaaaatggcgtcacccctgggacaggtgatgctgcttgccaccagtattcggaccaatgtcaacttccagggacggtgtaaccccttggaaacactgtaaaattctcaggagttacagtttggatcttctttgtctcttttccttgaaagagtgtttttgttcttcctccaaggtgatgaaagtacagctttctgtgtttgtgaggggagaagaggatttttgtttgacctgaaatttctcctcactctgttttgtttgtttttggcttttttttcttcctttgagatggagttttgctcttgtcgcccaggctggagtgcagtagcgcaatcttggctcactgcaatctccgcctcccgggttcaagtgattctcctgtctcagcctctcaagtagctgggattaacaagcacccaccaacacacctggctaattttttgtatttttagtagagacgaggtttcgccacgttgggcaggctggtcttgaactcctgacctcaggtgatccgcccgcctcggcctcccaaagtgctgagattacgggcatgagccaccacacctggcctctccttactctgttataagcctgttcctcaccatagcttcagattcccttcatttcatgttttttcaccaagaaggctcaagaaacccaatcccacagaaactgtgacggaacacctgtgctggagccgtgagtttgtctttgggttctccacccgctgcccggcagtccatcagccctggctctgcggggacggagtgggcaggtggcaggccaggggctgtagtgggccctgcagggatggaacggggagggtgggttccccagggttccatcctgcggagggactcatctgcacacacccgctccccctcctgaccaaactggtggcttttggggaggtttgtataaaaccctgagaaggactcatttcgtgggtttggatatagacaacgacgagaaacccaatatttatcaaggcactaaatgtatttcataggttcacatttcatcctcacagtaacgctatgacacaaacatcccagttccctaccacccgcccccgccatattacagatgggaaaaccaaggcttaaggccacctaaggtgtccatggccacgcagtctgtaaatgacaacactgggaggatttgtctctgcaacctgacttcgagtcatttgcattcccgtctgtgtgggactctcctgcccacacactcttttctgcctctcatcctcaccagagcctcggaagatgggcagcgcaggtgttaggttcccccacattatccatggggaaattgaggctcaggaagttagtgatgggcctaagatccagggtcaggaaacgggagctggggcagagcaccggggtggtctgggtccaatttatccgttgcgcttcccaccccactgcacggcctctgtgactggatccccaccctccagagaagggcgctaacatctacgagtgtgactgcagagagggctcctcatttgcctcaggttttgtggccaccagaggctgatagaacattcactcactctcaccctcccacaatagggaaggatttccctcctgtcaacaaggagactcaggggaactgcttttctttctcttttttcttttttttttttttgagacaagttcttgctatgtcacccaggctggagcgcagtggcgcactcactgccagccttgacctcctgggttcaatgtgatcctcccacttcagcctcccaagtaactgggaccagctgggaccacaggtatgtgccactacacctggctaattttttgtatttttttgtagtgatggggttttaccatgttgcccagctggtctggaactccagagctcaagagatccacccaccttgacttcccaaagtggtgggattacaaagtgctggtgtggtgagccactgtccccagcccaggaactccttttcgttttttgtttgtctgttttgagacggagtcttgttctgtctcacaggctggagtgcagtggcacaatctcggctcactgcaacctccacctagttctagtgattctcctgcctcagcctcccgagtagctgggactacaggtgcacgccaccacaccccgctaatttttgtatttttagtagagacggggtttcaccaagttggccaggctggtctcaaactcctgacctcaggtgatccacctgcctcggcctcccaaagtgctgagattacaggcatgagccacttcgcccagccaggaactgcttttctttaagacaagcgtggcccatttctcctgggagggttggctcttaatagctcactagaactgatttttaaattttcaggaattttatgagctgtttatatgaaacagccaatttaaaaaacttaaacctacaattgagttatattaaaaacaaaggtaatagatactcaaaactgatcatttcctagttattttactacatgttactgttatctgtgcccttgaggttatttacatttacctatcagtatggtggaaatactacataatggcatttactatgtaataataacaacggtaaagaacatataatgctactatgtgtctctttccaaccctgtttactggcatcacattggtagtttaaaattggtcacgttgggagtatctacaccacagtaatcagcaaacattacaaatcaaggctattccgcacacccccgcccctcccagacctggttgttaaacatttatttatcatcacatcactggttaaggacagtctgaggctcagacggttaactgtggggtcttggcaaagaccttccagttttgtcaaagatctgggcttccttctgcataaggagatagaatttatttactatcattgggccaattaaccaagtgatttagagcatttgattcagtcctcttgaggtaggaggcggggctcggacatggaaccaaattaaggactagctaaaacaggtaggggggcagaagcagctttccatgacatgcctgccagtgtgccatgtcagtttaccattgccatggcaaaacctaggagttaccatcccttttcgtggcaacgacctgatgacctggaagttactaccctcatcctggaaatctctgcataatccaccccttaatttgcatataattaaaagtagatgtccatatgagtgcagccctgcccctgcgttgctcttctgggcacactgcctctgggtagccctgctccacaaggagcagtacctctgctgctctgtgcactgcggcttgctggctaccaccactgctgcttgctggaattctttctgggtgaagccatgaaccctcctgggctaagccccaattttagggcttgcctgtcctgcatcactcttgtttgtctacccttctatttgtcaggtgctgatatgcaggataaagaacatgagaaggctcagtcttgaactccagaggtacaggaggtggacagtgtctgtggggggccccacccatttcaagtccaggcagatgctcagatgccaaggttcagtttaggttcagtaccaaggaacagaagctgagtgctgaagagggatggtcatggtggactcaggagtcataaaaaatgtgtctgagcctcaaggcaggtgggtttagatcagtggtgaaaaggccttccagacgggagagcacagtttgggcaggagtcaaagttcataaagtcattttctaaaaggtcactccgcttgcctgaaaggtactctcccggccaaatatcccaagagcccttctgcatgaccacaggggacaggtgggaaagcatggctggctccccaccatgcaccattgaaatcttgagttctggtcccagccctgctgctacgtagctgtgtgatctggggcaagtcataccctatacccagcccacacaatggccct

SEQ ID NO: 494 - DNA, 27892 bp, Homo sapiens
cctctcaaccccacatccaccactaccccactcctttcatcctgggtcccaaggacagcagtttcaggctcgctgccaaccccaccacagccagcagcctgatccctgcgctgcctgtcccgatccaaggccaggctgtggcgtcagcgtaagcgtcccgcgccctcggccctggctactgtcctcaccggcacccggtccgggtatttctttcggatcttctcgccctcagagcggcgcttctcgaacggatgctcttctttgtacacgaacttcatcctcccgggaaccgggctggacagggctgggctgagggaacccaggggggccgggacggggggcggcgacgacggcggcgacgcgcgggcggattcagcggagcgatccacgaatttgcgccacttccctattcaccaaccccgcccccgactatcggggactgccccccccgctaagatacgccactacctcagcggcgctaacgctgctagcgtagcaccaccaactgaccggccccctcacgccattagcgtaatcgctttggaatcaatttgtgggctacgcaggcgacgtagcaaagacggttggcttttgctcatcgaaaattactctaaacctattccccaaccgtcccctcaaggaagctggggctgaagaggagtaaaagatggtaatcatcatacgagacttggttctccaagttcctttcgttaacaacgtagaggaacagcagggacaattacaaggttagctattcacgaaccgtgttgctacgctgaaggcggccgttgacaccaaaacaaagtagtacccaagtggcggagatgatctccagaaataagaagtcaaaaagaaaacagatgtttggagagatctacagaacgcttaagtgccaaaatgagtagaccaatagggactggagaggaggttggaaaggtagggactacgccagcgcggaggaacactgcgggacttgagttaaatcatgtgatctcaaagagggcggagcgtcacgtggcgggtgcgcgaagtagggccggcttgggagggcgccggggaggcggggccggctgggcgacagctgggagggggaccgacgccttcccggacagcggaggtcggggcgccagccacctgggggcagcgcccgcttaacctgtccacgtcagtgccccggacgaagcccggtttctccagctctacgccctttggccgtccaggtttctcctttcgtgcttccatagccggtttctcctttcgtgcttccatagcctgcttctccgaaggtgtccttccactccccaccagcgcgcccatcctgtcactcggcccttcccgccaaagcatctggtgtcagcattattgtatcccaggcatctggtgtccgcattattctatccctatactcaacgccacctttccccctgccccttgagtccaacagcagtctcttccccctctgcctgtgggacagggtgcatgtgaacaaagtcccctctcttcacttcccaaaaccccagagaaggacctaaggccgctttggtttcaaagttataatgcatggtttaaaagagagaaaaggaaaaaagacacaaagctggttacaggtctgagggagtctaaggagagaaaaatagagggagagtaaaggggggacaaatttagggaaaatccagtggcccaaaatcccagtatcccacccacagcccagcccttggagcaggagtgaagaattagatcagttttgtacaagagttttttaaaaaaaatcaaatcacaacaaagctgacttggcttctctttgagcctcctggatcaccgtatgtctgtcactctggccagtcctgcctcttcacaaacactgattcggctctcctaggcttccgcctgtgtcccagtctggggtttccatggagtgtgaacacgaagttaagagtgaggctgcttcagagcccctggcccatgtgtccatccagactccaagtggagtgtagggctcccagggcagagaggggtgggaggggcagaccctgcccaggcagtcctcacattggacagggcatcagacggcatcccaagggctcgccctccctttcccccccaccccaactcaggtggagggggagcagctgtcaccagagccgatgttggtgaaggtttcggctcagcacggaacgaacatcagcggtgaacctggggtgacaataacttgcattggtagagtaccttatagttcataccctcacaacactcttgtaaggcagcatcactggagatgtgggacctaaattatcaccatattcatgattagataggttcaatttgcccacagcctactagctaaagtgatgagctttgaagtaagacgacctgggtccaaatgttaaattcttaagggaacagagttaaaacaggacaaaccttttttattccctctgaggatcccccacctcctcctttcttgagatatccaagtgtccagagcccacttcccttacctgagggcatccagcattgggagcaggttgagaagggctgtgtcgctggggtcactgaaccaggatttgatggggatggcattgtctagggtgggtgaaaatgcagatgagaagaaacagaattcaagagagacggtgtttttctcttcttggagggaaggaggaattattgttaaaaatatatgcctcccactaccggaagtcaacaacctaagtaaaactttcctggtttatgctccgaaactaagttttaatcaccagatctcatacctattgatgcttctagtcaagcttactgccattgtgcctcacttgaaacacacttggccaggcgcagtggctcacacctgttatcccaacactttgagaggccgaggtgggaggatcacttgagctcaggagtttgagtccagcctgggcaacataatgagatcccttctctactaaaaatcaaaaaattggccaagggcagtggcttacgcctgtaatcccagcactttgggaggccaaagcggacgaatcacgaggtcaggaattcaagaccagcctggccaacgtggtgaaactccgtcgctactaaaaatacaaaaaattagctgcgcgtggtggcaggtgcctgtgatcccagctacttgggaggctgaggcaggagaattgcttgaacctggaagtcggaggttgcagtaagccgagatcacgccactgcattccagcctgggtgacagtgcgagactctgtctcaaaaaaaaataaaaaataaaaaaattagctgggcatggtggtgcacgcctgtagtcccaactactgagaggctgaggcagaaggatcacttgagcctgggagatcgaggctgcagtgagctatgatcatgacactgcactccagcctgggaacagagtgagaccctatctcaaaaaataaataaaaataaattttatttttatttatttattatttattttttttgagacggcgtctcgctctgtcacccaggctggagtgcaatggtgcaatctcggctcactgcaacctccgcctcccgggttcaagcgattctcctgcctcagcctcccgagttgctgggattacaggcgtgcgccaccacgcctggctagttttttctatttttagtagagatggggtttcaccatgtttgttaggctggtctcgaacttctgacctcgtgatccgcctgcctcggcctcccaaagtgctgggattacaagcataatccaccgtgcccagccaaaaataaattttaaaaatgaaaaaaatgatataagaaatccgacttatgaaatggacatatatggtatctcatttgaaacacaaaaataacttgcatttcgacttacagcaaactagggataatctagggaatcccagctctcaaggaccaaagcccaggtctcctgcaaaaataccttctcagaaccatgttctggtcctgccagactcaccaccttcccccgtacctggatggctcctgtaagcccctggggagttatccaggatcacaatgctggagaggtcactgtggaccacagagaggtccttgatgtagctgcccaactccaaagtgcagtgctggaaggcaggggatcatgtagcaggcctctctccaggatactctcctcaaacccagatccctccctggtggcctccctcccaagccacactcttagactgggattctagcttacctgtctgtaatatctcctcttaagaatgcttctgctattgtccagtttatctgccacagcagagccatagatctccatgcttgctgtaaacaccaccagctcgtaccactggctcacctgaaatagattgggggagagggcgatgccatacaaggtgatgattcctttagacatacagttatctttcagaaaggcaatggcatagtccttcaggccttccatcaacatcaaatgtctctgaggacacgaaattctgaacccccagcccaaacctccaaactcagtgttaggcatcctacactcttatgattcagaaatgcaagaacaaaagagaaagatgccagcggaaaagaattacatcagcacaacaaatgaaccccaagtactgaaagccactcccctaccattacacagcctcccctctagaaaactgctctaacccgtttctcctcaccccttcctccaaatcctcccaattcccagagccctaaaaccattccttcattacagagctccctttagctctccaaaactcaccacttccaggaagaaatccacatggggcctcttatgtacaaaaaaccggacaggatgtttgtctattaccacctacagaggaacaagatgggctgggggatgtcatgaccaccacaacccaggcctagaaaacgccccacccatctgcttccctcctccaggctgacactggtgccagcggatggagacagatgctctgggactgggaaagggagtccaggtttgggcagaggaacagatggaaccatttcatcactccccaccaccacacaccttgaggatgaagtcaggaggcgtaccaggccggactgtgggcctcaggaccccatcatggtgggagtgaataagtgtctcatccagatccagcaccaggatcttcctcttcacctgggctgaaccagagtggggaggaataatattgaccgacctctgacccagagctagcccctacttcaccctaaaggaggcttcccaccacatacttacctagccgattccgggacacaggagataaggggaggatatcatatcgaacagtttggtactgaattacctacaaatagcacaaaagaggattgaaacccttgataaggaagccttccccagtaacagtaacagggagcacataatgaacatttaccacaggtactatgtatgtaatttaggcttatttcttcttcttttttttttttttttgagatggagtctcgctctgttgcccaggctggagtgcagcggcatgatctcggctcactgcaacctccgcctcccaggttcaagcaattctcctgcctcagcctccctaatagctgggactacaggcgtgcaccaccacgctcggctcatttttgtatttctagtagaggcggggtttaactatattggcctggctggtctcaaactcctgaccttgtgatcctcctgcctttgcctcccaaagtgctgggattacaggaatgagccactacgctggcctttttcatttaatcctcaaaacaaccataatattactgttatacctgttttaaggttaaagaaactgaggccacacagctaggaattatcttaagttgtttctctccctaattaaaatgaaaactccatgagaatatgattttgtctagatcatggctgtattcccagtgcctagaacacagtagcaaaagtggtcagttgatattagtagaatcagccaggcgcagtggctcatgcctgtaatcccagcactttgggaggccaaggcaggcggatcacaaggtcaagagacggagaccatcctggccaacatggtgaaaccccgtctctactaaaaatataaaaattagctgggcgtggtggtgcgtgcccatagccccagctactcgggaggctgaggcagcagagtggcttgaacccaggaggcagaggttgcagtgagccgagatcgcaccactgtactccagcctggtgacagagcaagactccgtcgcaaaaaaaaaaaaaaaaaaaaaaaaaaaagtagaatcaatgaagtgatagagccaggattgtaccaatgcagttcaacccaagaacgtgccctctttttttttcttttttttttttttgagaagggagtctcactccattgcccaggctggagtgcagtggcgcgatctcagctcactgcaacctccacctcccaggttcaagcaattctcctgcctcagcctcctaagcagctgggactataggcgcgcgaaccacgcccagctaatttttgtatttttagtagagacggggtttcaccatattggccaggctggtcttgagctcctgacctcatgatccacctgcctcagcttcccaaagtgctgggattacaggcaagagccaccacccccggccgaagctgccctcttaactgtgatattatcctgctacactgaacaaagaaacgacccccacaacgcaaccttcaccccaagaattatttgtagcaactaccatcattgggaactaagtgcctcagattccctagtgcacatggagtaggagtcgggaggagatccctgggtccttaatgggaatatagaatgagggaatccagaggttgtcaggtcagctaagttcctctggctagaagccaccaggcctattttaaccagccacctgtccacttctgtcccttctagccaagtcacaagttcagagaacctcagccctctgaacagtctccttatcctggtacccagggtgaggcaaagaacactggaaagcccctgccaggctgactggcagggtctggaggaggccagagtgaagtcagggccgttaagtgagaggtgaataagggacaaggacgtcaccacctcatccagctctgcttctccaagcattctctaggggctatttcctaatacgcacatctccccatacaaagcctggcaattccctcttccacacttttcttcaaaggtacaaaccctcttcagtgcatacctaggccccaagccacaccagaaccaggttctcccttctaaacccacagggctctctccccctaatcaagatctgcccttcttttctccctgggccatgatgaggtccgaaagagctccagtgtccagccttgctatctcgggttgcatatgctgggcatgtagggaatgctccaagcatctgccagaagcggggtggggaaagaaaccagattggaagggaagggaggacaaaaggctatggggtcagtgctgcccaaaggagagcaattttggaagtaacctgtggatgagctgaagcaccactccgtatgcccagaaaactgatgtgttggagcgagaacgtcagagaagatggcagtcaacccataaagaaaaccgctggaggccgggtgcagtggctcaatcccagtacttttgtgaggccaaggcgggcagatcacttgaggtcaggagtttgagaccatcctggccaacatggtgaaaacccgtttctactaaaattacaaaaattagccaggtgtggtggcaggtgcctgtaatcccagctattcgagaggctgaagcaggagaatcgcttgaacccaggaagtggaggttgcagtgagcggagatggcaccactgcactccagcctgggcgacaaagcgagactgtctcagaaaagaaaagaaaaccccaggagatagccccacacatatcccagcatctctgaccctaaatttttcttggctcctagctcttgtctcgggggaatagcgctgctgcctacagccacaaccatcctgtactgttcgcgccctaaatcaggaagtggaagcagactggtaaaggacagaatgaacccaaggccagacccattctcccaaatcagttaaatcaaccaccactaccactgagggctttctggaaattctctggaccccaggtcaccccaacctgggtttattctttcaaattgtattgaggtatgctaaggggtacagaccacagtacagacccagaacctgtgtctccgcttactaaattctccccagactccttccgaggattctccctggtggtggtgagaccacaagagcacattcatttaaagtgctgttagctgaaggacctctgaccttggagaaaagctaagggagaggggacccagagatgcttgggtccatccggacagtttccctcagaatgctaggctctcctggagaagcaaacgtcctcattttcaagccctacaactgcccagcgctgtcctctgacagggacacccaaacttcaatggtgggcacagcacccaccttgaactccctcccacaattaaagaggcccatcgtaaaagcatctgctttagtcttcaataaatccagatacctacactcacactatgaaataaattttcacagcctttttggaggaattctcttaatgggaaccgcaggcgtttctccttcacacccagggctttcccaagttcccgtccttgtttgtaacgtatgccctcccacccacctccacccttgacacacaagtctgtctcttccttgttataggaccaaacacacaccgaggttccaaatagggtctttcccaagcccacatccacagatccggctgtcatcaaacaggtgttccccgcctcttggtttctttagcaacaactccagctttcttaaagagcgccccacccaccaccttagcccccaagagttgccaaatcctgtcccatctagccccatcaaaacccccaagggcaaggttctattacaagggtctcccacctcgccccgcttagggtgcccaattctctggcgagaaaagccccagccaggattcccttcctaggcccaaacagaggcccgacactccgaaaacccctgagcaccacggacagatgtccccaacaccgccagacgtccccaacaccgccagcgcccaccctggctcaccgtgcggatctgcctccgcagaaggtaaatgaagaagctccagagcttggcggcgaaggccacgaacgtgcgcagccccagcagacactgcgtccgcatcatcccgatgaccccggcaccgccggccccggggcccccgcggcccagctccgccagccccccgggggcagccccccgccgccgggagggggaacgggggccccgagtggcaggagaggctgcagagaggggcacggagcgggcggctcagaaagccacccctggcgagggtaaagcccagcggaacggggagctgggggacaggcgtgggcagcccgcgggggcccacatgggctgggagtggcaccgacggcttcggggaggttgcgggccgagacaggtagggctaggatggggtcctccgagacctggagggaaggggaaggataattgggggagggggcagtgggggagggggctagggaaaagggaggaagggaaaagggaaggggagggggggaaagcagagagtggcccgctgcgcaggcgcgctagggggctgctcgcaggaacggggagggcgggggcagcggcgcgcaaagggccgcggcagcggagaacgggcctgcagagcgaaggagcagggaaggagggggagggggagccggagggcgcagagcgctgggccggagcggcctccccctccccgagctcgggggtcctttagccgctggggaccggggctgcagcctctgcagctgggtttcccactctgacaggcgccattttaccgtccaaaggactccctcttcctgtctttccccctcctcttcccctttgacactacttccggtggtgacgtgtattcgcttcaccgggactaagttcctcctgcgcggtctatggcgggtaggtataaggaaagccaaaagcactccaagcgaggctgcagtattgcgcacgcgcagaaggtggccgcggggcggggcctgaggcgaagcaggccccgcctcaaactgcgtgggcggggagagtgacgtcacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccagggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcggggtgagagccagaggcacggtggcggggcggggggtgcggttcgggcctggctgaggggacggaagtgggcaggaagggccaggggtcacaggctaggtgtggaaatcgcgacgggttcgcgaaggcggtaatcccagcgctctcataccctttatccgtccctcgctctgcagattccgtggagtgggaggggcgcagtctcttgaaggcgcttgtcaagaaatctgcactgtggtgagtatcccacagtgtctccccggcctaccctggatagggcacctgtgcccactctttgacaatcccttctcatctctgccttagtggggagcaagtgcatatcctgggctgtgaagtgagcgaggaagagtttcgtgaaggttttgactctgatatcaacaatcggtaagtaccagttggaagagatttgattaaatttgagacctataatgctaaggaaatttctttacaacaagcgcagaacctggtatgtagtagcagttccttaaatattcattgaagaattggatatggatctttcaggaggcaagaattaataagaggagtgatgagtatttggggagtccaaagcaaagatcatagaagtcgagagagaaatagcctggaaatagggagaacatgtgggaagggtattgcagtaatccgttaatccggcttcactctttaaggtacatatgtaccgagcaccaactatcaaccaggtgctgtgcaagatactggagacggcagtgagtgagacctgttcctgacctaatgaattttagggaataatggtaggaagtgatagaggcctggtttaaggcagtggcagtagagatggaaagtttagaacacatgtaaaggactttagtgggtagaatttccaggatttattgactaatatgggggagaagaaagtattgagataaggaagttcctaaacccagcggcatgcctgatcaggagacattaagaaccattagtaggatgctttctacttcctagtcccggcaactcagtggatgataatagtagtttacatcttatctgttgagcctccaattttgcatcagccattgttgtgatagaggcggtggtgtatgttcagatggcattccatggctgggcgcggtggctcacgcctgtaatcccagcactttgggaggctgaggcgggtggatcacctgaggtctggagttcgagaccagcctgaccaacatggagaaaccccatctctactaaaaatacaaaaaattacctgggcatggtggcacatgcctgtaattccagctactcaggaggctgaggcaggagaatcgcttgaacccaggaggcagaggttgcagtgagcggagatcacgccattgcactccagcctgggcaacgagcgaaactctgtctcaaaaaaaaaaaaaaaagcgggcactccacaagagaagatagaaaagagatatctgggaaaaaaagttctgctacctatgccagtctccctttcctgagctgttttttctgtagttgttacttcttgacttaattcttgactttctttaagctgttctacaggcaggaccaaatctcacgtcctctgctttctcttttttcacccagggtgataatctttaggtgccacacacaggaaatatttgataatggtgataactaacatttatcaggcatatactatgtgtcaagcactgtgctgaatgcttagaggttggcatctcatttcaccaatgaggcaactcttagaaataatgtatcagttagctgaccttgggcaagtagcaaagccaagcttggagatcaggctgtcagacaccaaagtctgtgctctcaatcactgtatgctctctctcagtaattatctttcactaatatttaggatattcataaaaattgagaaaacagccataaagatcagaggatgaactttgtgatcctctcgggggaaggggcaatattatattgtgtcttattttccctttgcaggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgagacccctccttcattgtttcccctcatacatctccctctgccaaggagtgtgccccttttcctttctaccctagaataaacatctgggttctccagtcagaccttttttcatttttttgacttttttgtctgtttttttttttttttacttctccttaatgccatctaccatttgcttttttttctccaagttatttttttactcatttgtttcactcattcattcatttaacaaatcaatagtaaatatatacaatgtgtcaggtacaattctagataatggcaaaatacagactgactgtagctgggtccttgccttccaggagctcgaagtcccataaaagatggagataagtaaacaggcagttacaagatggtctgataaaggccatgatgatacaggcatgcacagggcaccttaaagaagggcactcttggccgggcgcggtggctcactcctgtaatcctagcactttgggaggccgaggtgggtagatcacaaggtcaggagatcgagaccatcctggctaacatggtgaaaccccgtctctactaaaaatacaaaaaaaaattagccgggcttggtggcgggcacctctagtcccagctacccgggaggctgaggcaggagaatggcgtgaacccgggaggtggagcttgcagtgagctgagatgggccactgcactccagcctgggcgacagagcaagactccatctcaaaaaaaaaaaaaggcactctcttgaagagcaagaggtcatccaggcaaatttggccgggcaggggcactgagactagccttgaagtgcactgtgggtactcgaatggacttaggagtcagacgcccagctttgtattaaggtgcttgatctctcattgcttcactttcccctgtatatgggggaaggtacaagggaagtattaggatgaaccactatattgccatttcttaggttaaaagttgttaaatattgtctgggcgcagtggctcatgcctgtaatcccagcacttggggaggccaaggcgggcggatcacctggagttggagaccagcctggccaacatggtgaaaccctgtctctactaaaaatacaaaaaattagctgggtgtggtggtgcacgcctgtaatcccagctactcgggaggctgaggcaggagaatcacttgaacccaggaggcagaggttgcagtgagctgagatcacgccaccgtactgcagcctgggtgacagagaaagacgtcatctcaaaaaaataaaaacagtccgggcgcagaggctcatgcctgtaatcccagcattttgggaggccaagacaggtagatcacgaggtcaggagttcaagaccagcctggccaagatgctgaaaccccgtctctaccaaatacaaaaattagccaggcgtggtggcacgcgcctgtagtcccagctactcaggagactgaggcagtattgttgagcccgtagcaggggttgcagtaagccaagattgcgccactgcactctagcctgggcgacagagcaagactccatctcgaaaaagaaaagaaaaaaaaattgttaaatgtcagtgatttcatacagtttgacctaaaaacgctgacctttgtaaggattcaaacattgtgttaaagcgtttagcatagtacctgacactctctaaatgctcccaaaaagggaggcagagaattgaaggcactgactgagatcttgggaagttccagaaactacaagtacttccgtgtgtaagagatgaggctggaaagtaagtggacaccacctgctggaagcgttcgttccatcctgaaggcaggagctgctgaagaatagaagttagagcggtgccttgatcagctttacattgggatgatagaggagattaaggtgtgggctggaggaggctcagagcacggtagtgagattggccaagggacgtcaggattttggcagcactgtgatggaattgtgaggctctctcttcttcactgttagctcccaggccaccaacctgaatgctccctactatcctacatttcttgtcctcctctaggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccaggtcagaagaaccaacagagaaggactggaaacgggggacagagaaaggggtggcacgatgggaagaacaatgaaaatgctgatgtttcaaggagactttaaaaacaaacttttttagagatggggtttcactgtgttggtcagggtggtctcaaacttctgggctcaagtgatccttccacctcagcctcccaaagtgctaggattacagacgtgagccactgtgcccagccctcagtgagacctttttttaaaaaaagctgatttaggtatttctctgttttctatcactcacttcatttaatcctctcagctatggttaaggtagattgttttattatcaccatttttcaggctggaaagccagtccagggagggttttattcccttggagtttttttttttttttttattggacaaggtctcactgttgcccaggctggagtgctgtggtgcaatcataacttacggcagctttgacctcccatgttcaagtgatcctcctgcctcagcctctggtgtagctggaggtgggagcacaggcatgtagcaccacatccagccagctttttagttttttatacagatgagatctcaccctgttgcccaggctggtcttgaataactaggctcaagccatcctctggccttggtctcccaaagtgctgggattacaggtgtgatccactgcacccggcccaaggaggtttaaatttaagtcacttaccaaggttataaagtgtaagtggggcccaggcgaggtggctcaggcccataatcccagcactttggggggccgaggtgggcagattgtgaggtcaggagttcgagaccggcctggctaacatggtgaaatctcatctctactaaaaatacaaaaattagctgggcatagtggtgggtgcctgtagtcccagctattcgggaggctgaggtgggagaatcacttgaacctgggaggcggaggttgaggtgagccgagatcatgccactacactccagcctgggcaacagagtgagactccgtctcaaaaaaggagtaagtgggctgctctgcctaaggagtcgccatccttttattcctttacttccttaatcaacttgctttcacttttgaaaataaaatagaggctgggcgcagtggcttacacctgtaatcccagcattttgggaggccgaagtgggcagatcacctgaggttagtggtttgagaccagcctggccaatatagcaaaaccccatctctactaaaaagacaaaaattagctgggtgtggtagcacgtgcctgtaatcccagctactcgggaggctgaggcaggagaatcacttgaacctgggaggcggaggttgcagtgagctaagatcacgccactgtactccagcctgggcaacaaagccagaccctgtctcaaaaaaaaaaaaaaaagttgagggcaggagctgaaagcagtcagttaaataggtgattgggggctgaggatgtgaggtcctggagtctgtctagtttcttcagtaagatgaaaaaaactcttttcttttttctctccagactcagtggttctccatccttccggacttcagcctggatctccaagaggggccctctgtagagtcccagccctactccgatcctcatatacccccggtatctaagaatgccaaggccagaacaaggaaatgtagtttagtatctggtcacgggagagaaaataaaagctgcagaggttgggggtggggtcagggattctagggatggggcagagtggcagcatcctttgtacctacaggtggatcccacaactcatttgacctttaaccttcacctgtccaagaaagagagagaagccagagatagcctgatcctgcccttccagttcagttctgaaaagtaaggttgggacctgggtacgtggatccctgagtagatcccagcatctgggccatggagaggttggggcaacaggttattgattaacctgactttatagggactgaagtccacctccagagacaagtccaagttcttgatccacccattccccctataatggcagaggacctttatgtctcttttctctcccttatacccttgggtcacagctccagttgtccccagagcaccctgggcctgggctgagccagaccagacccttgggaggtggccctatccctaggcagtggtgctaggaggacagaaggctatatgggcgtggcagaggctggttaacaagggcttagtacacgcttgctgttctgtgcccagtatgtgggcggatgacgcaagactacaagatccttgccctcaagctgctaggaacttacggttttattaggagagcagtacaagggtatctatcccagtaccaaatggtgcttcagctctaacatggaggtcagagaaagggacttggaccaataaaatgacatggaggcctaacaggttgcctgaatgagagtcacagtcacctggaagaaagtatccagacccaacctgttagctaccctcaccagcaccaaatcttcccttctcagacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaagaagtactttggtagctatttaaataagaggggggtgggaatgaatgtcgagatacgagcacctgcatcttttagtcaattgtcagtggagtcagtggggtgctaagtgttctgaactgaagtaggtgcactaaggttccaagctccctgcaaggatctggacgggaggaaagcagaggccctgaagggaaaaaagcctgcttcccaatacttattttttattactgtacaaaaagcacactctccctctttttgtctctcccaccaacggcacccccccacccccaacccaagaggactatacatggagtgcagggacagagtgaccaggaggcctttgtccggcaccctgcccacaggctgagctcagccccaggccctttcaggcatctagacactcccatagcctgtcaggctggggcaaggagatcccaggtcacacatactccttggaagagttggacttagggtaagagcggggtacacggtacccagccttgctctcattcccaggacaggaacaggagagcagtgcacctcccaggatgactagggcagaccctgcccagccaataaagatggcagggccaaactcatacctgtgaagagaagggggtggttagaaaccctggcgtgcctctgccctcctccctattccaggaccccagacctgtccccttaggaggcagggttcccagacttacttaatgttggtagggatcaaagggttataaaagtctgtgacaatctgatggccataccaggagcaagctaccaaggcggcaagacctggagacagaatgagggtttcagtatagtgaggccccaaatgggcgccttgcccagccttgctcctcccagatgggagaacccgggggctcacctgccacgatgaaaattatgcctccacccatggctatacgggccttcttcactttgtcgtctcccccacagcgcgtgcacttcatgcccatcgtggccacaaacatggccaggaagcccagcaccagggagaccaccattagggctcgagtggcctgcaaggccgctgcgggcgaggggaaagggcgccgtcattgctggaaatgcaggcggctccagccttcgtgccgccggccgcgcccactaaccgctggacctcttctgtccggcgccgtgttctgccgagggccaggggcgcccaggtgtccaagacctgggccaagcgggcaggtccccgcccctcccgacagcgcggccttcctgctcccgccccgccctctccgctcaaggatccgcccggggcgccggggtttcggtgaaactgccctggatagggggaagggtgaaagggtgcagcgaagagaagccgagacggtggtccgaagccccgcgcggcgcacatgccagccggcgtccctgctctgagcccgctatcgaggccaccgggtttgtggcttcggctaatcggccgataagattagaggcagcaggcggcggcccactctgaccagccgcaccgcccttcggccctcggcgcgccccgtgccccgcgccccggggccgtttctgtctgagaaaaggacgggagatgacggaggccatggcctgcccgggaatggaggaggggatggccccggcctaagcaccgctgctccgagccggggacgaggctgggttgggggaggaagaggaacgtgggcgaccgaggtgcgcgcccacgtgcagccgccggaaccccggcccgctcccgcccagccccgccgcccccagccgaccacttcctcgccctgcagctccccggcaacccagggcccccagccgtggggcctcggctctcccacgcgcgccaccccgccacctcggtcaagggcgcgtccgccccgtcggtcccgcggccttaccggacagggcgagcaccgagtcgtacattttgcagctcatcatccccgtgctctgcgtgacgcagtccatccacagccccttgtacatggcctgggccgtgatgatgttgtcacccgcataggagctcatctgccactgcgggatggcggtgcaggccaccagacccacccagcccagcagggccatggagaagcccagcaactgcaggcccgaattggccatttccgccctcagaaaacactgggggcgccgggcggggagaccctacagtaaaacaaacgacacttggggggcagccccacaaaagaaaacttgaggtggagttttccggtcacccaaagagacaaaaagggtttgggccaggtgaatgcaaatcttgtcaccaaactacacacaaatcgacccctccagtgaagcgatggcctcgcggcacagggagtaggatacgccgggagggtggttccagacaaaattggtggtccccgaaggccaggcggttccctccgggcgctctcggcgaccctaggcaaacaaaaggtggaggggccgtctgggcgcgtttctgagcgccggcaagtcccaaagtatcctgggctgtaggtccgaggctgcggtgcgcagcagaggtggctcggaggtgagccagcaggtgcgggcggacaggtggggcgcacctgagtatatgtagggcgtcgggggcgcggcccgcgcgccccgggagcgcgggagggggaggcgggaccggaggggcggccgaggatgacctgacgtcaccgaagggacactcacctgaaccggaagtcgtggcccccacccctccttgcccaggtgaggaggaagaaacctgagcaccagggtcacgccccttcgcttgcccggttttgaccgccgctggggaggaggcggtggctccccaggagtcccaagctccgagtcagcccctccggactggatttccctcgaacaccgggaagccccttcctttcttcccaacaggtgcgcctgggacgctgcggggcgcccctgacaagcctcggcgccgccctttccccgccgggttctgtccaaagtgctctctcctcggccctgctttcgcccccacccgctgctctccttttttttcctgtctcctaccctggtcgatcccaccttcgggggccctggctcgatccctgagagtcgcccccttcagcaccctcttcagtgtcccggttctctggctctgctacagacacccggcttagcgtggctccccaacagccccaccttcctgtgcccccattccaacccaacatgacttacagcctgaaccctttgcactcaacctccccacctaccactgtcccctccggcatcaaggctcctaactggaggaagaaaccactgggacctaaagccggccgagggtggggagcagggtgagggctaggtcagagtcttggccacacccatcgttcccctcccttagagtcttttcagacctatcctccacctttcccacccctcccccacactcgcccgtttctctttccctcccgggcctgggcttggactgccaattgctgtgcactctgtcacgcctcactgttccgtcctccctataatctggctctctaaggtggtcgtccatggtccctcaccctgcagtcctgctatctctccccaaagcattgctccctccttcctcccggcaccccttccagccttttgctccttcctccttcatctttggtcatctccccttcctgcctttcctgctttggagcttcctgtttcactccttgtcttttttttgttgttgtttgagaggaggaagtctgtgttacccaggctggagtgcagaggtgcaatctcggctcactgcagcctcgcctcctgggctcaagcgatcaccccgcctcagcgtccccagtagctgggaccgcgggtgcacaccaccacgcccagctaaagtttttgtatttttggtagagaagggttttcaccatgttgctcaggctggtcttgaacacttgaactgaagcaatccccctgcccccacctcctaaagtgcaggattacaggcgtgagccaccgcacccagcccactccttgtcttttcgtttacctttgcgccttgtctccagtctccttggaacccagcatcagcaattaatctttctttcctcttcttaggtgcacactgcactttccccacccaccctgcccagtttcctcccaatcttcctactaccctccaacctcctcatacttctcagattctcacataccctgcttattctggctctctctcatttcattttcctctctccattttttacctcaactctctcacgttttttatctttgttttgccctctcaaacatttctctgtctttccttcgtttattcgctaaacatattaaagtcccccttatgctaagctaattgacctgcttttgtataaaatgaagactttcatgaactctttttttttttttttgaaacagagtttttgctcttgtcgcccagactggagtgcaatggcatgatctcggctcactacaacctccacctcctgggttcaagtgattctcctgcctcagcctcccaagtagctgggagtataggtgcccaccaccacgcccagctaatttttgtatttttagtagagacggggtttcaccgtgttagccaggcagatctcgaattcctgacctcaggtgatcccaacccacctcgacctcccaaagtgctgggattacaggcgtgagtcactgctcccagccatgaactgtttgttattcgtttttattgttgtacttttggattaatggtacttttctggattaatgtactcttagaggccgggtctcactctgtcgcccaggctagagtgcagtggtacaattatagctcactgcagccttgaactcctgggctcaaagcatgcccccccaccccccaacaaatagctgcaattacagccacgtgtcatcattgttctggctttgtttgttttttgaaacagagtctcgctctgtcacccaagctggagtgcagtggcacgatctcggctcactgcaacctctgcctcccgggttcaagcaattctcctgcctcaccctcccgagtagctgggattataagcgcgcaccaccacgcccagctaattttttgtatttttagtagaaacgaggtttcaccatgttggccaggctgggctcaaattcctgacctcaagtgatctccctgcctcagcctcccaaagtggtgggattacaggagtgagctaccgcaactgactttccttttttttttttttttttttttttttttttttttttgagacggagtctttctctgtcgcccaggctggagtgcaatggcacgatctcagctcactgcaacctccgcctcccgggttcaggccattctcctgcctcagcctcctgagtagctgagactacaggcacccgccaccacgcccggctaatttttttgtatttttttagtagaggcggggtttcaccgtgttagccaggatggtctcgatctcctgaccttgtgatccgcccgccttggccttccaaagtgctgagattacaggcgtgagccactgcgcccaggctggagtgcaatggcacaatctcagctcactgcaacctctgcctcccaagttcaagcaattctcctacctcaacctcccaagtagctgggattacaggcatgtaccacgacacccggctaactttttgtatttagttgagatggggtttcaccatgttggtcaggtcggtctcgaactcctgacctcaggtgatccacctgcttcggcctcccaaagtgctgggattaccggtgtgagccactgcgcctggccccgacctttttttttttttttttttttccgatggtgagattttctttttttctttttaattttattttattttgagacgtaatcttgctctattgcctaggctggagtgcagtggtgcgatctcggctcactgcaacctccgcctcccgggttcaagcaattctcctgcctcggtctcttaaatagctgggattacaggcgcgcaccaccacacccagctaatttttgtatttttagtagagatggggtttcaccatgttggtcagactggtctcaaactcctgacatcgggatccgcccgcctcggcctcccaaagtgctgggattacaggcctgagccaccacccccggcctttttttttattatgttaaaagactagtcagatgcagtagtgagaaagcagtgagagtggaaaaagaagttccgtctgtaactgactgtgaacaatcaattgaaataattcactaccttcagaccagctgagattttcttgaaaattttccttttagctctaaaagaaaatatttgtcatcacttaactatatccagcttctctccaaactcactgccgccacgccacaccagcccaagactggacacagcaactgcctccaaaccaatctcccttccacactggtcattttaaactctattctctggagtgaccacttcttactcactcagagctttgtcatttcctgtttaaaatctttcagttggccgggtgcggtggctcacgcctgtaatcccagcactttgggaggctgaggcgggcggatcacgaggtcaggagatcgagaccatggtgaaaccccgtctctactaaaaatacaaaaaaaaaaaaaaaaaattagccgggtgtggtggtgggcacctgtagtcccagcttctcgtgaggctgaggcaggagaatggcgtgaacctgggaggcggagcttgcagtgagctgagatcgcgccactgcactccagcctgggcgacagagcaagacactgtctcaaaaaaaaaaaaaagaaataaaataaaataaaatctttcagtgacactcgtgttcttcccagtaagtgtcacaccatggctgacctgactgcctcagccacactggccttctctgttcctgcccactgaattgcctttgtacagtctgttctctgggtctggaagctcttctccatccactcccacccaccttcctctatccagctaaccaactaatccttcagctatccctcaaatagcacttcttttagaaagcctggcctgaccaccccaccccaaactgagtcagatcatctgcatagtgctctcacggctaccagtactttgctttcaaagctcttatcacagtttgaaaatactgtatttactttatgtacttatttattcaatgtcaatatccccactatactgtatgctccaagagggtagagatgtgtctggattttatcaccaataaatatttgaggaatgaatgaataaattgcaaataaacaatattttcattcactgttcaacaaatattttcttttttcttttttcttttttttttttgagacagagtcttgctctgtcacccaggctggaaggcagtggcacgatcttggctcatcacaacctctgcctctcaggttcaagcgattcttgtgcctcagcttcccaagtagctagggttacaggcacggaccaccatgcccagctaattttttaaatatttttggtagagatggggtttcaccatgttggccaggctagtctcgaactcctgacctcaggtgatccgcccaccttggcctcccaaaattctaggattacaggtgcgagccaccacacccagccctcaacaaatattttctaagtgtctataatgtgccagacatggccaggcacagtggttatgtctgtagtcccagctactcaggaagctgaggtgagaagatcacttaagcccataagttcgaggctgcagtgagctatgatcatgccactgcactccagtctgggcaacagagggagatcctgtctcttaaaaaaaaaaaatggtgcggccaggtgtggtggcttatgcctgtaatcgcagccctttgggaggcagaggcaggaggatcacgaggtcaggagttcgagaccagtctagccaacatggtgaaaccccatctctactagaaatacaaaaaattagctgggtgtggtggcaggggcctgtaatcccagctactcgggaggctgaagcaggagaatcgctttaacctgggaggcagaggttgcagtgagccgagactgcatcactgtacttcagcctgggcaacagagcaagactctgtctcaaaaaaaaaaaagggggggagaccaagcatgttggctcatgcctgtaatcccagcactttgggaggctgaggcggggggatcacgaggtcaggagtttgagaccagcctggccaacatggtgaaaccccgtctctaccaaaggtacaaaaaattagccgggcgtggtggcacgcgcctgtagtcccagcaactctggagactgaggcaagagaatcccttgaacccgggaggcggaggttgtgaggttgcagtgagccaagatcgcgccattgcactccagcctgggcaacaggctgtctcaataatttaaaaaaaaaaaaaaagaaaggctgggtgcagtggctcacacctgtaattccagcactttgggaggccgaggtgggtggatcgcctgaggtcaggagttcgagaccagcctggccaacatggtgaaaccccgtctctacttaaaatacaaaaattagctgggtgtggtggcaggtgcctgtaatcccagctactcgggaggctgaagcaggagaattgcttgaatccaggaggcggaggttgcaatgagccgagatcgcgtcattgcactccagcctgagggacaagagtgagacttcgtctgaaaaaaaaaaaaaagaccaggcactatagttgaccctggagatacagcaggaagcaaactggataaggatactgaactcatgctacttattttctagaaggaagaagcagacaataaagacataaacaaaacggtgcatgttttgaaagcaataaagcagtgtaatctgatgaggtcgaatctactctaggatgaggttagagagaactttttgaggaaatgactgctaaataatatgccagtggccaggcacaatggctcatgcttgtaatcccagcactttgggaggctgaggcaggtgggtcacccgaggtcaggagttcaagaccagcctggccaacatggtgaaaacccgtctctactaaaaatatttttaaaaattagccgagcatgatggtgtgtgcctgtaatcccagctactcgggaggctgagacaggagaatcgcttgaaactgggaggcagaggttgcagtgtgccaagatcatgccactgcactccagcctgggcaacaagagtaaaactccatctcaaacaaacaaaaaataataatagtaagccacgagggaaccatattataggcagaaggaacagcaagggcaaagggcaaaggcctgctgttgattgcccctttgagactcacagtaattaatttaaagcagaatttctcaaccttgacactgttgacattttctcccctgctatctcttgggctagataattttttgttgtcccatgcattataggatatttaggagcatctctgacttctatcaattagatgtaccctcccctgtacctaagtgtgacaaaaaatgtctccagacgttgccaaatgtcccagggaggagaggagtaaaatgggtcccagtaaagcgtgactggtgagcatcatcatggatttttttcctctaatagccttgaagtaactagttggataaaaggatccaagtaggggccgggcgtggtggttcacacctataatcccagcactttgggaggctgaggtgggcggatcacctgaggtcaggaattcgagaccagcctgaccaacatggagaaacccggtctgtactaaaaatacaaaactaatcaggtgtggtggcatgtgcctgtaatcccagctactcgggaggctgaagcaggagaatcacttgaacctaggaggtggaggttgcagtgagccgaggtcgcaccattgtactgtagcctgggcaacaagactgaaactccttcaaaaaaagagaaaaaatgggatccaagtacatgaatagttgaaattaactagggttgggtgttactaaaaagaggaagaaggaattttat

SEQ ID NO: 495 - DNA, 266437 bp, Homo sapiens
gtttatagactattagggaaggcagacggtataaaagcaaagggtattaaaaaggagaagaaaggatgaggcatcctgtgaacacacaaagagggaactagccaacaatgcttccagttccagaacagttaagctgaaacctgaaaagatgactaggattagctaggtagctattaaaataggtggaggtagagattgatagaagagggagagagcaaagtcttaaggtgagagcatgcaaagcactgaagcattgagagaagaccaatatggctggagaacagagagaagtggaaatgcaggtagatgtcagaacatacaagaccttgtggatcatattaaagattttaggaatttatccaaaggtcaatgggaagcctttttttttttttttttttttttttcctgagacggagtcttgctctgttgcccaggctggagtgcagtggcacaatctccactcacctcaacttccgcctcctgggtccaatcaattctcctgcctcggcctcccgagtagctgagattacaggcatgcaccaccatgcccggctaattttgtatttttagtagagatgggttttctccatgttagtcaggttggtctcgaactccccatctcaggtgatccacctgccttggcctcccaaagtgctgggttacaggcatgagggaagccataatttaagcattaaaagtgatatacagatttgctcttttaaaaaggaggctgttgcaatagcttggacaacaggtgatactggtttaaaaaatggagaataatgatggtttttagaaatatctagatggtataatggcaaaattagtggccgggcatggtggctcacgcctgtaatcccagaactttgggaggctgaggcaggtggatcacctgaggtcgggagtttgagaccagcctgaccaacatggagaaaccccatctctactaaaaatacaaaattagcccagcgtgatggtgcatccctataatcccagctactcgggaggctgagaattgcttgaacccgggaggtggaggttgcagtgagctgagattgtgccattgtactccagcctgggcaacaagagtgaaactctgtctcaaaaaaagaaagaaaaaaggcaaaattaataattgatatggtatggatggtggaaaaggagtagtcaacgatgactctcagatttctgccttgaaccactggttagctggtagggttatttactgagttgaggaacaccaaaggaggagatggtttgggaatgaagatgataagtccagatttgcgtatgcagagtttgaggtgccagtgaaatattcaggttaggtaggctattgggtatgagggtctgaagctacagattgaagagctttaggtatatccattgtaagaaagccataggagtaaatacatttacctcaggaaaaactcaaagtgggaagagaagtgtacattcaacagaaccctggaaaacattgaatggtccataaagatgtgtcaaaaatgggtaagaatgagctactagtgaggtaaaaagaaaatcagaaaggcgtgatgtccacaaagtcaagggaagaaagcatttcaaagaaggaatgtcaggtaaaatgggaaataaaaattgataaccttactgaaagccatttttttgaggaatggcagacagaaaatccagattgatgagcttgaagagtaggtggaaggtgaaaaagtaaagacggggtctggaagcaacactttcacaggcttgaccgggaagaagagagaggagagagcattagagctggagaaggatgtggatgaaggactaaggaggatttttctttcttttttaaaaaatttctctctctctcttttgaatgagaaatacttcagtgtgtttaagtgctgaatagaaacaattattaaagagaaagatattggaaacatgaaaaatgtgctacaggtgcaaagacccctgaagaagaccagggctccaaagcaaagtggagttgtcctgtctttcattggagaagggcttcttccctctctgtaccaggagagaacaaggaaagaggggacaggtgcaagtaaggggtgtgaagttgaagtagtttccacttgacagcttttaatctttcaaaaatagttgctcaataaatatttattgagttgatgaatgaatacaagcaaataacatgactctgaaatctgcacacttccctcttttcctccggaagcattctattgtctagagaagcttggggatgacagtgaaggtgagcaagattcagagtacttttaggaagaggaagaaggatgtttccaaatcaaacaataaggatactaaaatcttgctccaaatggaaatcagcatggaatagccgctgtgttggataaggtgaaagcaaaatggctggctatctgttctatacaggtctgttctgatctatgctttaaaaaaaatccttttcaatttctagaagtttcaagtcacaaacttgcactttgaggggacaacatggaactctcacctattgaacccttactatttgccaataactgtggtgagtacctttcatttaatcctcatatcaacttcattaagttaacattgtctccgttttaagcttgtggaaacagagcttcagagaaggtaaatgtgacaaggtcattcaaccaataagtggttgaaataggattcaaacccagctctgccttcagttgctcttaactatgatgctatatttccatgaaattttaataactctcatcactacaaatactctttatgacacaactcttgcataaattgttccctgacataccatgggcattattcttgtaatattttccactcttcaatattcaacttttatatcttttaatgtcctacttaaatcttatctttgtaaactatcacaagaacaaaaaaccaaacaccgcatattctcactcataggtgggaattgaacaatgaaaacacatggacacaggaaggggaacatcacactctggggactgttgtggggtggggggaggggggagggatagcactgggagatatacctaatgctagatgacgagttagtgggtgcagcgcaccagtatgtcacatgtatacatatgtaactaacctgcacattgtgcacatgtaccctaaaacttaaagtataataataataataataataataaaaatcttatctttgtccaaaacacttaaggacatctcaaaccatgatggtttctctggcttttgaaaacctgcaacaatttgcctgtattacccatttgatatattttatctgcattataaaattgaatttgggtttatttaacctttcttttgattatgagttaatgctacaattctacaagcttcttaggggataggaagtgcattttgtgcctttttggggggatggggtgggcatcttttacagcttcttcctactgccttgattcatacatagtatgtagtcagtaaatatttgttgctagattgccagacggtcaatcttggcattgatattggctgactgtctttgggagctacctgcaactacttcagaaagtttcttgttggagtcaatatgaaaaatggaggatttattatttctactgtgaatttattttttctttttgggtgataaaactggaaatctcaaaaagtctcctggtttatgtgttgggcatagatgagggagattccttttgaaagtgagtgtagaaaagcagactttttattttgtgaaggttttttgaagcttacaagtccttatatatatattttaaaagtccagattgctcaaacttgaagttcccctcctccttgctcctccttcagggcctttttctaaacctacttcccttaaaatgacttttattgattttcactcaatgagagttattcttcagaatgaggatggaagggtcagagagagaaatttaccctgtgttacctgtggaataggtgtgcatttgtatccagtcttgctttatttgttctgtttcctgtatccagaaacccacacactggggatcattaggtcctctgtgtcttggtcggagcttgagtacagtatactaatagatcaatttatgtgttcattcattcagcaaacatttattgagcaggcatgtcctaggcattggagatactaagatgaataagacatagtcactgccctcagtgacctccagatgtacaagaagacaccagcctgaaggcagctggggtcagggaacaaggcaactgaatatcctccatcaggaaatcctaagagaataaaaagaccagtcttgtaacataaatataaacatctaatcaaattagccaattagaaaaacatttttaagaaaaggcaatcttttaccaatttgtcctatgtatcttttgcattttttctccctaatttctttgtctccagtcttactcgtctccagtctacatttaaaattgcctccaattttatttttctaaaccctgatctgatcatgtcattcctgttttgagaattttcactcattcattctgcactttttatcaatcacctactggatgtttccagtgagtgtgaagtgtttgggatgcagtggtacgcaagcaggccctaccttcaagaagctttagaatctagaccaggtagtactttctgaatcttgtccttttatctaaatcagttgagtccgacagacaccagtatctgttgtgctaagtaccacgcaaaacaactaagacagaattctgctttaagcagatcagagtctattagaggaatctgaaaacaatcgataattccagtacaatgtgataaatgaatagatgcatgcatagactgctatgataatcagatttgaggagaagagaggctggtgggcagggtggcttcctggaagagtccatcccaaacaaagtcttgaagtataaataggagttggctagacactgggagtgtccagttagttccttaatgtgacaaacaagatctttcacagtccattaatctatttttccagtctccccttatatcttctacatcttttttttcagctcccagcccaatttctgaatgtttttcaaattaggaatgaatgcccctggtttatttagtgttgtgctttggatgtgagaaagcaccaaataaatgtggtgcatctttctggagcatcagttctatcaaatgataagtaatttaaaacatggttttatattaaagcttaatatatttgtggaattgaaggcaaaattttcattcatttttcaagataaaacaggatacataaatttcaagctagtggcaagccattttaggcttgcccttagacatcaccacctgcaccacctctttcttgaggaaaaatttgagatgtactatcggaatgtggcaggaaatttcatgtgcctttgcatacgctatttgctcatcctggagtgctcttcctatttttctcccttgataaactacttatccttcaaagcccaacttaagtgtcattccatataacagtcatttttaacgaagcttaaatgtcatcccatatgatagttattttttaaaacacccacttctgtctctgcctcctttcctaatagctccaggcagactcagcacctccttcttttgtgtttctaccaccctatactcagaatatccattatagcactgctttcattgtgccatatgtatttgctttccaatccatctctgctgttggactataaacctctctagggcaggcactattatttatctttctattcttagtgactggcacttggtagacactcaataaatgtttgttgaatttgtggaccattccttactctgcatcacctctgttcttatataaagtgatatctcctttacttctcatcttcagggaatgatgtgttacacaaaagtatattttccagacaactgaaatttacttcttaaagtatcaaaatcttctgtttaaatcattttggtaggaatttatttttctatattttcacacgtgtgcttactctcataagtaaaatatactaagtgtaatgtgttccttgatgacctatccccaaaagtatcaggatatgtttggttggaattcatgacatccgctgggagcactgatgggatagggctttttgccttcacaccaaataaccctattttgttgtagtttttgagttatggtgcttgcttcttatagttcggtcaccatttctcattgtcagtgttcttgctctaacaacactaccctttgctctttttatatacgttttaacggatattaaaattacaaaactaatatatgttcactgaaaacaaacagaagtctatggagtaaaaagtcaaagtcctcccttcattcctgtctaaccccccaccctgtcacgtccacactttcactccctagccataaccattgttaacggtttaatgtatccctacaggcctttttctgtcaatgtgtgtgtacacgtatacggacaaatatcaaatcatattgtacatactgttgtatgacttgcttttctcactcgacagtatataataggtatccttctatgtcaatacatcctagtctatatcattctttttaatggctgcccccttttaatttgacaatcttaatcagctgtgaatgggaaagccaaataatcaagcttattagaattgtacctaagaaagaataaatcggctctgaatgaaggcttgtgtaattctcctaggagggaaatgtgttaactttagtgcatggactttgtaatgtttattttggctattctgggaccctttttgcttatttcctgcttcattgtgttttggatagctgaggttgctggacatatgacctgtgaattagtgaggtattacatattcaattttgcattacataattttgctctgattttatgagggatttgcatttaatttattcgtttagattgctgttatagacagtgattaattctagtttctgagtacttgcatcgtagtgaggaccactgcatgtggtaacagctaaaaatatttggcttgatgattgaacaggccttcttatctgtatcatctatctgtgagaatgtgcactggatctacgggaactctctaagttagtctgagggagccttttactactgataaacattaaagtactgacaacatcttttgctataaataataaaatcttatttaggatttatatagagtcttccttctgccttcatccaccatactaaaatggctaaatcctgttgattctaccttttagatctcactgtaatgtgtcccctcctctccactcactctgccccagtaccttggttcaggccctacttcatctcaactgaattacttgagatagactttttgattggcctccctgcctcttgtctaacctccaccttgtccacccaggaactagtgcttgttttaaaacagaaatcctaccctgtcacacccctaaaaccctctaggggtttctcatcatctgtaggataacatccactttccttagcttagtatacaaagccttttgtgatttggcccacttctcctgcctatctcttgctgctcaatgtttcatatttcaattttgagggaaatcagtggcttataattcctttaacacaccaggcaagagagttctcgataaatgcttgttaaatgaatgaatgaaataccttatgtagctagggtgaccattcaatctgcttggcccaggatggcccttgttgacatttgtcatcccagtgtaattattaaaagtgtcccttttttatcatcaaacttgtctcagttagatcaataaattctaaggtcatccttattacagtggttatcaaattgatttctaactctttctttgtctcctctactagatggtgagctctttgaggacaggagttcatttttatatcctcgtttattcattcaactaagagactgatgctgtaaggtgcttagggtatgatgtagaatgcaacaaacatggttcttgacttcatgaagtttacaatccagcaggaaataataatttagtggaaagaatagagcctaacataataaatgctggtgtatgaatgaatgattaaacatggattagaagttcctcaacaggccaggcgtggtggctcacccctgtaatcccagcactttgggagaccgagacaagcggatcacttggggtcaggagtttgagaccagcctggccaacatggtgaaaccgtatttctactaaaaattatttgggcatggaggggcatgcctgtaatcccagctacttgggaggctgaggtaggagaatcgcttgaactcggggcggaggttgcagtaagccaagatcacaccactgcactccagcctgggcgagagagtgagattccatgtcaaaaaaaataaataaataaaaataaagttcctcaacaaataatcctgatatcacgaattatagaaatagttgtaaatgtagaactctaagtgatcaaattaacaatttatttagagttgccaattaaaattttaaaataccaacagcacacatatacataaacatacttaatatttagatgctaccttaatgttaaacataagtaaaaaggacaatgaaataatagcaagaatgagattttgagtctcattctttttagacaatttataatcctatgtggttctctgtaaagtggattatcagtgtgtactccatttctccccaccctcccttttttttttccagatgagaaatctgaggttttagacacttaactacaaaacaaaagaatgacttttttttttttttttttttttgtcacccaggctggagtgcaatggtgtgatctcggctcactgcaacttccgcctcccgggttcaagcgattctcctgccttggcctcctgagtagctgggattacaggcgcatgccaccacgcccggctactttttgtatttttagtagagacagggtttcaccatgtttgtcaggctggtcttgaactcctgacctcttgttccgcccgcctcggcctcccaaagtgttggcattgcaggcgtgagccaccgcgcccggccaggaatgacttcttaaaccaggatttgattttggttgaactttgctttcagaactagaactacctgctatccaagacttgttaaccacgttttcatgggcaaattacaaaaccctttcaaccccagtttcctcttctataaactagtggtaatattattatctccagaattaatcttaggagtaaatgaaattatgtaaaggcatttagtctcataaccgggctcctagaaagcactcaggaatgttagttctctatccatttcccctgtttatctttgtgtttgatgaattataggatgatatgaaatgatctgaaatgaactgtaatataaacatcaataaaacaccaataaaaaattttattctcacatctggatgctatactaggccttcacctcctccaaaagttacagttttattaatattcatttattatttattattatagtcaaagacccagagaagcattccaggaacaaagcagcaggtaagatttttctgggaaaagacagagattttgagggacccaggatttgggggtcatttaagcagcagtggatgtcagtcttcaagctttgcccatttactcttggtcccttttggttcaggaaaggaagaacaacaagcacgaaaccattcactgagacctttgcgggtgggggaggagggatgtaaacaaaagccaacgctctctttagttcacaatggctcgcgaccccaagacttccaagctctttggtgagggccagcaggtctgttctccaggagtgccctgggtctggacttcatttcccagagtcccttagtgccctaatgtattcagtgctcagagtgcctgtatgtgtgtgagtgtgagagaatgtgtgcgtgcgtgtgtgtgtgcgcgcgtgtgtgtgtctccgagtccctgggagagtggaggctcattcactgattagatccagcgctgagaggcagcactgctccttctctcacgccaactgagtctcttgatctgtacatgcaatcccaggcagctcgcgaacacaaacccggggccagccgcctactgctgctgctgctgctgccgctgccgccgccgccgccgccgctgcctccgccggctctgcgaacccgggacttttcatgcaccacactctccgcctgcttccctccgtgtcctgaaaagtgcgaccgttctcccaaggaatttccacggcaagtatggagatcagaaaggggtgtggacgtgtgtgcgtacccaagaggggtgggtgcgagggcggccggcttgttcaggaacctggctaactttccgggtccgtttcctagggattcgggcggttccctctggacgggggcagggactgggactcggactggcgcgtcttggatcatcgcgacggagcctctcggcatcggcgccctgcgcgctccgtgcgctgcctcgctcaaactttccgtcttgagttttccttaatgtgttttatttggggagggggggaggtgcaagggggagggaccagacgcgggaattggacaagttgggagggtgagggcactgcaagggaagggagcaggacttcttttctccgtctcttaataagccccattcccactttgttcgggtcgatatcgagaatgccttctcgccgggctctctggtgcaccccccggtgatttccgggctcccctatgtaccccgcgttgatttccggcgaggccagggctgggtggtactcagtggggagcccgaggcggcgggcggatggagaaggggcgagccgaatgagaaactaccccgacagcctccaccccacacacagccggctccgcgggatacccggggagtggctgtttagccctggaccccgggtgctcggctgactttttcctagcgggggcgggtgtgaagggtgtggagggagggaggtggggtaggatggatggatcctctgcgggcaggaaggaggcaggtgctagcatagaggcggaccgttctaaacgccaccggtaaactccccactcctctgggctggaccggcctggccgtagagtagcccgacacgtgggatctcccgggattttcggggtcgggaccccctctcccagcggttctactgagcaaggcgggaggacgatcgtggagacgagggctacttgactactctacttgtagttttatttttatcttagacctgccttaaactgagtaacaatttctcttctgacttaagaacaaaacttttcagtgagcacgccggtcgctgcggtcctgcggccactgccgccgcgcttgtcagcccgggccgagcgaccttctctgcccggaacccagccccgccaccgcactccggagcctccggcctcccccaccccacccccgccccccaacccggggcttttcagggctcggcctgggcgtttcgcctttgtgctttgtaagagaaagccttttcttccagggcacaacaaacttgggcggagagcttccgtgtggccccccgggcgaggccgcccacggtggtgaggccatccgaggggatgcccggttcatcccccagtccaggagcctctccgagagctcgcggcccaggtcgaccccagctggcgagggcgcgcaggagtcccgaagtagcggggactagggcagccaggaggcagggggaaagctctcgcttcccgttaagcacaccctgcattctcgggtcgtggatgcagctccagcggagagcccgtgttccggccctgagccaggcgcgcgtcgcactgggtgggtgcatggggcccgggccataggtgtgggggcacagccctacctggccggcccgggtcgtctggggtctgcgccggcccactggcccgggagccgccgagggggagagcaccgcactcgctgcccacgacgcccagcagccacatcttgcctctcgcctccgctccggactcggcttgaggggcaaaggggagagaaaggaaaaataaagaaaaaaaagggcggcagtgaggaagcagcgaggggactggggggagcagagtgggcaggggggctttgccttgcctggcctcctctttccgtctcgcgggctcttcctgcaaaggggaatgagcagaggggggaaaggcagaaagagcgtcgaggaagagcggtgctggcgtcttccgtgccgatccctcctggcccgcagagacccggcaaaagtggcgtgagttcgcttgctgcgcttcgaggcaaggctggggaaggccgaggacggggcggcgccgcgtcgcgccgctggtggccgacagggccggggccgggcgcggagcgagcggggacacacacctgttctgcgagccgcgcggtgtgcggcggccggacggccgcggtgcgggccgcagaaccctccctcccgcactgcgcatccgcagtccaggagctggaagggcccggcagccccgcgccggtccgtatttgcaggagaagcgggagtggaggagtccgcggctgcccgctgaagcggtggtgcgcgcggcggcgggacccgggtgacccccggggcggggctgctcgggggctggaggtccttggactttggtcgaaggctggcagctctgagcccctgccccgcgggccccgcgcggctgcggaccaggggcccttgcacgtgtcggttcttcctggactggcgctttggttgcccaaagttgggcgcagattgtttcgtgcggaggttgttgggacccagagtattctatatacaaaggcaaccgagagccggagggagaggtcgggccaaagagtagtgggctcggctccgcgttgggcccaagtttatgtaggtttcgccttcacctcttcttcccccgttttccctaaaagagttgattttttttcccagtcgagactcttccgagctgaataatgcacccgctcgctgagccagtatcccgcgaccccgcactctcggactggcccgggctgtctcggattcgcaccctttggccaagctgggcctgaacccgggtccaaatctgggaccatacccggccatgcctgaaacacaggcgtcggccctagcccgggaactgtgttagccttatgttccctgagctctcgcatatggtggtaaaatttctgttagagcggtgtttccaaataccccctgggcatttggtgtgcgggaattctcttcaagcgaagaagtctgtgaacttaaaaaaaaaatttttttcctgcgttcttaacaaccccccactactctgcctcatttcccattgttctttgctttttaagttccttgttaatttttttaaaagtttatttatgcaaaggaaaaatatcgtttaatttgttctattattttaattcctggcttttggaaacggttcagagaccacaaaactgtcacctgttgtaataagcagaggagtgttgtgtgtgcattttaattgccagcagagccgtagtttggtgggcgccctgagctcggctccgggaaagagccctttgcagctttctttgtggcagtcatttgcaaaggggtttggctctcagctacggcggaggcagagggggcagcagcaccgcttccttctatgccgatcccgggcgcaggtcaggaagcccagaccttggactgggatgggagattacctactctctgagactttctcttgggctttcggtttttctgtgcgaaagtggctagttcgctccgcagagcgcggagcgctgcgcatcagcccagcctcagacattttcacgttccaaacgcggacgtcttcgtttcatttgtcttggttctggcgtgtttaaccacgcaattagtaatctcactaattattcagatagctggcgttttgcaatcactttaaaccagggtcaggagtgtgatttaagaaacaaacaaactcccacagatacggaactgaaccaaacccatcacgtcaaggatttgaaattttttaactcaatatttgttggtccctccgtccaacctcactgcctgccagacaatttatttagcttcgtggattgatccctcctccttgtttagttaattcaacaaagactttttgcaatctgtttggagtttgtctgatgccgtggaaaagtagctgatgatttatttggttgcttttcgatttctgtcttcagcccttctttctcctcctttcagcggggatgtcagctgttattacttcctattgatccctttgcaaagtgagaagtgaactaaaattaatgtcaattccactgctcggatcaatagctggagttattttaatctggatttgcacgaagtgctaaattaaaaaaaatcagcatagaggcagaaaagtaacagttacttactttccctttgccgggttcttcacagtcacccaaatgctccatcaagctgattatcttacaatccatatttttttaattaagagggtcagttagttttcttattttgggttctgtgtttaaacccatgacattttgacattgggagtgtattaactatagattttcataatgactgtggtcagctgaagcctcatctatacaagttgttaatgtgaggagagggtaagaaagaaaagggaaaagaaaaaaaagaaaaaaagcactcccccctcccccatggagaccaacgcccacgcaatgaagtaaaagagatgtggcctggaaaaatattgttgatttattttcagtgtaatgaagttttcaaatgaataaccagggttgagtgattcaccaggttctgttggagtgtccggtgctgtcaccagattcctaatttatgaaactcatttaagataatgaggtgatctaggaagtaaaaatagcaagtgaatcctggggggggtcgtattttgagggggaaacattcctcccttcacatttcttttctccagttttcctcatataatattgcttgttgatagataagtagctatttctgttgtgaagagctgcttagaacccttggaacagccctagacccactttcagagcgtccatgttgtatgaccattaatctgactagaaaacagccaagaacaggattcccagacttgtcagcctaactggctgtccttggcagatcattccctgcactgctataacttgacaggaaagttatttaaaatttggaagagagaaaaatccgttaatgtgagatacataatctggtaatttagcaatgatgtctataaggaaagatgccaaatgaggaagcagtctgatggtgtccactcatcttcccaattaataacagtcattgacatgtctgctacaggatgggagaaggaaatactctctttgcactgcattaagccaggaggattcatctaccgtttaactgatgtttctctgtttgagggaataccaaagatactccaggtgggctttttaaaagggacgaggtagattttatttctgatatgactctcaatttaaaggtataatttgtagcagacggtgatttttggttatgctttgagtttcactaagtttctatttcgtgtatatttttgacactaataagtcttggtattcatcttatattgtcccggcttttgatatatagcccttctcccagcccccactcaaaatacactttggaatggaaccactgactatgaaaatgtacaacctaaatttacaagggaaactgaaagaagtctctccgaactccaatttgttccgggggcctttattggacatcagctctgactgggccaataagcagagcaaaataagtcagaaattttgttaacattttgttctaaatgttaatggcaaatccaaggcagtttacaaatctacttaagagtgagtgcattagtaactaaaatcaccgatctgttctttgctgcccttagaagacagatgcttctagagagcgtatgccaaaggcacccattatggttttaagtgttgtcagagacgccaggcattttattgatgaaggttttgttccttctcagaaaagagaaatagaaagcccatgtgattagagagaggtgtgcctcaaaataaatgttaatgctgtttgttcatatagcacttttttctggaaacagtcttagatgatacatgaagatgtgtgtgtgtgtgtatatgccaatgtgtatcttttatccatgtgtatactttgtactaactaatatgtacaagtgttcctggtctagatgaacttgaattagggatatttcagtatcagggtgttgttaggggagatgaagagaggatgcatatgtggggaatcgtataggtagaatgtggtctctgaacatcaggcctgccatgagtggtggatgcaggtggaagcactttaaaacatagacccccacttaatctactggatggcttggccttccaaagctcatttgttcagagaatatcgtatttggaggttttatgatatttttttctttgctgggctcaggcgcatttcacccagaacgtgtagggaccaaagtcagctacgcgtacatcacagtaagttgtctattgattttcctgaatgaaaatggtctgatgctgctgcccactggctcctaaagcctgtggtgtctcttgcccgagcatctgtgagccagaaggatggtgtttcgatcacttggggtttccctttttttcctccccctgactttcctcccccttctttttttctctttgctgtttctacaggtcttaggagggaatgattccccagtaatattccctgccctgacccaaagtgctggttggcctccctcccagggaagactgcttcttgcgtaacgccggccacagaaagagactccgatggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagatgtaagtactttggttccagccctcccttacccccagtaagccctgcctcaccgtgatgttcaacaggtcggtggcgttttgcatgctcctagtaataggaagggccaactacttccctttcactagctgtggagtgctaacctttgcttgtctcttatcagtgagcactgatagttcttgaaatatttttctgaaagtagccagaggcaagttggccccagcacagcctttctctccggaccctagtgggcttattctctgaggacttgagtgaagaggggtgccaccgacgtactgaagtgaatgtcatttcattaagaagtgtcggctcctagggaatttggggggcctaaagaaacatgtccacccctcctctctttgctgtcctcgttatgtttgtctgatctcagtgttattttttagcttttccattgtatcacatccagcagactccacgtgattctattttcacaactctcagcccttgtccacatcaggctatttttcagagaaggacaaaggtgtcgtcaatcaccataaagcatttcacacagctgtgttttccttgcgatcgcaaggctagaaagccgacttctcttgggatttcacaggtttgctggatgcttatcctggggctcacttttaggactagacacggttgacctgtgtgactgctccaaatttgatgttcacaactattattaatttctgcttatgaaacagctttttttcatgttctccaagtgccttgttgggctctggctacacttatagctggaactaaacctttatttggaacttgtagactaggagtgctgaaccctgcaatcttttgctctaatataatcagaaaataattgtgttttgaagcttttgggctgtgggtagacagagcagttttcttcaagcctggtgagaatttatgaactgagggtgttttttccacgcaaccctttgttctcagatttgcttcattttattttcttaagaaaactacatctgaggtttgccttccacttttctctattttttcgtgctcccatcctctctataaccaccaacacgaataccatttttttccctcctctttatgatgccgaggagagtaatagagacattgcagctctctcccctgtcgccactgcttcgtcaggctgtctccttgaattaggcactgtgttaacttccctgcgctaaaaggcatctgcctaaacccagcgtaccttttcaataaaagtcatcataaaatcaacctgccttgtaaatccatcgctctttggttttgaaatatgttgcaagtgtgtcttttatgtcagcctctgtaagccggagacctccccacttaagggagaaggctgctggctgacagcactactgctagtgttgccctctcactttggctttggttctctttcaccttttcagtttctgttgacttgtgtgtcttgtgatcctgcttcttggatatacctgctgaacaggtatcggcattgtgttggttcatttgattttattttagttttcatttgtccagtgatgtgcaagtgatcaaggctagttataatgtgacctccagccaaaactgccttgtgttagggtgtgacagattccgcccctttttttctccaaatacaagttgaaaatgaaatcttctcttagctaatatgccacaaagtaacatctggagattgagatctctttcttcttacctaacagatccagcttgtctccatttttctatctttttagcccaaacctgtatccgactccagagcaggaggaagcttgttagtcaagtcagaactcatagacgtggatatccattcccctctgagtgtcaaagccataactcttctgtttgcctggtttgcattgtgtggtggtggcatcccccatggagatggatccctcacacaggagtacgcctgggtggagaaaaattaaatgagtctgtctcccaaagtgaaatggaattctgaccttgaaattaatgagattctgatcagaagggtggggaaacttctttatttccaatgcggtgttatacaaattggagtccctttcctcttttattcatttaaaatagtcttcccttatagagtaccctgtgttctcctttttttttcttgtacacaagcataaaacctataggagtgtctgtgaggggagggtgttcgtacaccctcgttattatccagagttgcatttgtgactaatctttaataaaaaacaaaggtgcaaagtgaaaaggaggctgtgctaccctgtggtcaccctggagttgtgctttttactcccttccttaccttaggtggttagcacatccctcactgggtcatactagatagcgtttgtgcttttgattgcgaatttttggaaggcaggagaagtatttttctgtaaggaagggttgaagaggcactaagacaaagtctgcagcagctttcttggctcctgtcatatgccgacgtgtgtcggaatatttatggtctgttttatgtaaatacatatttaagggtcgttagaaggcctgattattcccactagatgcctttcaggtcctccctacagaaccgttttgaaataagtaatatttctcagataatcgagtgacagtatacaagactgcttccaaagggagagaaagcttcaggggcagatgggggcagtgacggggtatggggatatgaaaagacagaggatagaaagtgttcagacgagcagagtgataggatacagtgctttcgccagattgcccaaattaaccatatatggttgatatacacacacacacacacacacgtgtatatatgtatatatatttattcttaaaatttagagttaattgctgatatggttgactcatttttcagttctcttcatataaatatcttttcataaaatattttttaaatgttttaattaagtgcagcagtcaaactccgaagtaagcatttagctttagagttttgttggtgggtgggggtgggagatgagaatggtggtgtgtgtcctttacttagagcagaagtttttatgactgagttttaggtcattaagaaatcagttgtataatggaaacactgacagtttttactgctgcagccaccccctgctcacacactacatcaatctgcagatatgtccacttgtgagcccactggaaagagaggcctgcagacatggtgtaatgcacacatgttctttccttaaatctgggtactggtaggcaggatttcttttgtggttaaacatgcatttttatagacagaaatatagcgatttgggtcaagcatcatctttcctgatagatgattctggtttgcttgcctgtccatccacctggcttcacaggtgattcctgagggaggtgttgtgctctatggaaaaacaagcagcctttactctgcaggactgacttacttgccctggaaaatgggagaagtgttttgtgagaagccattcatggaggatgcataattccccaggaaggagactgaggtaactcctgcttattgtcactccttgaatcagtccccaagactcattgtccagggaaataatgctaaaatttacggaccaattacaagtagttcacgtgtgctttacatatgaaatgtctacagccatgtttcccagggcctttaaaataaacatttcctcattaaggaaacttcacaacaaaagggaagataagtattgtctgctgtcttgtgttagaatctgtacatttattacccccttagcactctggctcctgtcatgtgcatatcctgatggtcctcttcaggctgcccctgtgcccagattcctgcctgtgtgacacagtctttggccagcctgccagcctatccactcagcccagattggagttggcgaagtatacatgctcaccacagggctgagagggcccagaactgcccgcgtggagcggcgactggccctgtcttctggcttaccccagggatggaccctgggcactgaccacacgtggcttggctttgccctctttccttgaccttcactgtggtcgggcagagtcacaggtaggcaggaaacctgatggctcacagcagctcctggatgttctgctttgctctcatctttgatgtacttgaacagccattcttgggtcccaaaagccctgagtaggagatggtattttgtactctgtgtctttatataaaggcatgtatcattgaagaccctgtgttctaacaatcaaatcagctgagcccacctaggccaaaggcagcctggaatggggagggctggggtgaggggggatactttccaagggctctgggactggggtgggcagggactctacactgggcttttaggagagttgttcttgctagggagaatgtttggggcatgccaggtggccaggctgcacctctgggttgcagctgggacagatgaccactgggaaagggtcagcaaatcgccagaagacctgggtcagatgcttccctctgtcctgactgcccagacctagcctgactctccctcagctgctcccgggttctcccctactccccgggggcaagaactcctgtgatgtgtgtggttgtttctggttgttcactcccaacacagtcatggagactctttttcatgctgctgggtttaattgtcttgttgggataaagaaatgtttgcacagctaaagtggggccaggctggacgggagcagtccctgatggctgcagagccatctggcctggcttggcttggctcggcgcgccgctcgcctggcggctgggctcgctgtagttgtgctcccgctcttcccctgccctcgctccacgccgcgccgctctgtgcggcggctgcctcctcttacggccggaatgcctaatcaccatggtgagaaaacggacaccgcagccgtcctccctcctcgccccgcgccctccctcccatcaattgtcatgcagaagtgatccgggctgccgttttctcgcggccgcccgccagcccctcgccgctgccggcagaagggtggctggtaattgatcttctgggggagggggcgcggagaggcgcgagaactggccccggggaggccaggccacggggtgggccccgttcgcttacttgcaagggacccccagcctccgccaccgaggcggcttgcaagtggtttcagaaatgttggtgatctcgccgtcgctctgcagcacttggaggccgcaggaggactccgcgcgccgcctcgagggccgggagcgcccagcccgcggccgcacacacgagggcccgtcgcgccccccgccctgccccgcctcgccctccacgtccctgcacccccaagtcgcactaagaacccagtccccgatcggtttcctctacgccgtctgagcagaagagagtgggaaccggggtgacggataaggggggggcgcccacgcgacgtcggggtgcatgggagcgcgcgggaggcgctagtgggtgcacggggcgtgagggggacacagcgcgggcgtggggatggccactgcgcggggagggttctgcctggagaaggagggatgggaggaggttgggggagcagggcgcgtggaggagggaggttggacgtgtgtacagcgcctggggacctcgctggccccttggtgcccccaggactctgaggcttctcctttcggcttgaaatgtttttcccttcctgcttttcaaatctgtaaaaatgttccggggaatgtttccgaagtccagggctccgtccttcggcgggattgctggcattcgggcaaggcgagtcgcggtggcctctgaggctcgcagccagcacagcggggctcgttaaagtctgggcaatttctggaactcttcccacgggaagttttccggggctgccttccggtcagcggccccaggttgattatttggtggcccttttttgtttgaaaacaaaaaaaaaaacacacacacattgtatccaaataacaaaagttgctgtccctccccaccccctttcctcattaggcagggaagaggaaactgaaaaatagaattatatttttatattggttttcttatttttaacccttattaactacatccatctggttaataaatattggcacacattgaaatgtattctttgtaaataattgagatttggagtgacagcatatttaatggagttatatttttataatagtttttcttatttttaactcttattaaccacatccatgtggttaataaatatcgaagcacaccttgggacgtgctctttataaatacttgagatttggagtgatggtacattgcattgtaaaatccacaggatttttaaacaccaaaatagcaatattgtttggacttgcatatttgctgctaagagtttaacagcatttcccagtgccattttatcccgtcttaaagagagatgaactgcagacttaaggataatttattgctatatattagctaaaatgcctttaaaaattttttttaagtatcatttaaattgtggcatgtatggttgaacagaatgtgttgttatcctttgtaacttcacatgtgtgctacagggtaggaatttgtaagtatctctttctttgcagcaagaagaattttctgcgaaagaaccttcttacaccttttccaagaaaagatcctggattgggactacatgttgagcctggagaaatgataggctgtagtatgaatcagaacacctggtagatgctaagtaaacagaaggaatttatcatcttccagccttacccaatggattggacttttctgttatcttaatcacactactttagttttagtgtttaaaaaaattattattttttgtctggtaccaatcatctaaaagggtttagtgttcattgcatattgaataccttagtggtggcgattataatctagtttttactttaagttttcatcatcttaccactcttcagcattgcacagaacagcatctgtaagactatgtatgctatcccaaaggcgtagaggtttgaggaaagaaaggaagaacttatttatgccttgaggtttcatgatgatgaaggtagggagggagttttccaagaatttgtgaaatcacctttctcaaatatagacttattttattacttggggtactattaataaaaaatcgtttataacttaacaaaaatttaaatctacttttttctcctaacccttagaaacctaagattggagcctatcccctttccaaatgttttcccacagcattacatcccctatcgtggagtccacacatacggatctgcttttggtgtgtattttagaaaaaagtttccacctagatcctggccaaagttgcaaacagtcaagtgatgtggaggttttgtagacacatgtaaccatctggcaattcagatatgtggctgtcagttttctctgtggaatgcgttctggtttaagatgacctagaagaaatgaaagttgtgtttttgctggggagacatggtgctgtgtccagtacattctgttaacagatctgaagctttaggaaaatctggagctatgtgagtgaagaaggaaccttttggtacagtcttatgagaaatccagcccagtaagtttgagtgtgacttaccaggcaagagttgtctttttccactgaaattcaggctagacttatggctttacatcaatcttagtgcagcagagacagaaagctgtagggagggggcaagggccagccctggagagaccttcgctttattttcaggtatatgattcccatttaggtgccagctaatcctatattgctctcatttgaccttgcttctgggggtttgatttaaaggaagtcagagtggcctagcataataaatacctgttagaggaataaaagctgtatttgccccctttgagcctcaactcgaaggtgtttcagatcaaaggtggggaggcaatgtaacatagtcactatgagtttggcctctggagttaagtcctgacgtgttagcttacttgctttctgatactgggcaggttacctaatctctctgggcctcagtattcttgcctgcaaaatgggagttatacagacttaaaggttgttgggaaggactgaatgagattaaacacatagataatgcttagaacagtttctcacacatactaagtattcaatacttagttactgttgttatttcaaggacaatctggtggtaaaaccttccttgttagaagcattgatgtagccaaacacagggtcattaacaactagcaatgtatgtagggtcctttcacacactcatgccttatggcaatgtggaaagagggagggagaaaggcttgaaagcccttttctgtgatggccagctgcttctcctcccttcattattatccatccaccaggattagccctggtgtcctcctgacctctttctcccttgttttatttagaagcaaggtaatagtcgagttagagaaactgagtctgggagtcgggagaggatttgactcgggttggatatctaggcagtggcccgggttaaaaaagccaaatctcatggtattttcttattctgaaattttatattactggatattgtttgaaatcaatgggttattagaatttgtgtgtgatagagatttggactacacgtaatgagatttgctgtaatagtatttgactagtattagaattcacaatccctgggtttctcgtgtgtccttagattttaagttatacagacagttttaccctcttgcctatgtgagacaaatctgtgaaccttcccccatctgtgtgtgtcacagtcccacagcatgatggattgtctctgcttgggggaagcttaggacggggcttgaaggggccttgtaggtcagaagagaaatacagcagcaggactgagatgggggggctgcctggggagggattagcagggggaaggggagggcagggttgggcggggcatagtgtctgtgtgcattctcctaggagtaaaagagggctgtccattaccctgaacgcacaaataaactcagtgtttttctctttgtagagaaaaagccccatgggacttgggaataccagagaatgactctgcatgtcagtgggagaggtggggagtaggaggatgggagtggggaagactgaccctgtgcctgaggacctcggatttgagtctgttatttaaatagagtagctcatatttgaagagcctcatgcccacacatgtttgtagcagaaatagctgttggcagccaatcatctgatacctcagtctctatcaactccttcatggctccatttaaaggaagggttcagctcacctttggaagtaaagtgtcactgaaggtcatgcagcacccaattctcctccctctctgtcctcagcccttcccacatatagtcacaaaggtgtgtactaggtaggaagggaaatgctgaatgttcttaatttttggttcttgaaggagaaagtctgggatttaggtccaaatgccaaaatcatggttcagaaggaattctagaaaaggagcggagtctgagaggtcgctggagtggtaagggcagtggcgcatgctcggctgaggaatcagcaggactgcagttagggcctaggcttcagcttccttcctgagcagtaaaattaaaaaaaaaaatccttagaacaacaaaagtctggacgcatgggcttccttcctgacaggccaacctggtggggcttcattcagactgagcagcagtcaaggctgatttacggggaaaagaacccagacatgggtttaaccctttcctaaccacagagatgcttcattgcaaatgctgccttctccttctaacttaccatcatggtatggggagatttttattgtcatttcttctttatttaaagtgagtgcctgctgctgaagtacccactgtcctcttcatgagaaagctgagcctatgagaagttgagtgacttgtaagaaactcaagtctgttgctcatggccagaatagctctcaggctcttgaggacattatattgactctgtagtattgaatccatctttgatcgtgggaagtgcctcctggagtctgtactggggtgctgctgtgagccccagttttacctccataagatactggtcccacagaaggaatagtactgcttcatcttagctgtttgttggtggcagtggataaaactgtcgcagagtatgtgagacatgactcagttgccatatcattggtcaaatgtgatgcactcattggtttaatcattcagctgtatttactgcatacctacattgttccaggcaccatgcgaggtactgggaatagactgatgtgcaagatagattatagcccctgccttactggacttcaaagtttagttagcaattgtaggatgctgcgaaaagtgctgtcataggggaaatataacatgccatgagacttagaagttggagcatctaatcttgtctaagagtcagggatagctttctggagcaagtgacctttacgctgatatctgaaaatcaagaaggagttatttattcaaaggagctaggggtagcagttggcttttttggacaaactgtagtatctgagagtggaagaaagaactccagaattgccaaggattgctcacagtgaagtgagaatagaattgttccctggcagggcctgagacctgaccttggatgtctatagcacttcatcctataaccaggcattcttgagaatatccatttggtgcttatgtggctctgaggctcatcatcatctagggtcctgcttttaaagtaactttctaaagatatgtcactagaaaatgctttctgataacatatgctatcttaaccaccagaggacccatgagcacccagaaccatgcttggcacagagtagatactctggaaatatttgctgaatgaaggagggccattgccctgctgatgtttagtgagttagattaagggtcctcatctttttactaaagttcaggcttagctctatcctttgccctacccggaaacgtgacaggtctcagggcctagagtactcgcttggccgttaaactaagccacatagcacccgggattcttggcagagtttcttggcaaagtttcctctgggaggtgcattgctcaggcttgactttcgcgagggaggttaggcatgtagtgccaagagtattgaagaaggaaaaaaagaaagcgaagcaaaccgttgttctagcctggcacacgtcggcatgctaaaaacagttccttccaggcggggcctctgtactccaccatccccgctgtggttttccttccctggcctcttatcttcatcatcgctctacatccacgaacatttcctgagctcctgtgtgtagagcgttgtgctcggtgctgtttgcaagggaatcaaagaagtaggagatgatacttcctcttcttgacagccttatggttaaggtgagtagctaaactgtatatatgaaaaagaaatgataatgtaaaataacagacagtaagggcactaggatttcaagagagagagagagtcatccctgaggctggctttcccagaatgtgatctaaggactgcctgtttcagatcacttgtgctggtgatagtggaggatggggacagggatgggggtggggtgaagaatgttatttataatgcagattcccagggcccacactagacttcatcttcagaatcacaaggaatacagcctaaaaactgtgtattcagcaagtagccatcctaggtgattcttgttttccttaaggtttaggaatcactcatctagggtgaaagtctcgggggaaggtttcaccgaggtgtttggccttgcagaaaggggagtgaggactagtggggaggaaaggagaggatggaaacccactgaggagtctgggcaggcaggggaagggtgaagacccagcatctgctcacaaacagtaccttcctcatccagtctcctgtcttggggaggatctgtccacctgtcccggctccccctctgccactgctcctcctcggattgcctccctctgcctgtcttattgctgatcaagtgactgtatgtgcccagacctccccttcttggtgcaatattattatgatgaggtggcccagcggagggtctggaggtgcttggccagatgtgagggaggccggtgtgcgctgcggtgccccttgggctccagcccgcttatcttctcactgctgttgctctgccgagaaggggctggagagggtttggtgtgtatgctttgccagcctcctctgtcctcttccgcaacccttgagctttcattcaaatgctcatttgtaaagaaataaaagttggagggttagaggaatctgtcagtgtcagaattagtcaccaacacctgcagattggctttctgctttaagctttaacccttccagggggcagctgccaccgggtagaaggttcagtgagccgtgactaggggcttgctctgagaggttcagggggttttgggtacctgcacagtaggggatgctctcgtcaactttgcttatggagttggggatggtatttttcccccaacataattccccctttaaaaacactcatcacattaaattgtaattatttgcttaattgtgcctctcccatgggcccatgtctgtctccctatgtgactccatctagcgtgtcccctcacgtagtgcctagcttggtaaatacttgttgttaaagtaaatgaacccaggatcactgtttcttctgctgagtttgcagagttgccagctggctctactcacttggacatagtctgaagggccacacaggatccaccacaacactgggcacctcctggcatgtttacaagtgggaggtggtgactagaaatagaggaacggttcagcaatagggcaacagcacagtcagaagctctgggcctgtcatttactagccgtgtgatgctgggtaagtctctgtttctctgagccccagctcctcatatataaaatgggagatggtagataatccctgccctaccctacagggttgctgagtaaatagataatccagatgtgttttgtaatctaaaagtaaccgtataaatgccataccctcacatacacataggtacatgcaagatgtctatctacgtctgtctcaagagcaaaatggtctttgggggctaaaatagtttatgaaatgcctgagtgttcaacctagagggagccctctgacatgccattccctccttgaagctgagctacagaagacagtctgtgttccctgagaccgaccgcagcactatttttctaggtgttttggggcaaaagttacccaactcttgtagactttttgtgaatgtaagttggcaggctgttttctatacagacatctcagctgaaattttattggctaaatccccactgaaagaagtttaccctttgcctttcttctcagcaaagctcggagcatctttatttttctgtttccagggccagtgactctattcctattttgtggagggagatgttttggctcagaggcacagtgctttggcctgaggaatgataggcagaatcaagtcgaagagggctttctgccctagagatctttcctaggctgcaagaatagccatgctttattggccagtatgacaagatgaagaggtccctgtcagatttggaagggcctgccccttaggcaagatctttagaagttaaagctgggccaggaggattggaaagagcaagaatttgaaaaaggctttactaggccaggtgtggtggctcacgcctgtaatcccagcactttgggaggctgacgcaggaggatcacctaaggtcaggagttcgagaccagcctggacaacatggcaaaaccccatctctactaaaaatacaaaaattagtcaggcatggtggcacacacctgtaatcccagctacctgggaggctaaggcaggagaattgcttgaactcgagagacagaggttgcagtgagccaagattgtgccactgcactccagcctgggtgacacagcaagactctgtctcaaaaaaaaaaaaaaagaaagaaagaaagaaaaagactttacttgtgcggtaaacttcattgtgtgattatttaatagaccagtaacaagcagattcattaacaagatcttaattaacaagttccagggttattcctccaagttcccaggggtcctgttctcctcccatttagtcccagagacttcctatccaccttaaactaaccaagccagatgcatttaaattcagtctttttattgcaagtgaaatgactgcaagcaaagagaagaacatagtatcactcctaataataatagctgacacttcaagcactttctatatgtcaggcactattctgagtgctttacaggtaataattgatttaatcctcataaaatccctacgagataggtgttatctccattgtacagatgaagaaactgatgcacagtgtttaagcaatatgcccattgtcacacaagcaggtgtgagagaagaggttcagatccaggcagtctgactccagagtcaatgagaaggaaggacactccaggagagggagacctatgggtcagattcacgaggtaacaagaataatacttgtatttgttcactgtgtgccagacactgttctgagcacttcatatatgtatgtcaggctgtctccatactcgaaaaattgataggagccttttgcagtgtggcagcccttaggcacaatttattttggcccactcacaagcccttttcaccctccctgcactgtgagttccttgagatgggaactgtgtcttattctaagatctctgttcctagtacccagtgcgttgcctggaacttactagttatgatctaagaaaaaaagtttgtcaaacataccctttggtgggatgggagaagatgatttagtatctgctaacgcccaatgtgctttacagacatagtagtttaagaagagctaaatctgtgagacgagacagatgcacctactctttctgtgcctccatttcctcaggataaagtgggatgaacactagtatcaatctcttagtggtgttataaggattaaatgagttaatagaaaatacaaataaagtcctaggaacagtgcctcgcacaaagtatgccttcaataaatgttagctataattaatatgataaggggttgggcacagatttgaggtctcttaaaccaggctcctccaactcttacctctactcctaattgcattatggggacagtgactccagcaagccctgaactcttataagtctgtgcagtttatgacaagtcttcctacgactgaaaaatcttccaattgatattcaggagttggtacctataatgttgtttttccttcttggcttcagttatatgggggctggagcagggatgagtttagcacccacccaatgaccacctttttaaaatacccgaaaaggcacagagtggaaatgactagaattctacactaaactcctacccgaggaaggacagtaagccagaaggaattttttctgggtttagtaaagggcttgacgaatcctgttctatgcctctgcctggtcagccaactcagatagcaagtctgtggaccatttactgttcaccagctattttgaggagaggatgaggaggtgacagaatgcctagaatcactgggaaatttgaactgggaaggaaccattgcaggctgctttatttttccaattttctaataacttacataatgcttaagactgtgttttcccctttaaggggaaaaaattgcttttgctctatttagagctcatcacatttgtacattctacaaatactcttctcctaaatctcaacttgatgacttccaagcgccgttctcacagctggctgctttcgctcccactccactatcccaccccgccccatcatctttagttaacgatggatgctcacaaacccccaaactggcctccctctttccgacttcgcatccttgtgttctttctaagtagctcggccataatatcacttttctttagcagcattctaacttctaagaggcttaataggcaaggagattgtggggtctttgacttcctctgcgtcttagccctaagtggtttattctattaagctgattcttggtggtggatagagctttgctggataagaagttggggtcggggaaagttgcagttggaggaattggatactttcactcccccttccactgtgccccaccctccaacccactcctgccccattctgtttttagagcttttgaatgaaggaagtggtgatgaaattaagtaaagaactcttcttagaggacttaagaggttgacattttccccaaaactgtcttttgcctcctcacctcttccctccctgcactttcattcctactcttcagtctgccacttgtggattttttttttctttccttccacctctacttttgcctccactccaacactagcttaaaaaaaaagctggggggagtaatgaataacaattttgagcaattgttttaaagagaggaatcctatccaggtatggaatgtagaaaaaaaataacagataagattttaacaaaagaaacaatgcaaattcttccagatgttttctcctagcattacaccaagttaaatatattccttctaatattctgacccagatgaaggattttcaggtgtccctattaacattctctcttggttcaggagggccagcaggctgggagagcagaggaagtgtctcttctttatttaatcatgctgagctgcagaggaaatcgtaagggacatttgtgagcacgaagaatgatattagagaagtgagaaggggagtcaagagtgtaagtgtagaaaaagaaaagtacaggacaaccttcacagggaaggtgggaagaaaaccaaaagtagccagagagctgaaaagaaggagggaaaacttgaagatggaggtgggaagatggcaaatgtgaagcatttcaaggaattgttagtaatttgtttgatggcctacagttgttgatgaaggagtggggaaacagggtggggacgtgtggttggtaggcctataaggcagcagcagagtctctttggagggcctttcaacaatgtctgtctatgaaaaatttaaatacaaatatcctttgatgggattcaacttaagaatttatcctgcatatattgggttaagtacttaaagatgtatgttctttataatgttgtttgtaatgtgaaaaacaaacaatctaaatgtacattgataagaaattggtaaaataaataatgatatatctatgttatagaatactacatagtggttaaaaaaatgagttagagccgtaagtgcttatatgtaaaacaagatacagagagaaaaaaaaaaaaacctcatagaaaaaaagatacattcatgtctatctttatatatgcatataaaatgtcagagagatacatatgaaactgttaatgctagtttcccctgggaagtatgactaggtaggaagaagcgagtaagactttttcttgtatgctcttctgcggtatttgaatagttaacatgtgatgtattatttctataattaaaaaatttagtttatgattttaaaaagttaatttggagatgctggaacaggaaaaggatattaggaaaaaactaaggaaatctaaatatagttaataatgtatcaatattggttcattagttttgataaatctaccatattactaatatattaataatagtgacaactggatgaagagtatatggaaaccctcttctactatctttgcaatttttccataaatctaaaaactattccaaaataaaagtttatttttatttatttttattttttattttctgaggcagagtcttgctctgtctcccaggctggggtgcagtggcatgatctcggctcactgcaacctccgcctcctgggttcaagcagttctctgcctcagcctcctgagtagctgggattataggcgcctgccaccacacctggctaatttttttgtatttttagtagagacagggtttcaccatcttggccaggctggtcttgaactcctgatgtcgtgatccgcccaccttggcctcccaaagtgctgggattacaggcgtgagccaccacgcccagccaccaaaagtttatttttaaaagatgattcagaagactgtattatgggacaggcttataacctagcatttatgattgaatcttggagagatgaattgataaaactgaatgattcctctggttctgtaattactacttggttctatttcttccaaatggtcaagtggatgggattacagtcacaattgctgggaaagtgtctgatttgtgtgtgtgcgttgacaaaattagttttcttttctgaatttgttttttcttctgagttagtttgtaaaaaaggttaactgatggttatttcagttttaccgtccaaaaagcacagactggtctaggagctatatagtgaaggtagtttaaaaatgaaataagacggccgggcgaggtggctcatgcctgtaatcccagcagtttgggaggccgaggtgggtggatcacaaggtcaggagttcccagcctaaccaagatggtgaaaccctgtctcttctaaaaatacaaaaaggtagccaggtgtagtggcctgcgcctgtaatccaagctactcgggaggctgaggcagagaattgcttaaacttgggaggcagagagattgcagtgagccgagatcatgccactgcactccagcctgggcgacagagcaagacttcatcgacttcatctcaaaaaaaaaaaaaaaaaaaagaagtggtcaaatgcttgctgctttcttcaagtgagcaagatggggtaaacagcagatgtgagtgctaaatggaattccatttaaccagctctgtttgtggctatatctatgaaactttttctccacttaagttggcgctagagccacataggagtgggcaagaagactacatccctggccatcttctgagtggagtctcttccctcctcatgcaccagcaggcctggtggtggccatcggctctgtttgttgcaggatcagagtctggagagcacagagccattggctcaatatgatatgtgctcattgatcctgctgctgatagtaaggcatggctaaggccaaatataaggcattttccctttgaattaattcacatctcagccagaggaaggcacctgggttttaccttctcatgtagtagaaagggagatctctgggtcctgctcccagttggccctggcacccagcttgaaaagagggatcctctgtaatattggctgcaaccaactacttcatccttcttggaattccccttaccgtggcttctgcgacattatactcctattgttcttccacttcttcaaccatgtttttgctgtcataataccctgtgtttccccatgttaaagcactttgaattttttttttattgtgataaagtatgcattggggaggggaacaggatcctgctactctgtagaggcattttaaaacaacagtcaactaaaagttggtctgcttttgtttgttttatttatttttttgagatggattcttgctctgttgcccaggctggagtgcaatggcgcgatctcggctcactgcaacctccaccccccaggttcaagtgattcttgtgtctcagcctcctgagtagcagggattacaggtgcccgccaccatgcccagttaatttttgtatttttagtagagacagggtttcaccatgttggtcagcctgtttcgaattcctgatctcaagtgatcctcctgccttggcctcccaaagtgctgggattacaaacgtgagccaccatgcccggcctgtttgtctgtttagaagcagggtcttgctatgttgcccaggctggagtgcagtggctattcacaggtgtgattatagtacactacaacctcaaacccctgggctcaagtgatcttcgtgcattagcctccccagtagctggaacgacaggtgtgcaccaccacaaaacgctctggtctgctttttaatatcatcatgtgctggcaattttaaacaatgtcacttggaaaatatttctccccacagaaatattttgttggtataagtttgaaaaaaatgctgtggttactcttgagttttggtatgtatgtaagtttcaaattggcttttctttttttttttttgagtcttgctctgttgctcagtttcaattttgagtctctctctgttgcccaggcactgtacccaggagtgcagtgatgcgatctcggctcactacaacctccgccttctgggttcaagtgattctcctgcctcagcctcacaagtagctgggactacaggcgtgcgtcactacacctggctaatttttgtattttttgtagagatggagtttcaccatgttggccaggctggtctcgaactcttgacctcaagtaatccacctgcttcagcctcccaaagtgctgggattacaggtgtgagccaccatgcctggccaaattagcatttttaaattatttgtcctttaatgaacattgtcatctataagggagaatttggagaacttccagttgtactgtgggcccctgacattggcaaattcagcttgatttgggtaaaagtacgtaacagttcagaatcagttgagcttccacaggaaacagtttgtgtctccaactccggtgacacagcatattccttcctgcattcatgcagtatattcaaaataaacaatgacagcacatgaactgtaaagatgaagacatgaaaattggagttttttccaattctgcagttctttgtgaccacttggagttcttatatgtgtttaagttttaaaacagtgaaataaactgtgaactgcagggtgtaatatttttgtttggtaagtgcaaattttagtttgcccagtaaatagtttactaaatttgaacatctttaaaaataaaacataatggccaggtgtggtggctcatgcctgtaatcccaccactttgggaggctgaggcctcctgaggccaggagttcaagatcaacctggccagcatggtgaaaccccatctctactaaaaatacaaacattagctggtgcagtggtgcatgtctgtagtcccagctactctggaggctgaggcagaagtattgcttgagcctgggaggcagagattgcagtgagccgaggttgtgccactattctccagcctgggtgacagagcgagactctgtcttaaaaaataaaataaaataaaataaaacatatttttaaaatcattaactgcttatattaaaattaaagaatcaagaaaagtattatgactgattattacatgattagttatttgtcatttaaaaaatgacctgctgtgtcaaatatgttccttggaacatatttgaattggaatgcccttggaatgatgtttgaattgaaatatgaaatgatgagccaggcacaactatgtaagggtttgggaatagggggtcctggaatgtttgaggaggagagagaaggcctgagggctgggacagaatgaatttgggagaatatggtaggagatgagatggagaggagccagacctctgtaaatcttttaggccacggagagttggattttattttgggttcatcaggaagccacagagtgttttaaacataaatcaccatgttgtgatttatcacttcaaaagattactttgggctgggcgcggtggctcacccctgtaatcccagcactttgggaggccgaggcgggcggatcacgaggtcaggagatcgagaccatcctggctaacacggtgaaaccacgtctctactaaaaatacaacaacaacaaaaaattagccaggcatggtggtgggcgcctgtagtcctagctactcgggaggctgaggcaagagaatggcatgaacctgggaggcagagcttgcagtgagcagagatcacacaactgcactccagcctgggcgacagagcgagactctcttaaaaaaaaaaaaaaagattactttggctgttgcgtgactaacagattgatgtagggaaagtgttagtaacagaagacttgtgaaaaggccattgcacagtagtttgaaaccacctgggcaacatagcaacactccatttctaaaaaaaaaaaaaaattaaaaattagccggatgtggtagcacacacctatagtcccagctactcaggaggctgagtggggaggatcgcttgagcctagtagttcaaggctgcaatgagctatgattgcaccattgcacactagcttgggcaacacagcaagatcctgtctcttaaaaaaaaaaaaaagacgaggaaggaataatgtcttaaagtttttgaaatatccacagtacttttcccatagtaggtactcaataaatgccaaataaataaatttataaaacgtgaagtgcctaaaaaaacaccaaaaaatctgcaacggagtgcgacatgctgagcaacatggtgctagtccaagaacattgactttggagagcaacaaattgggctttaattgcatttctgatacttcttagctatgttgctttggggcaagtaatttaaactcccagagcttggggcttccatgtctgcacaatgggaataagatgactcactgttttgttttaatgaacaaattaaatgagataatgtatttataacatggtgcctgatttatggtaagccactcaataaatagtgactattatagttagcaggacatgaggataccttgagactgtggtcagtgaaacttcagtgtgattacagccatggggaacaaggcaccagcgttccttgggataaagaggaacacttgggaccttttcacagttgaaactctgtctcctgaatctaaacttgtgctggccttcaaataattggattttcaagtctaaagaggaagaaaaggccaggcatggtggctcacgcctgtaatcccagcactttgggaggccgaggtgggcggattacttgaggtcaggagtttgagaccagcctgaccaatatggtgaaacctcgtctctactaaaaatataaaaattatccgggcatggtggcatatgcctttaatcccagctactcgggaggctgaggcaggagaatcacttgaaccagaggttgtagtgagccaagatcgtgccgttgcactccgtcttgggtgacagactgagactccatatcaaaaaaaagaaaaaagaggaaaaaaaaaatggaagaaacctttggataggttagggttagaatcttttctctcagctcagttcttccctctgattttaggaggagtcaaatccctctccttccatttccaagtttaacagaatcgtcctaatgtatatgcctccttgacacacaaagtccctgaagcaagtttccacttttctctgcaaaagctccctggagcgcagggagctcttgtcttgtatctagttaaatgcctcgattaaggatgtaatcatagttgtttggctctgtaaatcatttgaccctcacctaaagcagcctgggcctctggggggcccagcaatgaccattctgaatctgggaggacagagtggagctggagatggctttcacccttagtggaaagacagccagttttagggggggtaatatatttttctttttccctaggttttcttgtcgagatcgtgtgtgtgctcacacacacacatgtgtgagcaaaagagagaataaaaagaaagaggaaaaggcccaacagtgtacagcaactgctagcacaaaggccaggggagggacttgcagagaaagacaaggaagtgattttgcccagtttaaatcccacttgaaccatgtggtttctgagtcctgaaccttttgaggttcaagttgagtgcactcttgacaaaacatgattttctggttcacatcaaaaaggctttaaaagacttcgaagtcttttccttaggacatcaaacagtccacaacaaagcagggtgctgatgagatgcgtgcaaatgaacagattaaattctctcctgaggattagattctccttaagaagcatgtgaagttggaaacttgggagatggggcaatgccaaaacatactcacactcttgggaccccagagcgccctctcgtctgtttacccctggcacctccctgggcctggaagctgaccttatttgttatgaagttcacacagaagtgcccagggaattagaaactgaaaacaaactcttcaggattctctatcttgcctaaggcaacacttatgtcccccagtaaaaggtgtaaattaacttagaaaagataggtcattcctttgaaaaactgacagttgtttgggtggcttagagcacaattttgcttattgaacgagcctcaatcttcagagaagtaagtatttagaagactactactgccttatggcaaatggaatagcacgctttgggagtggcatagcaaaccaaccaatgcggtagactttctgtttccaagtgagcagctaaagctaaagtcgattgcatagacacagctgtgggtgggccaactgcatgagcacagtttctgagccaagccgctaaaatattaatgattagctttaaggaggagcaattctgattgaggccactctcctgttagaaaccataattagcaattaaaatatattctaaaaactgttccaaccagcagcttttaaataaataattgtcactgctgattgaacttgttttatttccctgtgatttttcttatcttcccccaccccaccccgcataacttacaaccctgtaaatgctcagtagctgttaatatgagtctgtcaatacatttaccatggtgacttgggctgtatttggcgagcatttgaagaaatcagtcactggttggagggaggaaagacaagctgtcgatatccagggagaaatgctaataaccctggtgacaaatcgtcctctggattctctaagggttaagaaaaagcacctcttagacctgggagctcaggggtaagggatggtgacttgttaggaagtgcagacagtagctgtcatgatctgcaatgtccttttcattgtcttgctttcaacctctcaaaaccacagatgagttctggagacagacaggcctggatttgaatcctgattcaatccactgtgtaactgtgtgatcttgcaaccactgaaccttcattttctcatctgtaaattaaagattgtaatacctggcctcatgaggggttgggaaaggccttaaacagagacactaacttactgtttctcaaactcttctgggaaaatacacatatagaagaaaactaacttctgccctccagcattgcaatcgtgtatacaaaggatcaactattagaagtcttgtttttagcttaaatttttgtaaattttgtactttagtttgtttttttgtttttgagacagcattttgctcagtcacccaggctggagtgcagtgttgtgattgtggctcactgcagcctcagactcctgggctcaagtgatcctcacacttcagcctcccaagtagctgggactacaggcacacacccttacacctgactaattaaaaaaatttttttgtagagatggagtctcacaatgttgcccaggctagtctcaaactcctgggctcaagcgatcttccttccttgacctcccaaagtgctgggattataggagtaagccactgtgtccggtctgtacttcagttttactttgtcaaaataatgttttaatatgcctatcattaagtaaaattggtactctggtacgattcattaattcgagtacttattgaatacctactaggtgccaggcaattttaggccctccggatacagtaatgaataatacaggtaaggtctaggctcccattgagcttacagctacatcagccagggaacctagtactggatgtttcttaggtggcctgtgacccatttaaggagacaaaaaccctataccagagaatcctatggacaacctcccgctggctatctgccatgatttttagaggagaaagagaataaaacacatagacaaaaatcattagtattttggtatgtatcattccagcttccttttaatgagtagataataagtagatcagtgtgttttgatataagtagggtcataccaaatgctgatttgttactttctttttcactttttcatttattacagatactactgtatgtcaacataaatctccatcaccatcactactcttaaaagcttagtattccattgcagggatgcattacattttatttaaccaatctctggttgtctaattaggatgtttccagcttttcaatattagaaacaacattacagagaacatctttgtgaatttacttttgtcaagcgtctgatcattttcttaggatatattctcgaaagtagaaatgttagataaaaaggtaggcatatttaaatctttatgccgcttgccggattacctttttctttatgctgttatcaacacattatgataaatatttttaatctttggcaatttagtagacaaaatggtttcttatttatttaatctgtatttctttagttactagtgaagctaaacattttttaaaacacttattgggattagtttatcttcttttttgaattgcttatccatgtcctttacagggtttccatctttttctaattgattttaagagctctttttaataggaaggatattaatcttttttaatctataatatttgttgcattttttttcagtttatcatttgtcttggtactttagggtggtggagctttttgttgttgttgttatttgtttttatttatttttattttattttatttagttttatgccttgtggagcagggctaccccataggcagtgtgtccagaatagccttaagtttttactttttaacaaggcattttatcatttttttttcccttttggcttatccttagaaagctgtaaggccacttctaatgaatccctaaagctattcaaatgtgcagtagttatctcaaagatagtccccagttttggaaaaaaaatctagatcctaagttcctgtggatgtccactcaaagggaagatgagaggtaccaagacctgacagaggagggccatagggtttacagctagtggaaaatacagacagaccagtcgttgaaataaaatgtgatgagtgagataagagaagtgtagatgctagagacgggaacaaaagggaaacctaactgatccagggacacaggatatgcatcctggaggaacagatgctcaagttaaggttttgtgactgagtagaagttagctaggtgaagagtggggaaatacatttcacgcaggtaagtagcaaatgcaaagacttacagtctagaactataagtcatggtagccactggccatgtgggtatatttacatctaaattaattaaaattaaataaaattaaatttttatttcatcagtcccatcagctacagctcaaaggctgactacccacatgtgactagtggctactatattggacagagcaggtactgaaccttttcatcattgcagagggttctgttggacagctctgtccagaaagagcttgatgcattcagggaactgaaaagggttcactctagccaggtatgcagtgtgcaagggtggagagtggcaaaagatgaagaggacatggcaaagaatggagggacttagtcaaagctgaccctggcattggggctaatgttcctagccagttgctattacagagaaagtaaagaggaaataaatttaaaatttactgtttaacagccctgcaggtagacattgtctccattttatatagtgcagctgagactcagagaatttaagacatttgaccaatatacagctagttagtggcagagctgggattcaaagacagacctgtctgatgccaaaaatctgtgctcttccctttttgtcactccagcagacttcagaaagctctacccagtgatctcttagatcaggatggaaagaattctgactaagaacagacaccttctcaacttgatgctttttctgttgaggcagtattaatcatgggtgagcttgggacccagcatggaagtaaaagagcttagagcagagctttctttggagctgtgcctcctgttccctgagtctcaaagaaaaactcctccaggtgctccagaggccttgacattagccagattcaaggatgagctcttcccaggtgctaaccctcagatcaggactgcattgccaaggagagccgctggcctgcggagtcccatgtgaagcctgtcaagggggacccctggacatcagaatatatgacttggctcatcccctcacctagaacctgttgtgatggccacttccaagatattatcattggaaagaaagaatgctgatccccagttaaaggggggaaatccttgccctagtgcaatcccatcttgtccagcagttgagagaatagtgtgtcaggccgtgcctccccatccctaagcagccatagggactgaggcttttaatttgctgtcacagctccaggcatttttctgagccaggaaagtcatgcctggcaggatgttaaggagaatattaccatctgaatgtgaactctggattagtcagtctccctaaattcaagatctagtattttctagggtaaatatggtaccttcacattttctaagctggcatgagtgaatggctatgtgggaagataaaatgcatgatcatacagaacaggaataataaagggtgtaaatctaaggaagaagtaaaagacgcagtcaacatgatagggaggaggatgagccttggagatgagcaatattctgaaagaagagaacattttaaatggatgaggagggagatactagtggcctctgccttgaaagtaagaaacatttgtggagaactggggaggaaagaattgaggagcagctggaaacttagtgtatgaagaaggttagtgatctcagttaaatgtagtgcagagaatactcaagacatgataagaggagtcagcagcatttcatcattcattccacacatttattgagtacctactatgtgctaggagccattaggtcataagaatccaatgtaaaggagacctgacttctaccttcaagcatcttacagttcttatggggaacacagatatggaaacagccaaatacgttacattgaggttcacattttaagaggaataagttatatggtatagttcacaggagtagcacccagcctagaattattaggtcaggaaacccttaaatactgtctttatactaatgaaacccaaaattataactcttaaccttgaccttgtcctctaagctccacactggtgcacacagttgcctacctgatgtccccagttgaatgttgaaaagacatttctttttttttcttttttgacacaggatcttgctctgccacctaagctggagttcatggcatgctcatggctcactgcagcctcggcctcccttcctcaaactccctaggcttaggtgatcctcccacctcagcttcatgagtagctgggacttcaggtgtgcgccaccacgcctagttaatttttgtatttttggtagagatgggatttcgccatgtttcccaggctggtctccaactcttgggctcaagcaatccactctcctcagcctcctaaagtgttaagattacaggtgtgagccaccgtgcccagcctgcatattatcttaaaaagagtccaaaggagagctcttgattctttgccccgctgccgcaccactcacactctttttttttttttttttgagacagggtctccctcctgttgccgaggctggagtgcaatgatgtggtctcgcctcactgcagctttgacttcccaggttcaagcaatcctcccagctcagcctcctgagtagctggagttaccggcgtgcactaccatgctcagctaatttttttgtatttttagtagagacaggattttaccatgttgcccaggttggtcttgaactcctgggcttgagtgatctgcccatctaggcctccccaagtgttgggattacaggcatgagccaccatgcctggcctacccctctttaaaaataaacaaagccagaaataatcttgcttctttatgtctccccatctcagatgatagcactgttgttcacccaattgctttggctgaaaagttaggaaccctccctgtttgcttttccactcttgtacccaagggccctcttactccaccctcttgcctagtggaaataagacttctcaaataactggtagtggcccaaaccacattgaaccatttcacaattttgagacctagatattgaatcattaggatccagaacaaatatctctgctgctgagcttcactcatgtgtatctggctgccttctagacttttattcttggatgtcgtgtgggcactgaatactcagcaggaccaaaaccagatttaccatcttctcccactaaacctgtatctccctttgtattgcctattttgatttatcatgctaatgttattcaaattagaaacaggatccctccattacctcaccccttataactaatcaattttcatggcctaacaattctgcttaataaatacctccatctgtccctacttcttttcccatagttcatactctcctgctgtcttagcacactgttgcagtaggctcctaacatgctctggcattagcatctgctgtcttccagttcattccgtataccctactgataaaggtcttgctaacatgcagacttgttcatgtcacctgcctacctaacacccctcattcctatcacaaaaaaagcccacaagtcttcagcctcccgttccaggctcttttctcaccattctcctcttagcttttcatttataagcatatcttgcagtatgtagctgttaatgagtattttggttttttccccaagtacatttttttcttttatattttgaaatgttgcatacatacagaaaggtgcacaagacatgtgtacagttaaaaaattatatgatgaacactcatgaaaccacatccagctcaagaaatagagcattagccaggcacggtggctcacacctgtaatcccagcactttgggaggccgaggcaggcggatcgcctgaggtcaggagttcgagaccagcctgtccaacatggtgaaaccccgtctctactaaaaatacaaaaattagccgaacatgttggcgcatgcctgtaatcccagctacagaggaggctgaggcaggagaattgcttgaacccgggaggtggaggttgcagtgagccaagatggtgccactgcactccagcctgggcaacagagcaagactccgtctcaaaaaaagaaagaaagaaagaaatagaacatttccagcatgtgagaagccccttgtatgtttctccttgattataacccatcctctcttacttaggtaatcactatcttgacttttatgatgattacttttttgctttttaaaataattttatcacacatgtaaacatccccaaacaatatagttttgtattttgggacgttcaaatgagagagatcatgtttttttttgtactgtttgtgttttgctctttctgttcttcactaagtttgtgagattcatccatattattgcatgtagttagagttctttcatttttattgctgtgtaatgccctaatttcctttcttttctttctttcttttttttgaaatgggggtctcactctgttgctcaactggagtgtggtggtgcagtctcagctcactgcaacctccatctcccaggctcaagcgatcctttgtcctcagcctcctgagtagctgggactacagccacgcaccaccacgccaagctaatttttgtattttttgtagagacaggatttcgccatgttggtcaggctggtctcaaactcctggactcaagcaatttgcctgcctcagcctcccaaagtgctgggattacaggagtgggccaccatgcccggcctaccttgatttctatatccattctgatggtgatatacatttgggttatttataattctttggttcttatgaaaaatgctgctataaacatttttatgtgtatcctggtgtacagggcctgagtttcctgagggtagagacccaagagtagaattgctgcctcctggggaaagtgtttcttcaactttactagctaatgtcaaactgtattcccaagaggttctaccaatttgttctatttttagcagtatataagaatttttgttgtttcatgttcccactagtacttgatattgtcagaccttttaatatttaatcatctttctggatatataaatttagtttttgtctacattcccgtggttactgataagctagagcaccttttcatatgtttattggccatttaaatgttctctttggtgaagtgcctgttcaatgttttgttcatttttctgttgggttgtctctttcctaatttcttcatgtaggcttagtatttcttctgttcaactattacaactcattaatatctcctataaatatatattctaactgatctctgtatctccagtctcaaacactttgattccatcgtcttcatagctaccagagttctaagagaaaccctgttgttgtaattcccgtccctaaaacccttcaatgactctccattgcccttgaagttaagagaaggacaacatgggctgtgagatccttgatcatctactctctaatttcttactccggctcttgctagatcctctcaactccctcccccttctttactgtaacccccatctctaccaatgcttgttgctccttaaacacataaaattgttttacacttgcatttgccatggttaccctttttcttccctttactcttaattgggagaatacctgcacatcttctgaaactcaactcaaaggtccgctcctctataaaacctttaccaactctccttcttatcccgcctcaatccctccatcttgtattctacgaaacacactgtctttatttctagcaaggcacctgtttattgcatttattggttaatatgcctgcctcttccatcatattatacatgagtcctttcaagccatgggaagccccttgaaggtagaggaattgcttcatcatctttttgttcttgcgcctagcacagtgtctggcacagagcaggatatgataaatagtagtaattgttattaatgttattactggtattgggtatgattgggtgccaatctgttttccttattagactgtaaattccttgaggagcctggtacttgggtggcatgtggtaacatttgtctagtgaattaataacttatgaaaaacttctgaaaatcacaattgctttaagcagtatttggagtaggaacataaaaacatgagtattaactttgcagagaaaaaaaagctggtttacatccatctcatgaagatgaaatcttaggctcaaactagttcaaagtaaaattttataagaacaaacgtaatgttttatgcttcggttaaaaagtaaggggtaaaagtggggaaagcctaacttgtcagttcatatagaaaagaagctcaaatctgttatatggtattgtctttcatctaaaaaattaagttttgcagtgaactgtaatttgtgtgtgaacgtgactgggaaaataaaaattctgctagagagagtatgatttgcttagcacctatgtctgcagtctgaagagcttgtcactgttaaagtgaaatcttatagatgtttcagctaagactgtctttgctcaaaaagagggaccgggccgttccttggagtaacctttttttttttttttttgagatggagtcttgctctgtcacccaggctggagtgcagtggcgtgatctcggctcactgcaacctccacctccgggttcaagcaattctcctgcctcagcctcccaagtagctgggattacaggcacatgccaccacgcccagctaatttttgtatttttagtagagacggggtttcaccatgctggccaggctgatctcaaactcctgacctcgtgatctgcccacctcggcctcccaaagtgctgggattacaggcgtgagccaccatgcccagctggagtaaccattcttaaactgttttcaataaggcataatgggtgaagttacgcagataacactgtttcatagacacacctgcagcgatgcataatttctggtccatgagctctacctccacttctttctatctctcccttaagaagatgtattgtaatggaaatgagcaatagtgaaattaattattatagtgataaccttgatctgctccacattttatttcctaaaaaagcaaatcatttttctaaagttcaatactttaattattagtgttaagaaattactatattcctgacaattgacatcttgttgagaacgatatgtacagcagtatattttgtttgtaggaagaagagaggctttggagtcacaccagctgtgattcatatagcagttcagtcattgccctgtgatcctgagctagttgcttaatatctctgactttcatctaaaaaataggcacctactttacaaattgctgtcaggacaataaataattacgtaaaacagccaagatagtacctaccccctaaatatctttcaaatctatatacatatctctgttctccccgctacagccctattttaagtcactagcatctatgttctggattatttagcacccttctaaatggtcttttgcttccagtcttgcctgccctagttttgttcagagcaaaggatgttgtaaaagctgacttgaaccactaacaggtgtgtccctggtatggagatgaatatgtagccgccatggatgaatgtgtggtatggagatgaatatgtatcacatgacagggactggtttagcattttatgcattatctcatttaaccctcaccataagccagtgaagtattattcaccctttaaaaaccggagtttagagaaggtgagtgacttgcccactgccactctgctgggacgtgaataattctatgtgtgtccaggcctctctggttccaaagctgatgctctgcccctgcttcatgctgcctgtgctgttcagtgttctaatcctatttctaagtccctgccttctgggcttactgtacactcctggtaacagctttgcgcgtcgcttagctacggggagatgatggtggatgcaaacatctgattttcctgacagtcacattccctttagtatattaataaactgacattggccgggcagtgtcacgcctgtaatcccagcactttgggaggccaaggtggacgggtcacttgaggtcaggagtttgagaccagcctggccaacatggcaaaactctgtctctactaaaaatacaaaaattagctgggtgtggtggtgtgcgcttgtaatcccagctacttgggaggccgaggcacgagaatcgctcgaacctgcgaggcagaggttgcagtgagccgagattgccgcactgcagcctgagttgacagcaagactccgtctcaaaaaataaataagtaaatcgacattctggttttatacttcagtttttttcagacttagatgcatgtgcctgcctgggttctctggactctgacaggattgagtttctggactagcaaggctgagggccagactctggtctttgataaatttgataagggcaatatcatgtggcacaagccttcttgcagccaacctgctgctccaagctgcaactttctgatgcctgcaattaaccttgatgacactgatgaaaaatcttatttggtttgaaaccttgatgcttttatagacttttagatagtaacagaaatgaagactgtctacacttggtttccttgagatttaggaaacttctcaagcatttaatcaacaaacatgtcttgagacctataacaaggggaatacaaagaaatttagtgtctcgcccttgccctcaagatgcttccaacgtaattgagaacattagagtttttttaagacccacaattcaaaataccggattacagtactttcacatagtaaacgttctgtgtgtccaaatgggtttcaagtgaatgcttgatatacctgagcctgacttttatgtggaagcttgataaatatttgttgaatgattattgagtattggcctcccagacactgctctctcctaggcttgactctagctctgtcctctccaagacgctgcagacttaggatatttagctactcactgtacaaccacacctcaatgaatcttccgtcagcacctcaaactcaacatgtcaaaactgattgtattaactttccatgtttggagaggcagcataacctcaaagttaggagcatggagtctcggatattggttttagtcacagctctagctagctgaatgacctggagaaagtctctaaactgttctttctttgtgtgaggaaatataggtttactcttgggattcgatgagatagtggatacagcacattcaacacgatacctgcacacagtcagtaatcattaaatgttagctattatcatccataattgcccccaaaacttccaatttttcctgtctggtaatgataccattatccacttgaaccctcttcttcacgccatctcagctaaagagttagcaaaaactgtatattctacctttttttttttcctcaccctgtcacccaggctggagtgtggtggtgctatcactgcttaccgcagcctcaaactcctgggctctggtgatccacctacctcagcctcccaagtagctgggattacaggcatgtgccaccatgcccagctaattgttttattttttgtagagacacggttttgtcatgttgtccaggctggtctctaactcctagactcatgtgatccgctcccctaggcctcccaaagggctgggattggggtatgggccatggtgcccctcctattctacctttttattttctctcagattatgattcattcaacatacacttatgtgacatctaccgaatacctaacacattgctaggtactgaagtcacagagatgaatacttatcagtttctgtatctgtagaagcaaatacatctgtacctgcagacttcagatgatccacgtaacggagatacagaaagtatgtttaaaaaagaaaaatttctgagctgggcgcagtggctcacgcctgtaatcccagcactttgggaggccgaggcaggcagatcatctgaggttgggagttcgagaccagcctgaccaacagagagaccctgtctctactaaaaatacaaaattagccaggcctggtggcgcatgcctgtaatcccagctaccccggaggctgaggcaggagaatcgtttgaacctgggaggtagaggttgcagtgagccgagattgcgccattgcacttccagcctgggcaacaagagcgaaactccgtgtcaaaaaaaaaaagtctgaaagtgatttcccgtcctcttttcaaaaccagtgcccttgcgaagcctgcattgcctcttactgtagatatagcaggaggttgggtttttttaattggttttgaaatgtataggtaaaacataaattcatgcccattgcaaaaaaaaaataaattacagaaataactaaaaagtaaaagcttcttactccacctctttaatcttactcccttccacaaacgtaaataactgcgctgtttactgtttaataggtacccttgaagaccttttctatttatacatgtatacatttatgtatatttatgtagatagaaatatagtttttatacaaatgggatgataaccataaacgtgcttcttccttttttcacttaactatgtgtgttttcaatttttccatgtcagtacataatagaattaccttattctttttaactcctaaatggtattccatattttggaactaccacaatttatttggttattttcctgttggaagccttgtaatttacttccagtttttcataattgcaatcaacgctgcagcgaacttttggcacataggtttttatagacacatctagttatttctgcaagtttctagaagtggaagtactgagttaagaggtgtttttgtgaggctgtgctaacttacccttaaaaaagactgtacttggccccacgtggtggctcacgcctgtaatcccagcactttggtaggccgaggtgggcggatcacgaggtcaggagatccagaccatcctggctaacacagtgaaaccccgtctctactaaaaatacaaaaaattagcggggcgtggtggcgggcacctgtagtcccagctactcaggaggctgaggcaggagaatggcgtgaacctgggaggtggaggttgcagtgagccaagatcgggccactgcattcctgcctgggcgacagagtgagactccgtctcaaaaagaaaaagaaaaaaaaaaaaaagactgtacttgtttacattcccatccaaaagagagaatattcatttacataatgagaataatcattacacatctcaccaacactggatattatcagtcctttaatttttgcaaatctaatgaataaaagtatattgttcttttatagattttctgtggctactaatgaaattgagcatgctttcatatatttattgattatttctatttgttctgtgaattgcctgtttatattgtctttttctctattagattgtcttattctttttagtttgaaggttctctccattacattatgatattaattctttctctgtgatatgtgttgcaaatattttttcctggtctattgctggtctttatttacattgtcttaaatcatacataaggttttaattcttttttatttttgattttattttatttttttttgagacggagtctggctcttgtcgcccaggctagagtgcaatggcatgatcggctcactgcaacctcagcctccttggcttaagtgattctcctgtctcagccttccgagtagctgggattacaggcatgggccaccacgctcagcgaatttttgtatttttggtacagatggggtttcaccatgttggccaggctggtctcaaactcctgacctcgttatccgcccacctgggcctcccaaagtgctgggattacaggcgtgagccaccgcgcccagccttaactcttctgtcagtcttttctgttatggcttctgaagtttgtgttttgcttaggaagggtattcctaccccttagaagacgttatatgttttaaattttcctttcaataatttgatagtatgtagtgtgaattaggtttataactttaagagaatttccagtagtcccaacacaattaaatagtccatcatccttttcctactgatttaaaatgccaggctgtacatgggtttgcttctgaattctgttctactccttggatttttttatttttggtccatttgtgtgcaaacaccacactgttgtgattattgtagcattatagaatttttaaaaaaccttatgaggccagctgggtgcggtggctcacgcctgtaatctcagcactttgggtggctgaggtgggctgatcgcttgaggtcaggagttcgagaccagccagaccaacgtggtgaaaccccgtctctactaaaaatacaaaaattagccgggcttggtggcgggcgcctgtaatctcagctactcaggaggctgaggcaggagaattgcttgaacccggtaggcagaggttgcagtcagccgagatcgcgccactgcactccagcctgggcaacagagcgaaactccatctcaaaaataataataaaaataaataaataataaaccgtatggggccaaaaactgtgtattctaccttcttttttattttattttactttgtggatttttagtagagacggagtttcaccatgttgaccaggctggtctcgaactcctgacctcaagtgatccacctgccttggccttcttgaagtgctgggattacaggcgtgagccactgtgcccagcctctaccttcttattatctttcctttttctttgcctcagtagtttttgttctcatacttttcttgactgcttttatacatcttctcccaggtgaactttagaataaatctgtcagttccataaaatatcttataagtattttgatcagaaactcattaaatttatagtttaatttgagtttcatccaggaatatgatgtgttccttatttatttttgtcttcttttaatgtctttcaataaaatttacaatttcttcatataaatcttggacatattggtgagtttagttgcatgtattttacagtttgcttgctattgtacatcttccaccatgtctttctatttggttatagttggtgtataggaaaaggattaatttttgtggctgatcttttattaaggctttactaaaatatagtattagttttaaattttacagttcttagattttctaagttgaaaattaaatcacttgtaaatagtgatggttttatgtatttctttgtgatggtctttctttttcttgtcttattgcactagttaggacttccagtgccatatttagtagttgcaactatagcaatgaaagctgccatatttatcttgttcctgacttcaataggtatggtgaatattcttaacaaattaaataaattttcttctattactggttttgcgagagttttacattttttattttgttttttatttgttttcctgcttgcctcttaaaatcaggaatggatattaaaatatatataactttttgaaggatcttttcatggtgatcatgaggttttacctcctgtaaactattaaggtaatggattatattaatagatttctaaatacagaaccatcccctgcattactagataaattttatctagtcatgaaaattgtttttttaagaacagttaagtctaagatatttgcatttatgttcttaagtaagctagtagtcttctttatttatgctatctttgtctattttttatattggagcaatattagtttagtgcaatggttctcaaatgtttggtcttaggacccatttgtcctcttaaaaattattgaggatccacagagaactttgtttatgtaagttacctatcaatgttagaaattaaaatggagaaaattttaaaacacaagaatatacaagcatgcattttgttattaatagttgccagagcaatgacatcatcacatggcattccattagcctctggaaaactccactttacacttgtatgagagaatgagagggaaagagtcaaaacatcttagtatcattatcaaaatagttttgggtgtgtggactcccagataagtctcagggatcttcacatatccctaacctacactttgagatctgctgatatggcagaatgagtttaccattcttcctatgtactaaaataagtaacttagaaattatttatgtgttgaaggtagaactcatctgtaaattatttgaaactgatggtttttggaatggtatatctttgcttatcatttccatttcccctacagttaatgttctactcaggttttatatctcttcttgggtcaatttgtaaatttatgtatactggaaaatcatggaatttcatgtagattttcatttctttaagagtaaagtcatgcttacattacaatttttagattttctattgaaaattaaatccccctttttttccttctaatactatttacctgtgtattttctcttttattctcatttggatttgccttgggtttaactattttattgctgtgtgttagtgtgttttaaagaacattttttggtatgattactcaagtttattgtttttttgtttgtttttcagtctatctttactaattcatttattttggtgggtttttttttttaagtcagatttattgaggtataattcatatatagtaaaaaccctttacagtgtacagttctgtgagttttgacaaatacatataatcatttaaccaccaccacaatcagggcatagaagagtcctaccaccctcaaaaatcccttcattcccctttgtagtcagcctcttctctcctggcatcttgtttcctgttttggtagtttcttcctttttgttactgagtagtattccattatgtggatataccgccatttgtttatgcgttcaccagtcaaaggacatttagattgtttccagtttggggcagttatgaataaagctactataaacatctatgaacaagtttttgtgcaaacgtaagttttctttattcttgagtaaagaacaatgagcagaattgctgggttaaatggtaagtttaagtttgactttataagaaattgccaagccattttcctgtcattctctgttcactagatttgcttactatttgttttgctctttcctttgcttctgtcaaatctctgtttttgggatgtgagtttagactccttactatgattccctttagcgagggcataggacacaccaaaatgcctcaagcacaaaatgccaaggaggacacctcagtgacaggatgggaaaatggaatcataggagggagaggagaaaaataagaaagaggaaaacggagagcaaaagaaggggaagaaaagaaatgaaaataaaatgatgcataggaaggcagcggtgagtgcatggagctagcagtgagactttctaatagtcttgttgccagtctcctgggggctcatggggctctcaaagaaaaatttatgggatggaaaaaatgtggtagggatttaataaatatttgattaactgattgattaattcattaaggagcttggtattttaagtaggttataagaaacaagtttgttagaactgcaaaggcatgaactggagacagtaaaaacattgaaaaccacatggaaagatgaataagttgagagagaagaagaaccctgaaaactgatctaatggtctggaataagaagaggggtcggcactggagataatcaactagtcataaaactacataaatacaacacagattgttttggaataaacacgggaacttagtgaagatcaagggtgaccttctgagttctctagctctagcacgtgccatctgtccctgactgacacctgaaccgatctcagaacaccctggggccagacagctaagtgatgaggaaggagtggtactgagggagtgtaagctttggggtgggagtaaggggtaaattaaatgcctccaaagatccctctagctttcagatcttgtgatgcttgtgaaaatattgctagagtgtcatattcttagaataaggattctcttaatttggagaaaggccctaagaccttcaaggggaaagaatacacaaaagccattgggtaatccaagccaagacaattaccattagtctctggaggtgtttaatttaagagagaaagaagttcctttccactgaagaattaatggaattatttggttaccaagggtccaatgttcctattatgaagtaaggtaactgcatgttgtagaagaaggaaaaaatggtagcaggacagatgtcttttcccttcagattatatgaattttgtgcatggctttcacattacattaactatgagtttagtccttccctcacaagaaagatcattcacttttcagagtgccggaaagcccatggagttgagatactatataaatgtcatgtgagaaatgacattaaaaagttgcactatttaagaaacatttattaaggacctactaagcactgggaactgttttaggcactgggaatacagcagtgaacaaaacagaccaagtccctgtcctcaaggagcttcgtaagttttggtaggagcacatggggtcaaggaagtcttaagaaaggagtgacatttgctgcacttcctatctgttgtctacgtggcagccagaagatttctaaaatcacaaacctgaaaacgttattcccttgcttaggtctcaccaatggctcccttttgcttttctgatgaagatcgaacttatattgccatggcctgcacagtcctgcagggtctagccctctccctctctggcctcatacccctctgtctcttccatctggggtaggacatcctgcaatcccatcacactggacttctttcagtttctccatcatgtcacccttccttctgcctcagtgtcttagcacccgctgttccctggatctggaacacacgtccccccaacccctcctgctcctacctatccccaactgccgccagtcttgcccagttacacccacgtatccttcagctgtagctccaatgttaattccttagagttttcccaaccgtttccccttccctgcaagctatatatactctcccaacaccctcccaacactctaccttcctctctcctcttcctcctcttctctgccccttcccttgaacactaaacaaatgaacacacaaataaatataaaatagtaaattgagataaatgcttcaaaggaaaagaatagcttatcataacatttcaatagggaaacatcattttatatatattatagaaatatattagttcattcttcactcaataggtgcccagaactatttgttgaatgaatgaaaaaatgaatgaaaaaaattatgagtaagatttctccaattagagagggagtgaagataattccaggcaaagaaaatgacacagagatactgaagcatgaatgaagtaactggcagatgactagaaagacgggcaagagggactggctcctttacaataagatggtaaaggtaggcgggatactacttataaccttggattttttttttttctggttgagagtaggggtagatggtggaaattaaaagtatttaagcaaggaagcgttatatttagatctgcgttttaggaagatagctgattcttcatctagggctgttccatgtctgaaattttaagttctgaaacagagaagtccttctcattcagcattgctactaggttgcttaatcaaagtcagttaaagtggtacatcataaaaagtaccacatatactacatatatactttcaacattgcattctaacttagaaatgcacaaccacttgctagtctttgggtagagtgtcagggccttttatcaagtgtggagtccttgattcctgaacaaccatatccatattgacttgtctacggattttggcttcggcttctttacaatagaacaagaaagccaggtgtgatggctcacgcctgtaatcccagtgctttgggaggctgaggtgggaggattgcttgagcctaggagtttgagaccagcttgggcaacatagcaagaccctccctctacacaaaataaaaaataaaaaaattagcagggcatggtgtaggcacctgtagttgcagctacttaggaggctgaggtggtaggatcacttgaacccaggcgttacagtgagctatgatcatgccaccgtactcccagcctgagcagcagagtgagacactgtctcttaaaaaaaaaaataacaagaaacttaaatattcttatgaaatagcctctgcacagactccattgttaggatttttccagtttttttttttttttttactaatatcataatggttaggacagtctctcaagccagaccacctgggttcaaatcctggatgtaccatttcctaacttgggtaagttgcttagcctttttgtgcctcagtttcctcagtaaccacttcagagagttattgtgaggatgaaatggctattttatataaagccttaatatactgcctgatacatagtaaacattcaataaatgttaactgttttctagttgtcttacccacacccaattcaatagcatttaaaaaagagatttacctttatgaaacttcccaaagtatctgatttagtgttcttagaaacaacagttctctttcttttcgcacgattggtttacataatgtttaattaaattatgtaaatgtaataactactaccacaggaataaagaaattttggaacaatcacagtgacttacactcagctggtaaaagtggaagtagtatatgtgtgtggaagagtggcctgccagccgtgagcattcagagcactgtgtccattaactggaacatattacagctggaatggaaagttttagttaacccagtaagtcagtagggaagaggctggttaagagagcatccactcttggacgacagcctctaccttgcagcttcctctctcccttgctcctgttataactgtgctttcatctcattgactgcctagatccaagccagacctttaatgtcccaaagcaccaaaaaagagaatgttcccttatgtaatttaaaatgaaaacaattctaacttgtaaaataagtgtaaggaagttcaataaatttctgacttttaccatggtgattcttttggtgggtttttttttaatttcaaggtttttctaaaaatatgttgtgggggttcactttgctttttggatgccctaagaatgtgtttatctattgagtaatccagcactgcctttgacgcttccatttcttcccaacctctcagccttctcccagaattacttcctttcctactgagcctacatctcatgatccaccacttttaaatgctgtcttgccaatgtcttctacccaatttccttacacacttgtcctcacacagaaccccccctaataaaccccccaaaactggtatactgcatttgagataactttgtagcttccaggtaaaaatgtccaaaaagtagtcagacacaaaatctgaaacccaggagacgaagtaagggtagataaaggaatttggggatcttcgaacaaaaaagtgagatttgatcctgtgcaggtggaccacatggccaaagaaaggcatgtagagtgggaagagcaagagctggactgagaactctgggaacaccactgtgtaaggggtaggtggagcggaactgccgatgaaagagggaatatccacatgcaaggaagcctgaatccaaggaaggagagcttcaggaaggagtgattatggatgtcaagtgtattaaagaggtgaggtcagattagacaatacctagaacctagtaggttctcaatgcatacttgctaactgatggattcaccaagaccgaaacagtcaggaagtcactgatgatcttggtgcttagtttgagttttcctaaaagtggaccctgagacgaggattagtctatttgaaagatgaagaacactggtgtgtgtgggagagggggatgaacagggaggggacggccagtaaagggtgaattaagccagcagccaccctgggcaattatagcttaatcccaacgggaaagttcagggagtcagtgcagaacacccacctcatcgttcctcgtctcacggggtgagggagctctttcaggtcattggttgagggctgttcttagagggcattaattcactgacatttccagcctgctgcttgggcagcagaacagaccccggctgtgagagaaatccctcaggtgaatgaatgcaggtaccagcgcctggaagcctggggttcactgaagtagtaagggcaggggatactggtagggcagtgacatcctctaacacctggtacctgcagtttcactggcagaagctagactgctgtggagcagtaggaaattggaagtgagaagtggaggaaatgggtgtaggtaactatttcaagatgtttggctgaaaaaataagataaaaaatatgtcagtaggctgattctgcgaagggtaggaaaaaacagggtaaaatgggagatcggagagttcttcgatcattgagggttcattgagggttctcacaaaacttccctgtttttagttaggggagaggaggtcagctgcactaaccacttcttacttcaggatcctcttttagcttccccagacaagcgcccagtgtttcctctgctagactttgggtcctgggttccccagctaaagaggccgtgctggtacagcctcacatgctagcaattctaagcctgaagtgccagaggaatagattgaatatagctgcagagcagactgggacacgtgtggaacacggtggccagattctgaaccctaggagaaccacaaggtcagaggagaccttctgaggggtctgccgctgctgagggactccttgcattcctggccttcccccttccctgtcagcacatctcaataattagtttggtttgggtgtaacagacctgccccatagaaggaaccttcctgggacattcatctaaataactctttgattgatgtctctctcttagctaaagcttaagctcccgggggcagggacggtattcatttcagcactattgtatccctagagtctggtgcctagtcagtactcaataaatattgcatatttaatgcaaaaatacccagcaacaggtaatgctgtctattgatggtgcctacaccaagaaaaaggtaaaaccaggatttttatccttctagaagtggattttctatgcagttaatgaatttaaacttacaggtcccttacttgcatgaactcctttaaagaccctggaagaggccttagtgatatttttacatggttacattttttcatgttgcaaaaataaaatactttaatcaaaattaagactcttgttttccgtctgagttcatatttcccctcctggagcggcgttggagtggctgtggatgttttggtgatctgtttcaggaaaagcagagttgggagtatattttatatttagtttatttgagtatattttgtatttagttgatgcatctgtttatgtggtttgcggtctcttctgtgtagagttaacttactcctgcctgtcctggtatataaatggctctcaggagtactgctactgcctactatgctaattaactgggtcaggccatgaaggtgcatgatgagagcttgtcaggggacatgaatgtgtcctatgatgctctgcaatggaagagaaacaaagcttaaaatgtatggatccagaaactagtcctcacatatgtaaaattgtaagtgaaaattttagttcttgttaatggctggtcaaaatgaaacctcgcatctgtcaggaatacatcttaatgcagtgtatacaattgtaaatgtatcatatttttttcttttcttttttctttgtttttttttttttttttttttgagccagagtcttgctctgttgcccaggctggagtgcagtggtgccatcttggctcactgtgacctccatctcccagattcaagcgattctcctgcttcagcctcccaagtagctgggattacaggggcacaccactatgcccggctaatttttttttcttgtatttttagtagagatgtggtatcaccatgttggccaggctcatctcaaactcctgctcaagtgatccgcccgcctcggcctcccaaagtgctgggattacaggtgtgagccaccacgcctggacatatatatattttttaatgggaatcacatgaaatggaatttattaaaattcctgtgtttatagtgtataagtctgtagcaatactactaacaatgagtgcattcttatgtgaagtatatacacatctccaaaatattgaccaaaggtaacataaaactcataatatgtcgctataaccaggacaccaataataagctgtaaaagagtatcaataaagtctgagaatattaaggaaaatttgaaaggccatgaaatcttacaactcctatatgaaagaaacttgatagaggtttccccaaatttcacattaatccttgacatttatataacagtactagtaaggggttttgaagtggaaagaaattctctaagctatcagttataaacaaattttggtcaacaatggtagaaaaaagacaggattttctattttctttatagaaaaatgaagtatagatgcttcaaaattgttcacatgaagagtcagagtccacagcttagaaaatacaagaaaggccgggcacggtggctcacgcctgtaatcccagcactttgagaggccgaggtgggcagatcacaaggtcaggagatcgagaccatcctggctaacatggtgagaccctgtctctactaaaaatacaaaaattagccaggtgaggtggcaggcgcctgtagtcccagctactcaggaggctgaggcaggagaatggcatgaacccaggaggcggagcttgcaatgagctgagattgtgccactacactccaccctgggccacagagcaagactccatctcaaaaaacaaaaaaagaaaatacaagaaaggccgggcgcagtggctcacgcctgtaatcccagcactttgggagactgaggcgggcagatcacctgaggtcgggagtttgagaccagcctgaccaacatggagaaaccccgtctctactaaaaatacaaaattagccaggtgtggtggcacatgcctgtaatcccagctcttgggaggctgaggcagaagaatcgtttcaacccgggaggcagaagctgcagttagctgagatcgcaccattgctctccagcctgggcaacaagagcaaaactctgtctcaaaaaaaaaaaaaagaaagaaagaaaatacaggaaataagcacttagaagtgtatcaattaatttaaaattatgtcattggaatatttttatgatgtttctcattttcctcaacctttaaaattttgtaattgttgtgaaatgatttgtcgttctaataaatactcacttttgaacctaattttatatttgtaattttgtttctttttttttttaagagagtcctcaaagtcatatgctaagcttcggatgccacagaatgtgaatctgccccatatcctccttatctgcctggctttaggtggtttgggctgtaaagcaatatcatctcgagtccaaactatagacaattggtgtataattggcttccatgtagacattttagatgtctcctgacctctttctttgtttttagactaacttgagtttccagaattaaccaggagctgagagccactcccttctaattcactcatggagtttgagctttaatcttcctgagcctcctcattctagactcaccctgagcccaggctccagggacagagtctttccttttccacagggtaacctctagaatggagacagttgaagaggagaggaagaaggtcacatgtgtgcagaattctaatctggtgattctttggaggggtgcctcctaattggttcagttggcatatcttgcagagaaatctgacagaaataagaaaggagggggcatactatgaacagttgcagaaaatagggatatttagcctagagaaaagataccacttttagagtcctatgtcagcagctcttgccacaacaacattgtataacaaacttactcagaattcagtgtcatagatgatggatgtatatttcttgagtgtacagttgtatagatcacctgagattcagcgagtctaggctgaggtcagatgggcctgactctaagctgtggattaggtccaggtctgttccatgtgtcctttattgtccttgaaccagcagctgccagaggcatgttcttctcatggtgagaggcagaagcccaagagaccaaggcaaactttgcatgtgcatctttttctttttctttttttgtgcatatctaaaatctctacttgcattatatccgctaacattccactggttaaaggaagtcgatggccaagcccaaagtcagagggtaggaatgtcacttcatcctgctttgaagactaagcaagtcatatgagtaaagcacatctgtgtggcagagaagatgggaggcagaggaatgaagggaatggatatttgatgagctaatatgccacaatagctattatatcaaagaaacagcaactttcctcatctctcattcagtcctcaacccacgaaagcctatcctcactccccactcttaccaaaatcattctcttactgactgcctcattccatctagaatctgatttctcttcttcattctcactacattgcttgcctagattgccgctatagcctactaactgctctccttgtctctggtctcatcctttcctgattcatcattcatagagctgccagctattatccgtatctcatcagcatccacatcatcattattgttacctattttgcattatacttactggtttatgtgcctggctccttcattatactgagagtgtctggatggcaagaaatgtgttttatttacctttgaatctccagcaccttacacagggtctgacacatagtaaaacttcaataaattaatgtgaaaagaaagaatcaaagaaaggagatggggtttcagttcaagtctgcgtgacctgaaaacccatactgtttctacactatcataatatatctttagtcacagctgtgttgctgataaaaataaggacacagctcaaaccctcccactgcgacaccagtggaaaagcaggttactgaatctagattaactaaagattcttcctcccatagtcacaataatccttcccaatcctaattcctctcaaatggaaaggtctagaagccataaaaaaattttaatggccataaatatattaaatatattatattaaatatataaaaaaatgatcaactttactcttagataaatccatgtgccatttttttttttttttaggtggaccctcgctatgtttcagaggctggcctcaaactcccgggttcaggtgatcctcctgcctcagcttcctgagtagctgagattacaggcatgcaccaccacacctggctgcaatatgccattttttacctatcagattggcagagatcaaaaaggttttaatagtgcacaagtataccttagagatgttgaagattcagttccaggccaccacagtaaggcaaatatcacatcaaagcgagtcacatgaacttttggttttctggtgcatataaaagttacatttatgctatattgtagtctattaaatgtgcaatagcattatgtctaaaaaacaatgtacacaccttaacttaaaaatatttcattgcttaaaaatgctaatgatcatctgagccttcagcaaatcatatttttgctagtggagagttttgccttaatgttgatggctgctgactgatcacggtggttgcttaaggttggcgtagctgtggcaatttcttaaaatgagacaacaatgaagtttgccacattgactttttatgaaagatttccctgtagcatgtgatgctatttgatagcattttactcacagtagaacttctttcaaaattgtagtcagtcctctcaatctctgccactactttatcaactaagtttatgtaagattctaaattctttgttgtcatttcagcaatgttcacaacatcttcaccaggaagtggattccattttaagaaaccactttgtttgctcatccataagaagcaactcctcatccattcaggttttcttatgagattgcagcaattcaactacgtcttcaggctccacttattgtaattctcgctattttgaccacattcgcagttactttctccactaaggtcttgaaaccctcaaagtcatccatgagggttggaattaacttcttccaaattcttgttaatattgatactttggccccctcccatgaatcatgactgttcttaatggaatctaaaatgatgaatcctttccagaagattttcaatttactttgcccagatccatcggaggaatcactatttatagcagatatagccttacaaaatgtatttgttaagtaataagacttgaaagttgaaattactccctgatccatgggctgtagaatggatgttgtgttagcgggcatgaaaacaacattcatattcttgtacatctccatcagagcacatgggtgaccaggtgcattgtcaataagagaaatattttgataggaatctttttctcttagcagtagatctcaacagtgggcttaaaatattacgtaaaccatgctataaacagatgtgctgtcatcatggctttgttgttccatttatagagcataggcagaatagatttagcataatttttaagggccctaggatatttggaatggcaaatgagcactggcttaaactttaagtcaccaagtgcattatgcacctaacatggtcaatctgtcctttaaagctttgaggcattggcttctcctctctagctttgaaagctctgaatggcatcttccaatataaggcagtttcatctacattgaaaacacattgtttagtgcagccaccttcttcaattatcttagctagatcttctggttaacttgcagcttctccatcagcacttgctactccaccttgtaattttctgttacagagatgtcttctttccttaaacgtcatgaggcaacttctgctagcttcaaacttttttttttcctcttttcttttgagatggaatttcgctcttgttgcccaagctggagtgcaatggcacaatctcagctcactgcaacctccacctcccaggttcaagcgattctcctgcctcagcctcccgagtagctgggattacaggcatgcgccaccacgcccagctaattttgtatttttagtagaggcagggtttctccatgttggtcaggctggtctcgaactcccagcctcaggtgatccgcccaccttggcctcccaaagtgctgggattacaggcgtgagccaccgcacctggctgcttcagacttttcttctgcagcttcctcacatctctcggccttcatagaactgaagagagttaaggccttggtctggattaggctttggcttcagggaatgttgtggctggtttgatcttctatccagaccactaaaactttctgtcagcaataagactgtttcatttcttatcattcatgtgttcactagcatagcatttttttatttcttttaagaacttttcctttgcattcacagcttggctaactgttcagcactagaggcctggctctcagcctgtcttggcttttgacatgccgtctttactgagcgtagtcatttccagcttttgatttaaagtgagagatgtgtggctctttctttcacttgaacattgagaggtccttgtagggttattaattggcctaatttcaatatcgttgtgtctcagagaatacggaggcccaaggaaagagatggggaaatagctggtcggtggagcagtcagaacacacacaacgtttattaagtgtgccatcttatatgagtgtggttcatggcacgccagatcaattacaatggtaacatcaaagatcaagaattaccaaaatgtgacgcagacacaaagtgagcacgtgctgttaaaaaaatggcactgatagatttgctcaacacagggttgccacaaaccttcaatttgtaaaaaatgtaatgtctacaaagtgcaataaaacaaggtatgcctgtaccggtgaaaggtgtggaaagagacattcgcatatattgctaatgagagtgtaaattggttcaacctctatggagggcaatttggcaatatctatcagctcttcctgtactgatatggaaaggtctctgatatatcttgtgtcgtaagtgaaaatgcaagacgtggaagcggagtgcattattgccttttgtgtgtgttgtaggaagataaacagctatatatataagttattgcttaggcaagccctgggaagatatacaagaaactttaatagtacttgcgtttggggaggggaattgagctggaaaacaagagtgaaggaagatttatttttcattatataatcttttgtatcttttaaattttgttccatgtagaatagaattctttaggccaggcgcagtggctcatgcctataatttcagcactgtgggaggctgaggcaggtggattgcttgaagtcaggagtttgagaccagcctggccatcatggtgaaactcggtctctacaaaaaaatacaaaaaaattagccgggcatggtgatgcacacctgtgatcccagctacttgagaggctgaggcacgagaattgcttgagcctgggaggcggaggttgcagtgagccaagatcacaccactgcactccagcctgggcaacagagcgagactctgtctcaaaaaaaaaagaatagaattgtttagatgccaaaaacaatatcagaagatcaacaacaaactggaaaacatattacaacataatatgacaaagggctaatttctttaatctacagagagtttataaatcagtctaaaaaattaacagaagagggtaaaggatatgagaactcattttagaaagaaatataaatggccaataatcatatgaaaaagatgcctaatttatatattattaaaggaaagaaaacccacagggaatcctttggagaagaattgaactctattattagatgtgtttaagtagagaataaataaccaattattaaggttgttgttaaggagtctctttgaatcatctgataaaggaaaggtttccaacatctgaaggaactaattccttccaatccgtagggtctttaattctttatggtacccagtggaggtgtatagataaggccaggcaaaccagcctaagaaaaggaagggaaggaaaataatagaagttcacctagaaagcacaaatctcagaaatggaagggatcttggagttcatttttcaaacctcccccctaatacatttcctcttgggacacagtcccagatctgccacttaacaccactgagcaagtttattggtatattattcattcattcattcattcactaaatatttactgagttccttctatgtgtgaggcacagtccctgtcctcatggaaacaggcattagtcaaatgtaacattgcaactgtagcaggcactgtgaagaagaattatgcagtgctatgagagcctgagtatgatattacccagacaaaaatttttgcaaagttgaactgattaggatgaataggcgtttaggcaacagagaggaaaaacagtaggcagaggcaatcgcaggtgcaaaggccctaccaggagggatagtgacaagcactaggttgaaaaagactgaaaatagtatgaaagtatagtacgaggtgaggctgcagaggagtctgacattaaggagttcttactcttaagaacaatgggaatcccttaaagggtttgaatgggatgaaggcgtaaaggacacacatcctgatcagagtcacatttgaaactatgtctctggctgcagagtagagaatgcattgcagggaaacaagagcagatgtgcagaggtgagtaaggaggcagataaagtagacaggagatgatgggtgcttagaccaccatggtagaagtagagcaatgtggacataagtgagagatgttaggaagtaaaattgttaagacttgatgatggattccatctcaagagtgacaaagaggaaggaaatatgtcaataatgcttcctaagattttggcatgtgcagtggaatagatgagacagataacaatggaagagaactaagtttggaagggaatcacagttcagtttagaacatgccagctttgagatgcttttgagagtacacatcagtcagttggcaacatttatttatggagtgtctactaagtagctagtagtggaatatacaggtttatttatgtgtaaaaaagaaaaataaaatggatacacacaattcccccttcttcgagacccttgctgttccactattctactgtcttctcgcttctgtcattgtctgttctctgacagtctccactcctcctcatttgttggatggaatgatctgatccctcacatttgtagtttcttggcctgttaatttctatagacctttaccaccactccacttcactgtccagtcccatgtccacactgtgaacctcatcactaagaactcatcaaccttaaacttcttgctctctagctggacccttctgtccttttggctctctcatttccctcccgtcctcttcctgcatcctcctcatttactttcctatttcttcccttcctattatttcaaaagcttgctggaaggatttcctctctatcgtggcctgacaaataggagacattcaatgaatacttgagaaggtgaccttctccgcttctttatctcccattcattcccaacccactggacttcagcattgacctccacctccactaaggctgaggcagggggatcacttgagctcaggcattcgaggctgcagtgagcagtgacccgctgctgcactccatcctgtgtgacagagtgagaccctatctcaaaaaaaaagataaaattcaccattttaatcattttgaagtgtacaagtcattggctgagtgcagtggttcatgcctgtaatcctagcactttgggagtccgaggctggtggatcacctgaggtcaggagttcgagaccagcctggccaacatggcgaaaccccgtctctactaaaaatacaaaaattagctgggcgaggtgttgggtgcctataatcccagctactcaggaggctgaggcgggagaatcgcttgaacctgggaggcagaggttgtagtgagccaagatcgtgccactgcactcccagcctgggtgacagagcgagactccatctcaaaataaaataaagtgtacaagtcagtggtttttagtataatcacaatgtcattcaactatcaccaccctctaactctggaacattttcatcacgctataaagaagactcatactggccaggcacagtggctcatgcctgtaatcctagcactttgggaggctgaggtgggcggatcacctgaggtcaggaattcgagaccagcctggctaacatgatgaaaccctgtttctactaaaaatacaaaaaattggctgggcgtggtggcacatgcctgtaatcccagcttcttggagcctgaggcaggaggatcacttgagcccgggaggcagaggctgcggtgagccgagatcgcaccattgcactccagcttgggcaacaagaacgaaactccatctcaaaaaaaaaagaacaaaaaacaaaaacaagaagccctgtacttctcaattccccctcttctccatctcctggcaaccactaatctgcttaccatctctgtggatttacctattctagacattgcacataaataaaatcataaaacctgtggccttttgtgtctagcttgtttctcttaatataatgttgtcaagttttactactattgtagcatgtttcaatacttcattcctttttatggtttaatagtattccattgtatggatgtaccatatttggtttagccattcatcagttgatggaatggatcttgtttccaccttttggctattataataatgttgctgtgcacattgctgtacaagtttttgtgtggacatatgttttcagttctcttgggtatatatctaggagtggaattgctgggtcacgtgataactgtatgtttaacattttgaggaactgccaaactcttttcgatagccactgcaccatttacaccattcctgcatcagccttgcatgagggttccagttttcctgggtgccacttattttctggtttgtttttttgttatgttttgtttgggattttaaaaaatagccatcctagtgggtgtaaagcaatatctcattgtggttttgatttgcatttccctagtgactaatgatactgagcatcttttcattttggggccgtttgtgtatcttctttgaatgtagagtctttttgaaaggcaatctcatcaggttgcttcagtactgaacattttgaatggttcccaattgcctacaggataaaataaacatttctgagtgtgccacacaaggcccttcaggatctggcctcagccttccggtccaacagcttctgtcactctccttctcacactttctgttttagctgtgttgaactgaggagaggtggggatattttgcttttgtttcctttttttgtcaaactagtctgcaacaatagaggatgtcaaccaaagttaaggaatgcagtgagctgggccagcagggtgacgggatgggtgcgcgtgcctgtggctccctgccaccttgcctttctccctctgatccttcttgccttttgcttctcggcagcactcactttgccctaactaggtcacatacgttccggacaggatgatattcatgtctctagaccatactggaaggttctggctttgaggttttcctgggctgtgaggtgtgtgtttccccacgtcctctgctttcctgggactacactaggcagggcaggaggaggcaggtgggcagaggaatagcagccgtttgttctggaggccccttccttctcccgtcttgactgcaaagggctggaaagtcagcttctattgtgattaagttataatttaaggcagtgaacatgtgctctgctggcggctataaagattcaaatcataaagttttacagtggaacggtttctgtaaaagcatcgttaggaagtgggaaccatgcctttaattcttatgacatatgggactgcctggtttgttttggtttcagtggagtttagtagggtgatggtctgactaattaaagtcagaccttcttcctctccacaatgcggtgccccatcacaggacagtgtagaaaggtggaacttttctccccatctcagctcatcagggatggcgggggcggggggcggggcgggtctcagaaatcaggagtaactctttgaaaactaaatagtttaaaatctcttccaacttactaggcttcatttcttggggagtctatgtgttcctctgttcctttctggccaggggcaaacctcaacagtgaaccaagcctgattgaagataatttccttcagaggggtcagctgagaagataattgggctctgtaactaggtcaatggtagaaacaaagagaataataatatcgtagctatctcatccaacttccacctaacttacatgcctggttaaccgacactctgtatatcctgtataaaacattctaactgatgcccacgacatactattggctgatggttttgctagtatacagtatggccacttactgccattcccatgcgttatcttgtgtgcttaccataactcagctgtacttgtttctaagcctctttataccagtgctagttattattgcaattacctaatttcattaagtacagtcggccttctgtattcacagattccgcatccacagattctaccaaccacggatcaaaaatattcaagaaaaaaaataaaaaaataataataatagaccgggtgtggtagctcacgcctataatcccagcactttgggaagctgaggcaggtggattacctgaggtcaggagttcaagaccagcctggccaacatggtgaaaccccgtctctactaaaaatacaaaaattagctgggcctagtggtgtgtgcctgtaatcccagctacttgggaggctgaggcaggagaatcgcttgaacccggcaggcggaggttgcagtaagccgagatcacgccattgcattccagcctgggtgacagagcgagactctgtctccaaaaataataataataataataataataataataataataataataataggctgggagtggtatggctcacacctgtaatcccaacactttgggaggccaaggagggagaatcgcttaagaccaggaattcaagaccagcatgggctgcacagcaagaccctgtctcttcagaaaatttaaaaattagctgtgtgtggtggcatgcacctgtagtcccagctacttgggaagctgaggcaggaatgtcacttaagcccaggagttccaggctgcagtgagctatgatcacaccatcgcactccagcctgggtgacaaggcgagaccctgtctccgaaaaaataaaaacaaaaacaacaatacaaaaataaatataaatataaatataagaactatttacatagcatttgcattatgttaggtgttgtaagtatctagagattatttaaaatatacaaaaggatatgtgaaggtcatatgaaaatactatgccaccttatataagggaattgagcatccaagtgttttggtgtctggagggtctcctggaactaatccgccatggatacgaagggacaactgtattttgtaaacgcagtgatatacaattggagaattttttttttctatgaaagccaagttgaaaattatggcgaatccctaaaataattgctgttgaaagatatgtgggtaagactgaggaaaaaaaaatcacaacagtctaggaatttgcactctaattgctttaagttcttgttccactaaaaactaaaattgtagacaatgtgttttgggtgtgatttatgcaggaaagatctgaaaagccagtcagcagacacatacctttggccctacatcaaaaacttggagaatgaatctatatttatattttttaagttaaaataaaatgttcaggctgggcgcggtggctcatgcctgtaatcccagcactttgggaggccgaggcgggcggatcacttaaagtcaggagttcaagaccagcctggccaacatggtgaaactccgtctctactaaaaatacaaaaattagccggcatggtggcgcatgcctgtaatcccagctactcaggaggctgaggcaggagaatcacttgaacctgggaggcagaggttgcagtgagccgagatcgagccactgcactccagcctggcaacagtgtgagactcggtctcaaaaaaaaaaaaaaaaaaaaagttcaaggtaagtatatatctctgtttaatgatatacaggacttttcagattaatcatccaatgcattgaataagagagtttctctgtaataggatttatcatctattgggtgccattattgagtgtattaatctctacagaggctgggcgcagtggctcacacctgtaatcccagcactttgggaggccgaggtaggtggatcatgaggtcaagagatcaagaccatcctcgccaacatggtgaaaccctgtctctattaaaaatacaaaaattggctgggtgtgttggcgcacacctgtagtcccagctactcaggaggctgaggtaggagaatcagttgaacctgggaggcagaggttgcagtgagctaagatcgccagcctagtaatagagcaagactccatctcaaaaaaaaaaagaaagaaaaagaaaaaagaaaatcagttgcagaagaatatatacagtatgatatacatgcttataaagttccaaaacaagcaaaactaagcaatatattgcttaagaacatatatatatatttggtaagctataaagaaaatagggacctgagggggagaaaaatctgagatgctagttctgtgggtgggatggggaagtagggacttggggtccagaaggagcacataagagatgccaactgtgagtagtcatggtctatttcttaagtgggatggtggttcacaaatgttcattttattgggcttcataactttcacgtaactcatatataatgtttaataaaagtttaatgccttgaagaaggaaaagaaaatagaaaagtacggagattaaagtcaaagatcttgacttgaagaaatttagagttagaaaagccagaaagccaaacctccagaaacaatgagcttagctgggtagttgtaccgggatccatgccctgactgctgtttctaccctgtccttaggagaagatctccaggcttcccaggccctctttctctcacagtgtgtggtctgtggccctagaaatattgcaaagactgttattgagaccttgtagttggggcagcaaatactacagggaggaagcttgagagagcctagggaaggcagatgttagagtcactgggttgtgggcttgcaaccatcaggctagagatagccttgggcttcaggtttctgtcacagccttgaggcaagctctgtgtgtctgtatgggatttttgtgagcgtgcttgtgttttcagggtggatagactaatcaaactttatgaaaaagtttgctctggccttagcagaaacagcagatggcctgagctgcatctttgacccagagtcctaatgctggtccagaagcaagcagggaaagtgtaagcaaagagcccatcagttatgtgttttggccaaattggttggttaagctaccaagcaagcaacctaattccttgggaagcacagctcattaggaagggaacaaaatcattcttattaaaaataagaggaatggaaagaaattgaattacattttctaaagctgctcaaagagtatgcaaagtgtttcctaacatatgcatatgaagttcattcactcacttaaaaaattctttcattcagtaaatatttactagcagtccagtatccaccagtcttaatcctacactttgggaatgcattggtgaataaatgaacatggtcccttcccttgtaaggcttatagtccagtggggaaaagaagtaaacatagaattatttattgttacaaatgcggatgaatgctgtgaaataaatcgcacaactatctagaataatagggtgatctatcaagagtggtctctgatgaaatgcatttaaattaagaactgaagttaaggcctgcaatgagcaaggacatttcaaaaagaaggaacaggtattttaatggtcctgaggcagaaaaatgcttgtttgcatttgaagaatgagaaccaatcagctattgctacataaaaagcatccacaaaaatctcctttgcatacaacagcacttacttctcatgcatctgtaggtgatctgatctaagctcagcttggccaggaacctctgctccttgtagtaggtctaatccaaagatgttcattctgcagcttaggctgaatagacagtagctacctggggagagctcttctctccaggaggaccaagcacacaagtacatgcttgggtcacatctgctaatgtgccattagccaaaacaatcacaaaactgagtcaaaagtcaagaagcaggtaaacttctccatggaggtagttggggagtaaatgtttttgaacaataatctaatctacaacagtacatttctttgtgaatattcacatccctcccacctgcaaaatacattcacccacaatcccaagactcccccagtttttatttcatttatttattgagacagggtctcgctctgtcacccaggctggagtgcaatggcacaatctcggctcactgcagcctctgcctcctgggttcaagcgattctcctgtctcagcctcccaagtagctgggattacaaggtatgcaccaccacacccggctaatttttatatttttagtagagacggggtttcaccatgttagccagtctggtctcaaactcctgacctcaagtgatctccctgcctccgcctcccaaatgcagcctcccccaatttttactcaaatcatggtacttggcttaagatccaggatcttatcatctgtatatcaggcctaaatatggtttctcttgatctgaagacctaagaacttaaaaaaatcccattcaacatacagtggtagaatacaggatagcagcaataaattattccattcaaaaaaaaaagggaagaactgccaggcgtggtggcttctgcttgtaatcctagcactttgggaggccaaggtgggtggatcacctgaagctaggagctcgagaccagcctggccaacatggtgaaagcccgtctctactaaaaatacaaaaattagctgggcgtggtggcacatgcctgtagtcccagctactcgggaggctgaggcaagagaatcacttgaacctgggaggcagaggttgcagcaaggtgagatcatgccactggactccagcctgggcaacagagcgagactctgtctctaaaaaaaagagagagagagaaatgaaatcagaaatcgccagtccatagcagttctgaaattctactgggcaaatgttgacaggtcccacggtcctaggggttgagaatgctctctgattaggctctgattctggatctcccatccattgttccccgtggctgttggtgcactcctctggaagaccttccttttctatcatccttggacatcacccatggacacttctgaaaaagatattaaataatttttgtgggtgagcagcttttttcagcctactgcctacttgtagaaatttggggccccagaaatctttttacatcttcaatagtctctgtttctttccgttggagcaggcagtctttcaccaatacagctctctcacaaactttgtggatttttttttttttttttagacagagtctcactcagtcgcccaggctggggtgcagtggcgcattctcggctcactgcaacctccgcctcccgggttcacgccattctcctgcctcagcctcccgagtagctgggactacaggcgcctgccaccagtgcccaactaattttttatatttttagtagagacagggtttcaccgtgctagccaggatggtctcgatctcctgacctcgtgatccgcccacctcagcctcccaaagtgctgggattacaggtgtgagccaccgcgctcggccaactttgtggatttttatgtgttttatactcatcaactctatgtaccacaagccacacccacaatttttacaagacagaatctaccgagacttaagtactgggaatgtcaggctgctgtagaaccttgctcttaagttttctacaagcttcattttcagctgcaagagcctattagatgccatctgatttccttcagagcttaatactcttgattttgacttcacctggaaacagtatcgttcttgccgcactctggattaggtctttagccccaggatggatcttaatttgaaaatctcttactagagagattggagatgagaaagttttatttttcaaccccacaaattctgggttctctatattcccactgaatcctgcttgcaaactagccagttttctgagtttatcactttcttgttagtgcttcatcaaatacagctaaaagcagccagctcatgcttgcaatgttttgccttaagatcccctccttcacctttgctagtttataagatacgtttcctgccttccaaattattgtagtttagtcacaagtttaccactaaataatacaagttgctattattcccggcttttataccagcttccttgctgcccacttgcctagtcccaaagccaatgtcacatatctttgtgttttgttgttctagttataacagcaccttgctatttaaaatgactgcaaaggcagggcacagtggctcacatctactcccagcactttgggaggccaaggcaagtggatcacttgagtccaggagtttgagaccagcctggccaacatggtgatatgccatttctactaataatacaaaaaaaatcagccaggtgtgatggtgcatgcctgtagtcccagctactcagggggctgaggtggaaggaacgcttgagcctgggacgtaaaggctgtggtgagccctgatcgtgccactacactccagcctgggcaataaagtgactctgtctcaaaaattaattaattaattaattaagtgattgcaaaagatgaaatgaaaatgaatggtgtaaaagagagaaaataaaagggcacagacccaagccctggataactctaacatttaaagatgtggtagaggaaaagaagaaaggagtctgagaaggaatggacaatagagatcataaaaccaaggaggaaaaaggagtgttttaaaagagaaaatgggccgggggcagtggctcacgcctgtaatcccaacactttgggatcacttgaggtcaggagttcaagaccagcctggccaacatggtgaaaccctgtctctattaaaaatacaaaaattagctgggcatggtggggcacgcctgcagtcccagctacttgggaggctaaagcagaaaaattgctggaacgtgggaggcagaggttgcagtgagctgagattgtaacactgcactccagcctgggcaacagagtgagactccgtctcaaaaaataaagtaaaataaaataaaatagaaaatgatgagttacgtcaaatgctcctgggagatcaaggacagagatgtacatgtcttcaggatttggcaatatggagggcaataggtcactttgagaacagtttagtggaatgacagggcaaattcaagttgacatgaattgaagagctaatagggggtgagaaaatgtatgcagcagatgtagacaacaccttggaggtgtctggggataaagaagagcagaagactgagcgtggtggcatacgcctgtaatcccagcacgttgagaggctgaggtgggaggattgcatgagcccgggagttcaagaccaggttgggaaacatagtgagactccatctctgcaaaagaattttaaaaattagctgggtttgatgacgtgcacctgtagtcccagctacttgggaggctgaggcagggggaatcacttgagctcaggaattcgaggctgcagtgagctgtgatcgccctgctgcactccatcctgggttggccatcatcctcagcaaactaacacaagaacagaaaaccaaacaccgcatgttcttactcataactgagagttgaacaatgagaacacatagacccagagaagggaacaacacgcacacagggcctgttgggagctggaggttgagcggggggtacttagaggatgggtcaataggagcagaaaccaccatggcacacatacacctatggaacaaacctgcacgttctgtacatgtatcccttttctttggtttgtttttctttagaagaaataaagggggaaaaaaagaagagcagaaaaatatgatggcaagtggagaggatgtggaatcaagagagagaacttttttgttcttgagagaagatagcagtgcatgtgtgtgtgtgctggtggaagtgatccaggcaaagaaaaagactgacagtcaagaaacagagatgatgaagcagtttaaaagacaagaagggatggaatccagaccacttgtgagggattagacttcagtcgtaagagggtcattctctcagttgtaacaggagagaacaaggagcagatgaagttaattcagagataagaagccaaaacaatgagcacccgcttttcctgggtgcctgctctgtgtcaggcattgcaccagaagttctgcatgcagtacttgggccccttgattttggttttatttcattcccattttacagacaagaaaacagaagcttaaaaggttaattttcctaaagtttctcaacttacaagtagcagaactgggattcaaaccccatccatctgaccatgaacccatatttgatttctattccaaacagattcatttttccatagagaaataatgttcaaaaaatgagacaaaactaagaatacacggcctgcagaccagacctggtctagtctggatccctggggctcccttctcaggggagcaggaggggtggagggcagttgctgtggtgaagacatttgaaggaagtggggagagaagactgatactaactccagtccgttcaccttttagatactgcatatttttcaaagaatttttgtgttccttctctcagtgagcaatgaatagcttcagtggagctagaaatctttctgtaggaagaaaggagctatgctctggttgtcatgaggcatttgagttctaggggatctgaaataggattcttcacatttatccttggcatagtctagggtaattcagtaaatttttttttttttagacagagtcttgctctgtcacccagtctggagtgccgtggcacaatctcagctcactgcaacctctgcctctcagattccagtgattctcgtgcctcagcctcctgtgtagctgggattacaggcatgtgccacaatgcctggctaatttttgtattttaatagagacagggtttcactatgttggccaggatggtctcaaactcctgacctcaagtgatctacctgcctcggccttccaaagtgctgggattgtaagagtgagccaccacacccagcctttttttttttttttttttttttttgtccagatgggatattgctctgtagcccaggctggagcgcagtggaacgatcgtggcttactgcagcctcaaactccgggattcaggcagtcctcctgccttagcctctggaatagctagaattacaggtgcacaccatcgcgcctggctactttttctatgttttgtagagacagggtcttgctttgttgcccaggctggtctcaaactcctgggttcaagccatcctcccgacttagcctcccaaagcgccaggattgcaggcatgaactaccatgcccagcccaagcatagtattaatacacaccttttaaaaggatgagttccatccctttgcagccggttagacctgttctaccttgctcaatgtcagaagcccagcttttaaatactgttctagatcagaagggaaaccaaatgaaaatgtgtggaagaactatgtccaggctcacagcactattttagaaagcatctcaacaatggagtcaggaaagggagaagtgccatgcccatatcagaaaatatactcatcatactaacatgtacagtgctttgtgctcattcatttagcagatactgagctagtaccaggttccaggcccagagctagctaaaggggtatggaggtaaatgaggctcttctccagaccttgaagaactcctgagctagtgggctagcaggttactctgaagaggtgttcaatgaagatatgtctgaggagctatgagaacatagcggtggcaggctagataaggggtcagatcagagagggccaaagagtataagcagtggtgcaacttgatctgatttgagattatgatttatagtttgcttttgcatatttcattattttgtttaaatcagatgttcatagccttccctcttaggattttttctgccttgagccttccaaaacgtatcagaatgcagcttgtctggtgtgtgagaaacccctgaagctgtgagccccctttccaggagtctgggctcactgctagccttggccctcctaagccccttacccttgcttttcctaggcaagcagtgaaatgtctccaaaatctgggaataactgtttcccagccttgggctggttctccttccttccttgttcttcacaagctgtagagcctcctgaggtggggtcgaggcatctcattttcagggtttattagggtaggctaatgactacatccaacaaatcctttttagaaggcagtcacatagcggtgcctttggaattcaggttgagccgtcccctagggttcaggatccccctgctggatgctgtaactggcatagaagaaaaaaaagagcatgaagggtcaagtaggagacttttattggcccaggggaaatggcttacatcacctccacctacgatccagtgagtggaattcctatctaactgcgagggaggctgggaatgcagtcgagctgtgtgcccaggaagaagaggaagaagtgagcacatagcaaactgccgcacagtgggtagaactgacaaagacagtagactgctgagcaccagtgagtacgaaggcaacagccacaggatccccctgtggccgtgtctggagacatagcacgtacttggggctttaggtgggaggactggcagaggccactccatgaacgaaaggaggctgggcaccaggggctgagtaagaactgttttgaacagaatgggagctgactcacatctggaggagggttctcaggtggggtccctcggtattgctgtaactgggtcaatctgattgtctctcttcaacctttttcaaccatggtaagcacgaatgccctaagccattgactgtaattaatgaatttctctcctatgcatctggattgtacagtctagatgtacaagttgtactatccttgggagaactaagaaaatagttgctctgacagccgggcacggtggctcacgcctgtaatcccagcacttcgggaggccaaggcaggtggatcacaaggtcaggagatcgaggccatcctggctaacacgatgaaaccccatttctagtaaaaatacaaaaaattagctgggcatggtggcacgtgcctgtagtcccagctacttgggaggctgagaatcacttgaacccgggaggcggaggttacagtgagctgagatcgtgccactgcactctagcctgggcaacagatcgagactccatcaaaaaacaaagaaaagaaaagagttgcttaggtaattgttctgtctttgtggctcagttgaggaaccctggctgagaaacccctgcctgaagagatgcaaacagcattttatatttgaggcaaatgctctagactattctctccctccccccaatctcctgcgccctgaaaggaaacaaactgatgtcatgagaaattcctttctaataacaaaaacaaatgggaggtctcccgggattgttcctatggagagacagtggttgtgtaagaatgagaaaacagtgactcctgctcagggttctggttaagtagcaggtagaatttttccaacatcattttgaatcaagagaggcaccgaaatcactgtagtaaaatcttcgagtgggaaaaatataaagaaaacaaaatccaactaaggccgtttttccccaggaaaggcattagtcaggcagccgctggagccagccacctctcaagagcctgtttttcagtgtcactgcggtgactctccatgctctgggttttaattctagcctctaatctcagtcgcttctgtgataaattaattgtaataatagaggccccagttacgaggtctgcaccgtttgcttgtaatgtgagcgacaggtttagggcctgctttatttaagatgctggggtaattacatgggagttagcatatgcaggcagagatatgattcattcttccagccacaagcatgacacagctgtttgcgggataaaataggggaaccgtgttgttacaaaatgttccccttattatacctcattaaaaacaaggctgtgataagtcaggactggcaatgaagaaaatctattgcccctctgtaaaacctgataggagagggcttagagctatgctgtgtcattttattttttatttatttttacttttttatttttttgtcctttctctgactcttttctccctattattcagcaactctctgaatacttggggaaggaacagtctcccagaccgtcttcctttcttcttatgaaataggggctgccctttccttgcttagctaaagctgagaatgttcagaaagagcattcgcccagaacaaagtgaaaggggggggcctttgggcgacctgtcccaattttgtcctcatcacctttaacaggagcacataggctgagagagctcagaggctccagcaggggccagagcttcaaagtcagagaaaatcacgggcaatagacagaggctcattcctttcaagagacagacatatgttctcttcccccgtcatctttctttttaaaaataactttaaaatttaaaatgaattttggcctcatttttcttcttcttttctctctctccaaggttactagtgagagcttaaaccaacatgcagattaacattgatctatggacccagggccaaataaatcaggctggttttttatcaaaatggttggttaggaaaaataagcatcacagtatagaatagtcttcagcaatacctacctagggccattccagaagagctgttccatgacacgtccatgtgtctgttgaacggtaaagcccacttgggaagccatggagcttcatggctaagagtgggctgggaagcttgactgcctgggttcaaatcttagctccaccaccacctcctagctgtgtggacttgggaagttgagccaatgtctccaggagtcaatcttcacaatctaccaaatgaaattggcaataatattatccacctctagggttgttctaaggaataaataagataatccatgcaaaaagcctagaacaatgcctggcaaacagcaagtgctcaataaatgttaactattattataagtaacacaattaacagcagcaaactgctttagcccaggttgtgtgttagaattagaaggacggtttaaaaattgtcatccaggtgcggtggctcacacctgtaatcccagcactttgggaggctgaggcgggcagatcatctgagatcaggagctcgagaccagcctggccaacatggtgaaaccctgcctctaccaaaaatagaaaaattagccaggcatggtggtgcatgcctgtagtctcagctacttgaggggctgaagcaggagaatcacttgaacctgggaggcagaggttgcagtgagctgagattgcgccattgcactccagcctgggtgacagatcgagactctgtctcaaaaataaataaataaataaataaataaataattttaaaaaataaaaaataaaataaaatggtggttgctgcaacagaagtaaggactataccctgatttgtgacccttttgcagaatttgggttttgagagtaaagtctcaaaatttaggatggagataaagggagagaagcccctgggcatccttgtttgtttgagttataaagtagggacgtgggccgagcatggtggctcccacctgtaatcccagcactttgggaggctgaggaggatggatcacttgaggtgaggagtttgagaccagcctggccaacatggtgaaaccccatctctactaaaataataataataataataataataataataataataacaataataataatacaaaaattagctgagcatggtggcacacacctgtaatcccagctactcaggagactgaggcaggagaattgcttgaacctgggaggtggaggttgcagtgagccgagattgcaccactgcactccagcctgggtgacagagtgagactctgtatcaaaaataaataaataaatataaaaataaataaactagggacctgctcactttagtaataggagtatcttagagtggtagccttttggcactgcgatttttttttttttgagacagagtcttgccctttcacccaggctggagtgcagtggcatgatcacagcccactgcagcctcgacctcccaaggctcaggtgatccttctgcctcagtctcctgagtagctgggattacaggcaagcaccactatgccttgctgattttttttttttttttgagacagagtctcactctgttgcccaagttggagttcagtggcacgatctcggctcactgcaaccttcgcctcctgggttcaagtgattcacctgcctcagcctcccgagtagctgggattataggcgtgcgccaccacacccgactaatttttagtagaggacagggtttcaccatgttggccaggctggtctcgaactccttacctcaggtgatccacccgcctcagccccccaaagtgctgggattacaggcgtgagccaccacacccggccatgccctgctaatttttatattctcagtagagacagggtttcgccatgtcataattttttatttttactagagatggggtattgctgtgtttcccaggctggtcttgagctcctgagctcaaatgatcctcctgcctcagcttcccgaagtgctgagattgcaggcgtgggccaccatacccagcctgcactgtgctctatagtaagaaatatgttttacatcatgactcagtacacatgaacaactgaaacaaaagtttcacaaaaatagtacttagcctttttctttttcttttttctttttttttttttttttttttgagacggagtctcactctgtcacccaggctggagtgcagtggtgctatcgggctcactctaacctctgcctcccaggttcaagtgattcttctgcctcagcctcccaagtagctgggaccacaggcgcacgccaccacacccagctaagttttcctatttttagtagagatggggtttcgctatgttggccaggccagtctctaactcctggcctcaagtgatctgccagccttggcctcccagattgctgggattgcaagtgtgagccaccactcctggctctattctattgtatttaattaaaaagtgctcattaccactctaggttgatatcatccttcaataatggatctcactttgcaagcaaaaggcacttggttagtaattgagttgaagcgttcttgtattctggaggaaaaggaacacatgaacatggcatgttcagggtacagcaagttctaaaacactgctggagcaaaaaaagttgtaccgaagaggtaggtaaggggccacgtgatataaaatcttatatagactacaaataagtagcatcagacaagcatttgatactaagagataatacacatttccgtataactatacatactatgaagcagaagatggtaaacactgtaagaacaattcgataagctgtcttgggagttcagaggaaagggagatggctttcagctgggagctcctcgtattctttgagattctgttatacaattgttcatgcattcatgtatttagtgaatacacattgagttcccactatgtgccaggcacttgcccttggctgtcatccatctacctggttaaaaccacatgaggatgacttagattttcagctgcctgttgcacatttttcagcacgaaaaagcaaaagtctttttctcgaaatctcagggaaagtcctggtgcattcctttggctttgattcacgcccattcctgaaccaatcattgaggccagggagaagtcatccttcaactgtgtaatgcctgggtcacattcatgaccccgcagttgaatgcaagggcagaatctgcttcaccagaatcccattggctgaaataggggaaagggtagtcttgaatatccccttttgtctcgcagctctaagtctttactcaagctgtttctaccacctgggaaatggtctatcatctctttgcctagctggtgtgttactatttgtccttacaaaccctgctcagtcgttatccctattgtaaaatgtactttgttagaactaattacttttttttctatgttcttttttgttttacacataattctatctttgaatttctatattattaaactaaaccgttcttcgtaagaccagttgagtagcaaaatatgaaatcaactagaaagggaaatactggatatgtttcttaaggatagttaaagataataaataaggtatcagccgggcgtggtggctcatgcctggtaatcccagcactttgggaggccgaggcaggtggatcacctgaggtcagaagttcaagaccagcctggtcaacatgatgaaaccccgtctctagtaaagataaaaaaaattagccaggcgtggtggcgagcgcctgtaatcccagctactcaggaggctgaggcagaagaatcacttgaacccagaggttcactgcagaggttgcagtgagctgagattgggccattgtgctccagcctgggcagcaagagcgaaacttcattccaaaaaaaaaaaaagaaataataaggtatcaaaggaggaatcacaatagaaattggtacctttaaatagataaaaatgaaaacacaacaccaaaacttatgacatacagctaaaacagcactcagagggaaatttatagctgtaaatgcctatactttaaaaagaagaaagatgttatattaataacttaaccttccaatttaaaaactgaaaaaaagagcaaactaaacccaaagcaagcagaaaaaaggaaataaagatgagatcataaataaatgaaatatagaattgaaagacaaagaagaacatcaacacacccaaaaattggttctttggaaagatcaataaattgaaaaaccattagctagaatgaataagaacaagagagaggactcaaattactaaatcaggaatggaagaggagacatcactaccagacttacagaaataaaaaaagcattataagagaatattatgtacaaatatatgccaaaaagttagataaatcagataaaatgaacaaatttctagaaagcacaaactgctgaaactgactcaagaagaagaaaaatctgcatagacctataacaattaaggaaattgaattgctaattttaatatttcccacaaagaaaagtccaagtccagattacttcactggtaaattctaccaaacattttagagaacaattaataccagttcttcaccaagtcttccaaagaatacaagaaagagggaacctttcccaaattatttcatgaagccactattactctgataccaaaaccaggcaaacatatcacaaaaaaataaaactttagacaaataactcttatgaacatatatatatatgtatatataaatctgcaacaaaattctagtgaaccaaagccagtgacgtataaaaaaaattatatactgtgaccacgtgggattaactccaggagtgcaaagttggtgtaagatacaaaataaatcaatgtaatataccatattaatacaagagagaacaaaagctatatgatcatctcaatagatgcaaaaaaaccatttcacaaaattcagcaccacttcatgataaaaacattcaacaaactaggaatagaaggggccttcctccatgcttaatggtgaaagactggatgcttcctccctaagatcaggaacaagacaaggatgtccactctttttttttttttacttttgagacaaggtctcactctgtcgtccaggctggagtgcagtggcatgatctcagctcactgcaaactctgtctctttggttcaagcaattctcatgcctcagcctcccgagtagctgggaccacaggtgcacaccaccacgcccggctaatttttgtatttttagtggagatgaggtcttgccatgttggccaggctgggcttgaactcctggtctcaagtgatccacccgcttcggcctcccaaagtgctggaattacaggtgtgagccactgtgcctggctggatatccactcttaccatttgtattcaatatagtactggaggttttagctagggcaattaggcaagaaaataacagtcatcagattggaaagaaagaagtaaagtcaataataaacagaatgactcaattttaaaatgggcaaagaatctgaatatttatctaaagaagatgtatgaatacttggcaaacccacgaaaaatattcaatatctttagtcatcagggaaatgcaaatcaaatccacaatgagagtctgctttgcacccattaggatgtatataatcaaaaagtcagataatagcaagtgctggtaaaaaatgtatagaaattggaagaaccatatgctcccgggggggtgtaaaatagtgtaaccactttggaaaacagtctggcagttcctcaaaaagctgaagatagagttgccatttgtcccagcaattccactcctaggtatatacccaaaagaactgaaattaggtccacacaaaaatttgtacactaatatgcatagaagtattattcatgatagccaaaaggtggaagcaacccaaatagccatcagctgatgaatggataaacacaaatgtgatttgttcatacaatggaatatttttagccataaaaggaataaaatactgttacatgctataacatggaagaacgttgaatacatcatgctaattataagacatcagatacaaaaggccatgtattatatgattccgtttatatgaaatattcagaacaggcaaatttatagagacagaaagtagattagtagttgcctagggctggggtgaggggaggattgggggtgactgtttaaaggtatggatttcaggggtgatgaaaatgctctaaaagccatttgtagtgacggcaagccaactgttttaatgtacaggttgagcatacctactgtgaaaatccaaaatctgaaatgctccaaaatctgaatttttttttttttttatatatggatgaggtctcattatgttgctcaggctggattcacactcctgggctcaagcattcttcttgcctcagcttcctgagtagctgggactacaaatgcatgctaccttgcctggctatccaaaatttttgagcaccaacacgatgccacaagtggaaaactccatattgacctcatgtgatggttcataatcaaaacacagtgaaaacttactttcatgcacaaaattatttaaattgttgtgtaaaattaccttcaggctatgtgtgtaaggtatatgtaaaacataaatgggcctggagcagtggcttacgcctgtaatcccagcactttgggaggccgaggcgggtggatcacgaggtcaggagttcgaggccagcctggccaacatggtaaaactccgtctctactaaaaatacgaaaattagccaggcatggtggcgggtgcctgtaatcccagctactcgggaggttgaggcaggagaatcgcttgaacctgggaggtggaggttgcggtgagccaagatcgtgccattgcactctagcctgggtgacaagagcaagactccgtctcaaaaaataaataaataaaataaataaataaataaattttgtgtttagacttggatcctatccccaagatatctcattatgtatatataaatattctaaaatcccagatccaaaaacacttgtgatcctaagcatttcggataagggatatgcaacctgtactaaaactactgaattttagctgggcacagtggcatgcacctgtagttccagctactcgggaagctaaggttggaggatcatttgagcccaggagtttgagaccagcctgggcaacatagggagattcccccacctcaaaaaaaagtaaaaactcaaataaaattattgaattttatgcttcatatgggtctctgtatggcatatgaattatatgtcaataaaggtatctattaaaaaaggaaaaaaatggcccaggcacggtagttcatgcctgtaatcccagcattttaggaggccaaggctggtggatgacttcaggtcaggagttcgagaccagcctgaccaatatcgtgaaaccccatctctactaaaaatacaaaattagccgggcatggtggcaggtgcctgcaatcccagctacttgggaggctgaggcaggagaatcgcttgaactcaggaggcggaggttgcagtgagccaaaatcacaccattgcactccagcctgggcaacaagagcagaaactctgtcaaaaaaaaaaaaaaaaagaatcatgaggacttgaactggagcagtaatggtggggatggtggagaagggatgaagggataaacttaagagacattacggggctagacaatctattagacttgctaaaaatatgattgatgtacaagcgagaaaaagaaattaattcaactagagatattctcagacatgcatgaaatagcatttgcagcattgtttgaaacagcaaaagtttgagacaacctaaatgttcctctctagggagcaggttaaaaaaatcataatttttttgcatggtacaggcataacatggagcaccaggcagccaccaaaatgaatgagacagctgtttagattactaatatgcagtgacctccaagacatattgttaaaaagaaaaaaaaaagatacagaacactagatttaatatgcctccatttgtggaaatgtatttgtttgcatatgaaaaaaatatctgcaaaagaaacagataaaattgtttcttgggaagcagactccaggatctgggtaaaaagaagacttttgctctttcttttggtacctttagaattttgaatcctgtcaatgtattattacctatcaaaaaaagtagatagaatttaataaaaacaaatctctaacttgtcttttaaaaagaagaatcacttcacaatgaaatttctaagatgcgtgcctgggagtaatgaatagcaccattaacagaaacaggccaagcacagtggctcacgcctgtaatcccagcactttgggaggctgaggcaggaggattgcttgagcccaggagttcaagaccaccctgggcaacatcgcaagacctcatctctaccaaaaatttaaaaattagctgggtgtggtggcacacacctgtagtcccagctactccggaggctgaggtgggaggatcacttgaggctgggaggttgaggctgcaatgagccatgatcatgccactgcactccaacctggacaacagagtgagaccctgtctcaaaaaacaaataaacaaataaaaccagaaacaaaagatacaaaaaaaaaaaaagaatagatttggctggcaagataaatatttttagactaccacagtgcttggcacagagcagttgataattaaatatctacttaattaattcagtagtgctaggcacgaaggttacagcaagatgatctctaagactgctttcaaagaatagatagtgtaatgggaatacagacaacttaaaaagtagttacaatgaaatggggctggtacagattgctttggaagcatgtagttagtaagggaacgtaacctaatttagttaggagaatgcaggagacctaaaaaatgaataaaagttagccagggattacaggtgtgcgccaccatgtccagctaatttttgtatttttaatagagacggggtttcaccatgttgaccaggctggtctcaaactcctgaccttgtgatctgcccaccttggcctcccaaagtgctgggattacagacattagccacagcgcctggcctgacaaagagctttctagcagaataaactttgtatatattggcccagaggtaagagggtaacagaaaatagatcgggagagctacagctctgggaagacagacatctgttttgctccctgctgtatcccagcatttagagtagtgtctagcaccttagtaaccactcagcatatgcttactggatggatgaatgaatgagtgaatgaaccagtggcaagagatgatgctggagaggtagacaagggtcagttcgtgcagggcttttatatatatgccttgctaagaagcttacactgaatcctaaagactacgggaagctactgaagaggggcagaacatgctcagatctgggttttagaaggagccgtgtagctgcaaagtggagaataaagagtagctgagggatagcccaggtgatggggtggacagggggaccatcctccaaggtggaaggacaaatcaatttgaaggggagaatgagctcagcttttgacaaactgaatttcaggtgcctatgggaaatcccagtgaagctggggatacagagagttttgtgaggatggaaatcagagggatctgggctgatgatagagagtcagagtcactaatatttataactgaagctgtgggagtgaatgagatatctctggaagagggatagacaggcatgagaatgaatgaattcatgaatgaatgaaatgcaaagccctgctctgaacagctttggctaaagacctgaggaatgattaatgctaaggaaaaaaggggaagacttaaattaatgaaccactgctccctctcaatcccatgctgcagagctgagtccaaggggaaaaagccacatgccccggcgtaggaaagggtgacttgtcacttcagcaggtcccacttttcacccctgcccttggccacctccacagtggcatggttttctagtccagggtggtgctgctgtgtagcagatgcatgtggtgtgggctgatggcccagagcacagctcttctctagctcttcccctccccccagcactgaaacagcctccccgtcctcctagcaagttgctaaaattaaaacttaatcaagccagctcacttggggatgtggaataattttgcagctcaccccagagagcagggaactgctggggcagacagtgtgagagctgcgggcggcacctccaccttcttgtggtcctcctccaaactcctgttggatggaaaaactgtgctgcctgcctcctgctggcttggtgattgcctcaaaggtgaagagtcctggcctgtaatgtctcctctgtgacactggcctagggatggggataggacccctgggacagtttcttctctggccagttctgccattttccctagatgctaagcaacggttacactagtgtcccctttccaataaattctgggccttcaagcctagaattcccaaggcatctctagaggtcccgttaaaacaatgccatcatgacagacatatttgatatgtttgtctcatcctttccagttgtgcctaccctacccacagtccagatactttcataagggtcttcatggttcttggcacgtatctatatgataatctccccttccctgacacacacacacacacacacacacacagagtattgcattgttaatacctggtcattctgtgcttagagaccaaggttttcctgtataaaacaaccctaggagtctcaaccaccagtgtgggataatatcctcaagtcttgagggaacatcaggtctcatcagggtgtgatcagcccacagtttgtgccagttcctttcatccgcctgtgggtgacaatcccttcttgtcccatcaccaccatgtgataatcctcgcctccagccttaatattgtctaattgtatgagacaatctgtccaaacaggtcttcctgtgttaaggtcagacctcgtgagtatgtgatcatccccatccctttccttggtacatgcaaatctctccattcccccaagttcaacaattcccctcatccctggttcatttactagccaccttattgagcacctactatactgctgcaagcaccccttttctcgtgtctcccctctttctgctggaagttgcttcctaattgttaggataaatctttctgcaaaggtaattataattcttctcatctgaactcccgagggatctggactggcgccaaaggcaaaggtgcttgatacttggaaagctgcttgtgcttccacgttaagcaaaaaccagtggggaaaagcctggcctggccaagtaggctgctggctggagccatggatcagccatggcctggccccgaccgagctctgacagtggttgcttccggagacccaggcgtgccagaaggaaagcaacatttactatgggatatatttggtgagtggcgaaggtccctatttctttcatttatagattcatccttccaatctacacttttttctgggttcctagaaaagaaagaaccattggcagatgtgtggtgtaactccagaggtccacatgctcttgataataccgtcctaccccaagctccagcacacacagcctcaccacccaattctgcccaagagtgtaccaggaccgatgtcaccaagctctccatttgcttcagtcactacacaagctccctgactcccaggaagccttcgttcctgtagggctctgtataccccattatctagtggtgctcaaccttgcttgcatattggaaccactaagtaaactttcaaaaatactgatatccttgaagtccccctccctgccagatcataaggaaattgattctggagcgcaggctcacaactgggagttttcattttcctggtgatcctaatgttgtgcagccgtggttgagacctgctgccctcatctgaccccatgtctgacccctcaactgccacaacccatcaaaaccctctataccagggattctcaaacttactatcatcaagtctttcaacaggacttgttaaaacatggatcgctgggccccacgcccagagtttctgattcggtaggtctagagacccccaaggatgcgcatttctgagaagttcccaagtggtgctgatggtgctgctgttccaagggccacactcagataatcgttttcaatatcctgctcatttggttccttgaccttctctcccccaataaacttgtcctctatcccacctcagtcacagactctgatattcatcccgaaatcttgtcattaccagtaattataccccttcctaataaccaacttaaacatcctgctctccaactgccaatttactcctggtagtgacccaattccaactccaatgggaaggactgcaccctattgaccctgcctgcctttcatgtcccccaccccatctcacctaacttctttcctaatgtagcttagattatcttctagtaattgtctccctgaatctcaccatcagagcttccctttctgctggaagctctgatgcacacaaacgtgcaaaaatatttaccatctattttaaaagccttccatttccccctgtagctacctctccatttctctgttcccctttaggtcaccccctctcctttcattctcaggtgaaccctcactagtcagatttttccctatccttcctgtgaaatggcttttgtccaggtcactagtgacctccctattgccaaatccaacagccagtcctcagtgcatatcatactcaatctgtcactcccgtcttctagaaacactttcctcactccgcttctaggacacaccctctgttggttctccttcttcctcactgcttgttcctcttgctggttcctcctcctttcagtgatgctaaactttggagtacccttgacttagtcctcagatttcccttctcctttatccgcactaccttcccaggtgatccctccagggcttcataccagctccatggtgactcccaaatttatatctctagcctagacctctcccctgaactacaaattcaccaactccactgcttactggacatctccaattggatgtctaacaggcagctcaaatgttaagtccaaaactgaactccttattctaactgcacaggatcaaatgattatgtcctttatctctaccctgcccgtcaatagccactccagtcttccagttggatcaggccaaaacattgaagttatcctggactctggtctcccacaccattcatactgcctatcagcaaatcctgttggttcccaaatctgacagcttctctccatctctaccacatgaccctggaccaagccactactactatctctcacctagacaatttcaacagagtccttaggttttcctgcttctacccttgttccggcccttttaatacataaatcaaattctgtgactcctctggcttgccattcgttcaaagtaagatccaaacctctctacaggcatgagagacctaccctctctggcctccctgccctctgggctcacaggctacacacgctgcccttgggtctccaccttagccttttagttccttaattaacagcttagagcctttgctcttgcagttcccttgggctggaagtctcttttctcagacgctccttcctatgtctaaattctgcctgtatctggagacttccctaacacacccccgctgccacccgcatctcacatactccccacctggcactctctggctccttgtcttgctctctttttctgggtggacttgtgtctgaaatatgtattgatttgctgattgtctgtctcacccactggaatgtaagcgctgcaaggagaactttgttctgttcactgctgtttccccaatgagcgtgtatgataggtgctcaatgagtacttgttgaattaattaattaatggaagcgtgtttagacctttcctccccagcggctgcagctctgtacaaggaggtgtcccaggctgcctgtctccattctctaatagcctcctggccaccacctgggcatccccctccccagagcctgccagaccattctaattgccgctgctgctgagggagggagtctctaaagagagaggagggagggaggagctccatctggtgtccaggaaaataagggagccagctttggtctgcggctccaggtccaccctggagtccacaacgtggggctcgggagccaggggcgaagcacccttcgggcatagacgggcccttggctcttctgtcctgtcagagagtgggcctgggggccccatagaggcccctcgatttggccaactgagcgggacccagcacaaggcctccaggctgcagaaggctgtgggggtgggggtgggggtgggggtatcgggagacaataggagagcccagagccagctctccctttccaccagcccgagtgacacagtgacacaaagggagagtcttgtgcttgggggagggggtggggagagccctttgtcccgctattttctacattgctgggggtggggagtgggaagggtgtgggggggtgaccagcggctgtcagtatggggaggagtagagagtggtgcagaggccctggaaagtttttgaatttcaatcaggttggctttgaaagagtttggcttttgttgaaagaaagagaaaggttaatgctagagttgagggggagggggtggattctgcagatagagtcctgtttgcaggccggtcagctgtgggacacccaggctggcagaaaggctggggatgggtgagcagaggaggagcaggcgtcccatttcccttcccgggcccaggtggaggaaggctgggcagagaagcatggggttattgggtgtgggcagaactggtcaagaaaggaaagcaatgcggccaagcaggacaatttctttcttccttttgcatgccttacagagcctttgactttttaagccaggaaagaatgaagttccctccctctctcccctccgtttctactccacccaagcacagcggcggcggcagagcacttgtcagggctgactttgtgacaagtgcaggcttggttggtgcaggagaggggggctgggtggcttgggacctcttagtgctcaggaatcagctgttttctccgctcttaccctctgctgaccctcctctgcactctaattgctccaaaaagaagcataaaaatgtggagctattatactctttgaaataggcagcatactgctttctcaatgttgggagaaaaagaaggaggaggaagggagctacagccacgcagcaggctagagatctgcaattccaagttggggagtgggcacctggcattccccagctgacttcacaccactgaaacacacacacacacacacacacacacacacacacacacacacacacactttgtaaggctcctggctgcagtatgatcctttgtctctctctctctctctctctctcacacacacacacacacacacacaccatacacgctcacacacacacatacactttatgaggctcctggctaaggctgccgcatgatccagtgttctgggagtcccagtgtattctgggagtctactggggcagtcagttctctaaatggcaccactgtgtgttctcagctctaggggttctacaaccataaagataactccagaaccaatccctgaattccagcctgaaaatatttgagaggagaaagatcagaggaagagggaaagagaatataaaaatgggattattcttattttgacatgtaataaccatctgcatggtattaggcctcatcttcctggagcaaatattcatgcactaaataatttgctcagcattccttgtgttagacattgtgccaggccctaggagacacagaggaaataagagctgtccctgccctgaaggagcttattcttaaacagaaaagcaaatggagaataaataattctaatccaatgagataatatcacacatgccacacaatacattgtaacatacatcacatttaacttcatttgacaagcgaatactacagaaaaacgtgtgaattattattattattattattaaattattattttagagacagagtgctaactcagtcgcccaggctggtgtgcagtgatgagatcgtaactcactgcagccttgacttcctgtgctcaagcgatcctcctgcttcagcctctccagtagctgggactatagaagcacgttgtcatgcctgactaattttttctatttttatttttggagagatggggtcttgctgtgttgcccaggctgcattttttaagatttcattgatattttttactttaatgttgggtgcatttgaagtgtttaccaagggccaggcgcagtggctcacacctataatcccagcacttttggaggcctagatgggcagatcatttgaggtcagaagttcgagaccagtctggccaacatggtgaaaccccgtctctgctgaaaatacaaaaattagctgggtatggtggcacatgcctgtaatcccagctatttgggaggctgaggcaggagaatcacttgaacctggaaggcagaggttgcagtgaaccgagattgcgctactgcactccagcctgggtgacagagccagatgctgtctcaaaaaaaaaaaaaaaaaaaaaagaagcgtttaccaaggaaagcattttggaggtgaaaacgtgtcccaccaagcaaaaagaggattggactccaaatgcaggccaagggaagaaagaggagaatgtccatgtgtgcatacattagtgtgctgggaagacctccatgcccacactgccctcatccaataccacattaaaagtattttgctggtttacttgtccatctgatttgcagccacatataatctcagacaccccctgttccgccctctgccacatcacctcccacaggagagaaacagctatcccaggccattctgttcccctttcaaggccagatctgaggtgaagagaaggcattgagaaagttaacccaaggaagaattttaggctagtgttttcaaagcttggaccaacagcatcagcatcacctgggaatttagaaatgcaaatcctcaggcgccaccctaggcctactgaactgaaagctctgggtgtggggcccagccatccgtgggttgttttttgttttttttttagacagagtctgctgttggccaggctggggtgcagtggcacagtctcggctcactacaacctccacgtcttgggttcaagcgattctcctgattcagcctcctgagtagctgggactacaggtgcgtgccaccatgcccagctaattgtttttatttttagtagagatgggtttcactgtgttagccaggatggtctcgatctcctgaccttgtgatccacctgcctcagcctcccaaagtactgggattacaggcatgagccaccgtgcccggccgccatccgtgttttaacaggctctcagatcattctgatgctccgtaaagttctaggtatgctgatcaatgttgccacccttggttagatcttcctgatgcacttcaaaaataacttgctctggtagaagccagggggctaatgggggccaatccagcccagcacctaagtcttttggttagttcttgggctaatctgcccaaggatgtggatatgaatggctgggacacggacacttttaaggaccccgttatctgggatgtctgggccctgacccttctgagccttgactggccccctgtgctcatattcagagcatgggacctggcagaagttcgaggggctgatccagtatggcaggtccctttgagagtcctcttagggatccgggtttgtgacagcacatgacacgatttggctctctggagcttctgggtgggcgggtataatgaaaggatggttagaattggaaagagcagtgagggagagagcaaagtcccctcttccatatctgattttgtaagcagcttctgatacctcagtgacaagatcccagcacctgtgtctcattggcatcagtatcttttttggcacagaccgagaatctctttttggaaaattcccttgccaaaagcacgtgaccatatctgtcttaagaagctggcacctatcctttttttcaaatttgtctctggcctctcttccctctcccaatgttccctttcaccttgagctagaaacatgtggtatcctcagggccatttcagattgatgcaaccacatcactggttctgacctgtaaaagtaaaggctaagaattcctttcagaggggaagaaaaactatcatgaactagacatgaaatagccaagcactgtgcccctcgctttccatgatgctcctcatttatcgttacagcaaccccatacactatatgttacttcccccattttataagtaaggaagctggagttgggagagtttgtccctcgtgcagcatcacacagcttctaagtggcagtcaggatttgaacccagatctgcctgacttcagagcacgtgtttgctgctctttaccacactgtatcaggagagatcctctaggtcctggctccctcccaggcaaccccaaggaaacaggactctggccaagtccacgagctttgtaggtcctggctggattccctcttggttagactctggtcaggccttccctgatttctcctggccagctggcctctccgcctccttggctctacgtgggctcctgagggagaaggcagagtgaagccaccaggcctctggacaggttgcagtcagcatccgttccatcacgcgttaacccctgcggctggcccgcagcagggaagccctcttgcctagctctgcatggactgctcgcttgcctgagtttgcattatttatttaatgtcttgtaccgtaaataatggtaactttatggttattaggaacgggttaaggtacatgcgggtagcaccaggctgccttcaaaaggaacagtcctggcataaaatgttgcgataattgcttcactgctgagtgttggtctttattttgtgtctgatttgtcccttaagccagcgtaacattctccccacggcaggagaatgcagagagcaaattgaagggctgagcatgaacaatgcgacatggcgcactgctgggtttttcttttttcctctttcttcgtttctcccttgacctccctccaatcctctccgctcccctccccccatgccctgccccagtctccgccctactctggttgggagaatcattctcccccatccttgacacctctagaaggtagcccatcatacccccttatttccttttgttgaaaataaggttaatagagcactcctattccttacctcttctctgggcagcaaacaagacaaaacaaaaagataaacacataaaagatgccttcttttcatggacccggtgcccaagcaatgcccaggcactctagcccagaagttattgtcccttacatttcttaaaaggatgtggaatcctggccagtgcccagcatcacagtggtcagagagggctgggtatgcagaaggacttgggagggtggcagggttgctggtggcgggtgtggaggggtgaagggggcagagtctgccagctccttcctgatagtgggagagagcgatggtcttcagtggccagtgggactcttcctcttctcttcggtccatcacaccaaggcaggaaggccactggcactggccgccatgtgccatacacatatttcccttgtctgcacaggagtggagtgagggcaggggtggggtgagggcctctccactcggggcagccttttggtttgccagaagtggatcctcctggccttcatctgtttgcccctgggggtcatctatcagcctccagcaataccctgcaggccggatggcccaagccaagtgaaacctcttccctgtagcagaaagcaggtccagcatctcccaaaacgggcgctctgactggctgggcttcttcgatgttcagagagcttggccaaagcacgaacactggagtaggagccagaagtcctgtggtcttgtctgagcttccccactgacttgcccggtgtggtaaattcatagacacagaagttccttggaaacgttctgcctcggtttcatctgtaaaatgagggcaaaaatccctgccttatgggattattggggagatcaaaagtagctaatgagtgactacagactccagaaccaatcatagattgttgatcacggagtctcaaataacccatcatgccctcaggccaaaggccaatgactatttctgggtaagtatgagaagcaggtgggactggaggggcagctggggtggtacaatgacaaggagaagaaggaggcagagatcctccagccccatagctatcttggagcagaaaaccagtgttgctgtcctccatggggcaggcatcagggcagaccacaggctgtaacccaccttagaggaatgccttcttctagcggccggatctcttccctccctccagccaaaaccccttcttctgctttggccctttctcttgccattcctcctcttcctctagggcttctccttggctacaatggaggggacaacaaagtccaagcaagttgatatccagtggctttaagctacaggaggctgagaggatttgtgtgtctctccacttactccacctctccagagcctagtaactcatcaatagcggaaatttgaacaaagtggagaacctgggatgaaaggagaaatgctgcggtgattgggggtggggtgaagggggaagaggggatggctttaattagggcttcttggcctcgtcagtcctggggttggtcggggtaatccagttagagtcccagcctttcatctcagctggccggcctctcgggggccctgtcagagcctttagggggcaacaagtagcgggcaggcttggagtggcgtgggggttgataccacacttacttccagctggacgcagaggggggtacggaatgaagccccgccagcacagcagttggtggtgagcagtgaagtggccggtgtgggcggcttgggcgctgggcggctgtctcctgacaccagaaactctctttatgaaaggatcaagtcggtagcattgttctctggccagggaaccaagggctcagaatgctcttttgtgtggaggtgcccccccctcaccacactcccccttctttttctccctttgagccactgctggctgtgcctctgcccccatgcttggggcgggaggcgatggagtggtggagatgggctcgggacagacagtcctgggggagccatctgtgctggggtaggatccactggagctgaaaaattaaacagcattttcaattaacttttcctctcttgtttgggggtgggcgtgtgggggtggtggagcaggctggttgaatttaacctttgaaaagctgtgtggagcagaggaggagggaatgacctttctttcccgaggcagggttgggcgggggtggggagcagtggaactgtttcctcgggccaggcgggggaccccctcctggtgaatattccagaagctcttggtgtccttggcccctgaggtcccatctgtgtagagagagggtttgctagtgcatctccagggtgttcgttgtaaggagagatgggcgagtcgtgtggggtcagcaggtggatgaaggcttactgccgagcaatggaaatctttttcacctctccctcaaaggctgccccttttctctacccatcttcccttctgctgctcaggaacgcctgcatcttagtttccgctcttgggctgggtgccccaaaagatggaagaacatccgtagaagggactctgctgtaggtggcgtttgctctaaaggcctttctgttcctgtctcattggcaccacagaacgtaacacaaccagaagtcagagtcagagtccagtgtgtatccttctcacatcttgttgctgcatgccctgaccttctccattttccctgagaactgggagcaggtcttcctcacccctctctgatctctttctcactccacatagtgaccagaagagggctttcacctcttctttagaccctcgtggtggaaaacttctgtcaccataatgactgtttgtacctgaagaacactctgtagtttgcaaagaactcatgagagtcttcttttaatctgtggggacagatggaaaggagtaagcccttttttatgatgaagaaactgggactcaagagagattaattttgaaaaatggggcatcccctggagggcacagcagcatcacttaggggtctttttcagttgtccatcccacccagagattccacggtcctcactcctcctgcccctaccttcaccccagagtagggtttcttaatgaaattatatcttttgcgttttcctttagctaaatacagacagtcccatttacgggtgtgaaaaatcaggaagtctactcaagtgagctgaggcaaaagaggtaataaagccaatggtttcatttgggttttcaccagtcctggtgtttatccgagcaacaaggaggatggtattagaaaataggcataggcagccgggtgtggtggctcacgcctgtaatcccagcactttgggaggcccaggagggcagatcacgaggtcaggagatcaaaaccatcctggctaacacagtgaaaccccacctctactaaaaatacaaaaaattagccaggcgtggtggtgggcgcctgtagtcccagctacttggaaggctgaggcaggagaatggcgtgaacccaggaggcggagcttgcagtgagctgagatcatgccactgccctccagcctgggcaacagtgtgagactctgtctcaaaaaaaaaaaaaaagaaataaataaataaaagaaaagaaaaagaaaatacgcataggctgggtgcagtggctcacacctgtaatccaagcactttgggagcccaaagcaggcggatcacttgaggccaggagttcaagaccagcctggccaacatggcaaaacgccatctctactgaaaatacaaaattagccgggtgtggtggcacacacctgtcatcccagctactttggaggctaaggcacgagaattgcttgaacccaggaggcagaggctgcagtgagccaagattgtgccactgtactccagcctgggtgacagagcgagaccctgtccaaaaaaaaaaaaaaaaaaaaaggaaggaaggaaagaaagaaaaggaaaagaaagaaaagaaaatcagcatagaatgattacaggttcaatgcctgttaccccaacactttgggaggccaaggcgggaggatcgcttgagcccaggagtttgagaccagcctgaggtacatggcgagactctgtctctattaaaaaataaaacaattagccaggcatagtggtgtgcacctgtagtcccagctactcaggaggctgaggtgagaggattgcttgagcccaggaggtcaaggcagcagtgaatagagatcacgccactgcactccagcctgggtgacagagtgagaccctgaaaaaaaaaaaaggaaagagagagagagagaggagggagggagggagaaaagaaggaaggaagggagggagagagggaggggaaggaaggaaggatatgacatgagctgctccctcagctaccccagggcacagtggagcagcaccttcctccccaaacctgttccttgtcttgtatttcatgctcagttaaggacactgctctctagcctcagcttggggcactctcctcttcctgggctaagttcagccaaactgcttttccttcagtttgtctaatacgcaggctttgcttttcaggacattaacatcaccctccctgactcttacccctccttcctgtctcagtgaattttactgctcaaagaagcctttctgtcccaatgtacattttgtcttccggttacactttctcatagcattctgtccttccgggatgtaacgtatcatggtttctagtggcacgatgaggtggggcagtagttaccatgtctcccctaccagtcgttacgcactgtgagcacaggtgtcctgctattttgttcactactctattcccagtgcttctgggaggcactaaggggcttaatacggtcaatgaatgaatgaaaggagaaaagggaaaggtagtaactcacagagaaaatgagcaaaatgaaaaccaagatttcccagaggtaaaggtgagaaagggttgttgctccgaggtctaggaaatttctttaggcccccaaaatggaggccagttggcctgaatggtgcagagaacactctcgcagtggggggatgacggggagtgatgtttgaggaccttttggtgaggcaaggaagcatgcagcccacttcagctttctccttatttttcaaaggtgccagtccatttttggagccctgaggaagagaaggctagagggagaacactaaagactacagccaattctgataaagaataagggaaaagaaaaggctttgcctgctggaatagctttgggtgaggtcaccatagttttctacaagataaagggattggctacaggagccaccagaagagagatccccgggcctgcgggcaagaagttgaaccctagagagaaactttcactagcgaagggttaaagggaataaatatgtttagcaatatattgagggtgaggggaaaggaaaggtgggggacagaccagtgagcatgtagactgctaataaatgaagagaagtgggagattcatcttacctcctacagggcagagatgctcagctcattttttagatcagtctttaagaagaaaaatgacaaaaaggaatttggataattaggaagtaaatgcagactgtgcaaaaatcgttcctgatagaaagcaggtaggagaatactcagaaaatgtaaaggtttcacaaatcagcaagccaggatgacatccatcatgagatattaaggctagtgttctgggaacatactaagcggggcgctgattgaaccacttataattatgtctggaaaatcatagaaagtaaaaggggccatcaggaggctggagaagtgaaacggatgtgactcctgtcttctaaaaaatggtaaacaagcctaaaaatgttcatccagtcagtttggaactagatacaatgaaagggggaaaaaatctgtcatctccgggaggaaagtaaaattgagaagcgtgtgtgtgcgtgtgtgtgtgtgtgtgtgtgtgtgtgtgtgtaagtatgcctaagggccaaaccacaccaaacagaatagcgctaagtgatcaaattgaaaacagaaaaacagatgtgttgtaatgggtgtgccacaagtggctgttgttaaaacaggttcaggttttcgctgtggttgtaggtatgtaaatgaaaactgcacagaaaagaaaaatcgatggcagggaatcattcagagagagggacactctctggatgaacagagtattctgaaccaatttaacataaggtctcattttggatggggagaaagctgcatgtaactgaaaaagctgataggtaggtgtggctgaggaacaattcaggaacctgaagaagtcaacaaccacatgaacacctaattatggggggaggcggtgggttgaaacaaatgaacatatttgggaggaaatctctgctcatccaaaaaagccataggaaggccctggaagctgccttgctttgggggttgcatgcacacaatttggatgtggagctctgggacctagaagggaggtgacacactggggtggtttcaaaaagaatggggacggcccctaagggggttagctgagagggagtggctcctcatggtaatgatcctaactgactccacagccccagcgccctacacacttttacaaggttaaagcaacagcttgaacctgtatggggtgagcatttgtttcctttccagattgccagctaatgaggaaagattaaaggagctaaatctgtttagcttggctaagtgacgacggaggcggcaggagtggagaggcatgctgggcagcctggccaagcggaggggtgtgataaccgtctgcagatttcaggaaggtgtaactacggtggaagaagagcggctgtctcaggtggcacaggggcctcacccttcggcagcgagtttcccaacagtgagctcggtggctcctggagcagccagttgacctgaggaagagagagcaaggattaggaacatcccggctgagccaagggagggaccaagccaacccacccaatggtccaggcactgtcccaacagaccagctttcattttgccttttgctagcagcatcctcagcattcccaagggtcttctctgactctctgcccccactgcagccaatcccttaagggatttggagtccagaaaggttcccccactttctggcctgtgatagacattcgcagtagctggtttggcaattcagaacctgcctgttctttgatgatatcttcagatagattattccaaggctatgagatcagaacctgtgcgaggagctcttctgggaatggaaataacttacccaaaaggggaagcaagtggcaaggcccagggtgtggcgtccctggggtcccgagcctggcccatgggggccagccaggctgcctcccgcatgcttgctgttggcaatctcatggttaaacacttaaacaatctttctttctcctcttttctctctcctcctctctctctttcactctcttcttttcagagttgacaggggccaaataaaggcccttttaaaaaaaaacacacaaaacaattttgttccttctgaaagtgatggagcgaaagtgagtgcagattataggcctgtgaggcgagggccttccagacggggggagaagcggtgacatgatgggaacctaatggcagtaattggccctggctttgacagggcccatatcacagctcaggaaaagagagatgtttaaagtaaaaatttacacaaaattatatgttttcggggtgaaaaagactgtttggatttcattttttttcttcctcttcttccccccagggcatgtttcatgggtcatcctctgcatgtgtgcgcgtgtgtctgtgtgcgtgtgtgcacacatgcccgtgcagctgtctccccaggtatatgggcatcttatgccacatcgccaatgtcttctacttccgctcttcctggaatagaggcgtttgttagctttggaagtttcccttcaggaagcagaaagagcctaagagaagaagggagaaaagaaccattcgagtaatagatcaggccacccttcatagtatcaccacagcagaccttgtttggattcaatatatagtcgtgtagcatcttgtatttatccttgtatcgcttagtcctaaatataaccaagtaatagatcaagtagctatatttgtttagtgtctaactcccactccaaactgtgagctctttgagtgcaggaccctgtttctcttgttaagtgccataatctcagcacctagcacagtgcctcccacgtagcaggcttgcaggatttgttaaatgagcggcctaaaataatggaattatggagggacagctgcgatgttggaagcccgtgccttcctgagtagaaaatgctgatcaatcagactttcgtctaactagacaatactagaatattcagataattgattcttcattgcctgttggaaatgtagcctgagaggaagacttcaggggttgcagtgaagctagaatattaggcattcgtccctggttcagaatggtttaggcttcctccattgtgagcttcactagaagctctacagtcaaaccccaactgactctttaatgctgatgaccatgctagtgttgaaacgatctcctcttccggcctgcagaatgtcctgctgctccctgttttacttgggatttaggtgttctctatggactaagctaagaactagccagctattgggctactttttagatttttttaaaaaagatatatcttttggctaacatgataacaagacccataaatgaaacaaaattgaatgttttattcacatgagctcaagggaagtacccgagtcacagaaccacagattggggagtggctttagaggttctgaagttcatgctttactagttgtgtgcataacctctacagtaacctctcatgctccagatgcaaagattggcacgtccagcagggcaggtagagtttaaagtcaagaagcaaaggggtaggagctgggctgaacaaggaccagtccttgaaaatgggtcagtcatgggggaacaaacacagaaagggaagacctagcaagactgttccagggagtggctatgaaggctggaaataagttctgaaaggcaagtccaggaggctggtgttgaatggaaatgtatagctatcagcagcagggaccaagccaacagtctattcccttcccattttgcctcaatgtttgaagaaaatctcagcccagacaaaccaggaggtttcaagaccactaggggaatccagaacacggggtggatgtcactggggacgggagaagggtagcagggtatagaatcaaatggaaatggggctcttagagctgtggcagttgctgagattaactgaggtcaacacaattgagtagatggttcttgaataatgtaggtgtagtttgtgtggtgattattgtgttaggtacagtaatagcagataaagttgtaaatgatccacaggattggcatgctctaggaatgaagaagtcattgcttgtggtgagaatacaggttcttaaagaaaaactgaggcatttggggtttcagaaccatttatttgtcccaacatttataggatgcctgctctattccaggtatcatgctgagtcaaagctcttcagacctactatttaatttgagtcacttcccttttattttccctttgtgtgatgaactgagggtgccagtataggggaaaatggctaacattccatccatgaaaatcacacagtatgagaaggctctcttggcaatctcagagttctccgagctctgtagatgctccaagagtctaggaaacagcagcagcttacagaagtttcctcctttgacatttagcacagagatggcaaccttgtccttatctgctacctctgtgtaggaatattaaaattgtaaattacatacactttcctaaaatacagtcctttcacccggacctgaaataaatgacttggcttcaggtgcctctgggtatcacttggcttgcccgtcagtgcggatctgaagatgagacgctaaaaccttcagatctgcctcccttgaatgtgatcttagctgctacaccatctccttctaaaaggatagcaaaggagatatgggtgttgtttgctttttcactcatctaaactttttgcttaaaattatggaatctcagagccttggagatgatgcaacatatttttaaataaactgcctcgtctaagttaagtgctggaaatacaaaggtttaaaaacagttctcctttaaaggaattcatagtctaccaaggagacaggccagccaaagaggtaatgtcaaaacactatggtaagtgctaagatagatgtaagatgcagcacctcctagaagaagcaaacacctaaatcaactagagaccttaaggaagacttcacagaattagcaaagcttaaaatgaatctttaagaagtttgctacgcagccaaagagcaaaggaaaggtgttcccagcaaaggacatggcatgatagttggatgcatgaattttaagtcaactattcctgaccccttgttccttaatatgtttagcagcttctaagaaatttgctgtcctcatttttgtgatagctgtgtgcagtgtataaggatagtgagaaaaagaaagggatcgaagaaccaccaagagaaaggaagatgggaggaaagtgaagggaaagaggaagagaagggaaaggaaaccaatatttatggagtgtctattatatgccatgtggttttacatgatctcatttcatattatttccattccatacattaagtcaatgtgtttcagagagatgaatgatttcttcacctaacttcacctttttgtcctctcctgtccccattctcatgctaaccctacctcagacctctctttgaagctccacactgcctatttaccaccaccacatggatctctaacagacactctgccctcaccagtccagaatgctgctcatcatttttcccaccaaaactgttccctctccccttttcccatggcacctccccatccacttgtccaagccagaaacctgggaatcactcttcagcctttccctgttcctcagcccctcagtctacctctaaatcctatctcaaatgcattcccttctccccagcttgcctggcaccgcccaaaatccaggcatcagcatctgtcctctgtcactgctggaactgtcttctatttgatttctcccttccatccttgccacttcccattctagcctctccacctggcagctaaggaatctttttaagagatatgacccctagagtcaagcccataatccttaacgcggcaagacctgccccctgtcttcccggacccccatctctcctcggggtctttcatcctgcccagttccctctctccagcctccttacatgactgcttcccctcatccttcagatcttagcttcaatgccatttcctcagagaactcgtcccagtctataaaagatttcacctgtttttttctttctttcttttttcttttaacctggcctttgactgttgtcatcaccgacttttctatttcttatctattgtcttcaagtgtgtttgacaaatgtagttagacatttatttgcctgtttagttgtttcatgtctgtcttgttcactaagtgtaagctctgtgagggcagcactgtgtttctttatatttttagagaccagggtcttgctctgtcatccagagtcatcaacactgtgcacagcactgagtagagagtaagcacttaaatgttatattttaatacattacatatttttgttaaaaaggaatattaaattaaatgtgttcaggataaagaagagcttggatttaaatccgcctctagggccaggtacggtggtccacacctgtaatcccagcactttgggaggccaaggcaggtggatcacctgaggtcaggagttcgagaccagcctggccaacatggcaaaaccctttctctactgaaattacaaaaattagctgggtatagtggtgcgcacctgtaattccagctacttgggaggctgaggcaggagaatcacttgaacccgggaggcggaggttgcattgagtggagatcgtgccactgcactccaacctgggacagagcaagactccgtctaaaaataaaataaaataaaatataaataaatccacctctaggctgggtgtggtggctcacacctgtaatcccagcattttgggaggccaaggtgggaggattgcttcaggccaggagttcgagaatagcctgggcaacataacaagaccccatctctataaaaaataaaaaaataagccagagcagtggtgagcacgtttaggcccagctactcaggaatctgagataggaggatcgcttgagctcgggagttggaggctgcagtgagctatgatcaccccactgcaccctactcactctgggtgacagagtgagatcctgtctctaaaaatatgcaaataaacccacctcttcctgatgccaaagctcatgatctttcctcttcctcaggcattcagtgggggaaaatccaacacaggccatcaggcagtgcatggtattcctggagtttgtttcagagaagagacagaaagcctttaaaaacaatcctgggccgggcgcggtggctcacacctgtaatcccagcactttaggaggccaaggcaggcagatcacgaggtcagaagatcaagaccatcctggctaacacagtgaaaccccatgtctactaaaaatacaaaaattagccaggcgtggtggcgggtgcctgtagtcccagctactcgggaggctgaggcaggagaatggcgtgaacccgggaggcagagcttgcagtgagccgagattgtgccactttcctctagcctgggcaacagagcaagactccgtctaaaaaacaaaaaaaacaaaaaaaaaaaaacttaatcctgattagaaggtgaactctttgcagctagaggccatgtcttcattgtttagtaaagtgcctggcacagggtagatgctcaataaataatgaatgaacgaacaaatgaaccatgagaaactcacaggtttctaatttgaacagatgggcagaggcaccattcactgaggtagatgagggagaggaagagcagatttgttggctgggttgggaggggtggggagaaatgaaaaaagagtttagttttagaatgacatgcagagaaaggcacagttgtcaataagcgtgttgtgttttgagaacaatgagaagtttattcattcagtcatttatttatttagtcattaatcaacaaatatctatttaaagcttaatacatgtcaagcactacgctaggcactgaacatatgataataaatcagacaaagtcaagaaagggaaatggataagaaacacctattaaaatgcagagtggctcatgccattatcaaagcaagcatagggtgctgtgtgtggggcctcagaagcggaggctgcaagacttcctggggaaagtaacaccccagttgcatcctgaggaatggaggaagtaggtgctagccagactgaaagccagagaaagggtgttcgaagcagaggaagtagcatgtgcaaaagcccagcagcaaaagaaagaaaagcactcagagaactccagatggttcagcaatgtgggaatccagtgtcgagctcaaggtgctccacggacagtagtaagcggcccaagttgtgaacctccttgacccccctccctccatctctccatgtagagagaagaatagattgcacggaaagtcaagtgcaggtgtcagtcagtccctgtgactcacagtaggatgtgtgaggggaaatgaggagaaagtagggttgaaattataaccttggaccaaattgttaagagccttgtctgccataatggagggtgacttctaggggcagttggtaaccactgaaagtttttaattgggagggtggtggtgatgacatgatcagatccatatattagaaagataactcagggctagtgtgaaaaatggattagcagagacatgacaagaagggactatattttctgtcaagaaggcattcttcaaactggaaaaaaatagaatggtaagaagatgctgaagtccagcattgtgtgtgtgtgtgtgtgtgtgtgtgtgtgtgtgtgtgtgtgtgagagagagagagagagaaagagagagattgtaagaaactacatgagtctcgggctgggcgcggtggctcacgcctgtaatcccagcacttggggaggccaagaaaggcggatcacgaggtcaggagatcgagaccgtcctggctaacacagtgaaaccccgtctctactaaaaaatacaaaaaaaaattagctgggcatggtggcgggcgcctgtagtcccagctacttgggaggctgaggcaggagaatggcatgaacaggggacatggagcttgcagtgagccgagatcgcaccactgcactccagcctgggtgacagagcgagactccgtctcaaaaaaagaaaagaaactacatgactctcagttctgacgttcatgggcaacttaactccctgccatctgcctctcctgccttgggtttccctgacacattttgcctcctctgctcaaagagtcctccctgcgtcttgcccatcttaaagtaaaacttcaagttcaagccttccctactgctcttcccccagacagattgaacagtttcattctctaggctgctatatcattctggacataacaactacattataattcctgtttttctcatctgtttcctaaactagattatatactccttgaaggctaagactgtacaagtttctttgtatccccgacatcaggtattgttcatggcaaacactcagtgagtactggattggaatttataggaatgctaataaactgggatgatctaataatgtgatttgtttttgtttttgtttttgagatgaggtctcactctcttgcccaggctggagtgcagtggcgcaatcatagctagctgtaacctcaaactcctgggctcaaaggatcctctcacctcagcctcccaagtaactaggactacaggtgtgcaccaccatgcccaactagtttttttatttttttgtagagtcaggatctcaccatgtttcccaggctgatctggaactcctgggctcaagtgatcctcccaacttggcctcccaaagtgctgggatgacaggcatgagccaccacctaaggtgaaatttaataaatgtgaattcctgcacctggatctaaaactttagctgccccagtacaggataggagagcaagatatctattcagcaaacatctccggactatcaagcaaatgctaggtactgtgcttgacaggggacataaagcaggaaaccagggagacacattctttgccgtcatggagtttacacatgggatgacaaattttaaacaagtaaccaaatataagtgaaatgctgtagagaacaatatagagtccaatggagacctcacctggtcaggaccatagaggagcactctatgaggaagtgatgtataagctgacctgaaagactgctggagttttctaggcagagtcaagggttgggcctctgtgggtgtgggtgggggcaggggtgagatagcgttttcagcattgttatcattacttccttaggcaagtcttccttgacttctctgaagaggtcacatcttctgtggccacatggatcgctcgtacagaacttacctctactgcagattcatgtttatttctgccatgacttgatcaatgcccaaggcccccactagactgtatgcacggtgaagagacctgtccctgtgctcatcagtgtatttctactgcctagtacagtacctagcatgtaataggctctcaattgatgtctactgaatgaatgagtgaatgaatgaatgaatgaatgaatgaagtgggtattccaatcagagagaacaagcaccaaagaccaatgtgtctgggaacacagtgaaggggagactgagtgtctcagaaaatctgagtgtttggtcaactgccagctatgcatgaaacaacaaagcaagatggccgcaactttaggatttattaagaaaaatcttgtctctactctgtcttggccagactaaacctacagtgttgttttctttcctgggtgccacactttagaaaagaccatgacaaatgtttgcaaaacatttccatgtgggaagctccatcacatgatggaaggatggtgggatttgaatcagatggacatggtttgaattccagctctgtcgcgtgttcactgaattggacaaatcgctgaacttctaagagcctcttttcctatccataaagtaggactaataatatccagagtcctgaaagctaaatggaatgacatgcaaaatgcctaacatggagcctggcacacagtaggcacccaataaatgtgaggccccatacctattagaagaagcagaactcagagcatttgagttacagaagacttcttgaagggggtaaaagtcgaactggtcacttaaggactggaggattctattttattgaagaaaagagagaccttaattgaggtgggtggacaatagttgagcacagcactgggctgggctctatgcatggacagagagaaccaagtagagaccaatctgagcttcaggtagaaacatccctcctgggggggcggggggaccttctgtgcttgatgtcaccttcccaaaaggaatgcaatgcccggggaccatctttgactagtatacccattttggaaagtagggaaactcgatcttagtttataatttgctcacaaacttagataacctctgaggccctgccctcctggagctggtgtggtacatacattccactaatggtagttagagcaagtaggactgtgtgtgcatgcatgcatatgcttaagcactcacaaagccaaaacaaagcgtgctacccacactggccttggagcttggcagtcacaaccaacagcagcccatccagagagcagctttgggtctggaaggactagtaagggagaaggaaggcgagagatggggaagaacatatgttcaaaaataaacactgcctcctgctaaatggtctagaaagcatctgtaagaggggctctgggctgtggggtttccgaggatggtgagtgtgggaatgttttgtctgtagagttggggctgggggcttccacatcctgcccactgccacatctggggaagtcatctgcactgggctgatggctccccgagcactcctgctttaatggctcgtggtgccgcaagaagtggccctgtaatggccattccaggctgccccggggaagggtctgggcaggccccaggcagcctgtttgctctcctcccaccccaggccagccagcacctttcacctcctctttgcctaggtgagctggcctgaaccctagttgggagcctccagctgtggggagacagtgggactagaggccttggacatttagagtggggataggacttggtcccgcgcttcctgaatgccatccccttgctaaggcacaggctcctgcatctgtcattgtttgcgttcttctcttgacacagctctgccaaaacctcatctctttacaaaatgaggctaatggttatggggtcaggtccaagaccaagtggtgcagaaggagcaggaacaccatgctttgaaagaacctgcttcgcatggtgttagggagaggtatggaaggagaaagcagagaaatgtgctgaggcagctcagagggctcccgcctctgctatcccccagggcccaagaggatccattggtcatttctgccctcacaatccagcatccagcgcagccccatcccctcgtccatcccgagcctgagacatagctgcaggtgcagacaaacctgctcgccagtgacctctggcatggggtattttaatggcatagtccgcttgccttgctcaggtccctggggaattagctgggggacccaagagcagcggcattgtgagtcgagatacctgcaagttgtaaggattgagcgatgggtcctagcttcagcaagggggagactccccctgccactctggtgccccagcagcagcctggctagagtgggggcccaaatgtgaatggggggatgctggaggggggcaaagggaggggagggcttgcactggctcctctcagcaagggctcgtaaagctgcaggtgtgagatgttgttatttagtctagagcctggtatgtgacagcccgggccctctctcctgcgaactgccgccgccaccgcctctgctggccagataattagtccattacgactctcccacctcgggtaggtgggggcagggtgagagcccaccctcagactccttgtaattcaacttcctgtgttttatggaagcaggctgttgggggcagagagtgaaaggccggtccctaggcttggccaaccccttcctcaactcccagcccccacctccctccttccacccaaacccggttgctgtggtgaccaaatgttatttcccagcttcgtgttggaactgctttgtaaaagttttttacatctcttacctgcctcaaacacgaatgcaggctggtctatctctccctgcgtcttgctctgcccgtctcttcctccgcatctctcctctgtctctctctatttttattacacgcttatcgcctttttccctcctgcttttgaaattgatttcctttcctttctccccctattcaggacctaaacgctgaatgttcgatatttcatttgagaccgctaatcgcattactgcccttgacgttttacagatatcatattatgggcgcaaatttggcaaattattagcgctgtaatgtatagcttgtcagaggtatttaagacgctaagagcccaaggcttatcggggttagcagagagctctcgttgagcttttgaaatgcagagagccagttataaaacacactgtgactctctcttcagctggtgaaaaaaaggaaaagagaaaaagagaaagaaaaagaaaaaaaatgtcacccgtctatcagaggcttccagggctgataacaagcaaaattcttctctgtgggtttcactggaaatgtgagaagcttttaaaacatttctcaagctgtctggaaaagaaaaaaaatctttattgaaaggatgtagcaatcttttttactgtggcctatttatctctggggaaaaagctgtaacaagaagatcccctactggtcaccagccgtgtcagggcctgcctggctttggtgccaggactttggtgtggggggcttgctgagcgagaggggggccacctttggcaaaacggggaaaggctgctggctggtgtgcattcctgtggaagaggcagcgtcctgcacgcctagcacagcgctcagggctcagcagacgcatctcatcaaatcctttttgaatgaatggttgaatgaaccaaccaacaaacacacacaaaaaataacagaaccttgaaactgctgccccgctttggtctgcctaactgtgccaggtgcctgtttacccccctactactgtagcaagtgacttttgctgataccactgtccacatgtgttccttcaccctcatacaaacatccctgctcttttgaggccattcgatcctctctacttacttgtcactgtcatctgctgatgacatctcccctctattcagcaggaacgttggcactcagtatctccctgctcacccctattctgcgttcctcctgtgaatttcagcacccacatggactgtccacatcctgggatcctctgctgcagcatcctgcactcctacagcagattccatggaaacacagccccgccctcagtctgaccatctcccacaatttcttcgtctcaaaaataatgaactctgaatcccattttgtaagctgcgtctgctgtccttatgtccgttctccttcctcactcccactgaatctgtttttgacctccgttagaccttcagtccctggaccattcctaatttaacaagcccaccattcccctcctagcttcactttctttcctgcccgaccttgaccctttgatcaacatctttaaagaatttcttcgtgccatttcctcacccttttgcctttctgtcccacctgtttgcctacctcaaatcccaaatccatgaaagcatttactttctcctctatttccggcctgtgatgctccggggagaaaagcgcataaccatttcaactggtgtcaccactagcagaccctgactaagtctcaacagtctgcgtacttgtcccagaatgacttcccatttcccacagcagttgttgtaaacccttccctctctcaaaatatttctcttcactgcctctgtttacctcattctctgtagatgacttcatttcctgcttttcagagagaataaaggccaaacagccacaacttttctccctccctaaccttggcctcaccctggaggccatcttcactgaattgtcccctaactcagtactactcagtacttgtgtcctgactcagtactactcagcacttttgtcctaactcagtactatccagtacttgtgtcctaactcagtactcatccttccacctgggcccatcactcctcctccttcaatctggcaccaccatctcttctctcacattttaaatatccctcttcctaccaatgcctttctctctgccttcacacaccctcaaatctcccctttaaatcttcttttaatcttaacttccaagcacattactctcccctcttcctctttccctttactgataaacttgttcaaaagacatctcactcacattgcctccacttccccacctcccattcagtcagcccattcactcaatgagctctatcccacttcttcactgacattctgatcacctcttctttcttcaaagccgctcttcccttagcttctctgactcatctctttggatcttatctacttctactcctgctcattctccttccccagcttctgcttgatgtgccccttcagtatcgctgcttcccagagtacactgcttcacttctctccttacttacgcatcttcccggggtgagctcatcatgcctgtagtttcacctgccacctaaacactgatgaataccatggctgcaacttcagcctcaacctctctcctgagcttcatgcccatattccagctgccaactcactatctctccttgaatccttgcagagcacctccagactcaacatattcaatactgacatcattatattcttccaagcctgcaacttaaatgatccatcagcaccatctaaccacacaagcagaaacctagtttgacctagagtcttccctttttctttccccgttatctgtcctctttcaccaaaggaaggaggaaaggaaggaaggaaggaagggagggagggagtaaataagtaaaacttgggaagtaggagagaagtgagttccttgccttgtaccttatatcagaattaatgaattaagccaggcactatgatgtacacctgtaatctcagccactcgagatgcggagatgagagaatcgcttaagtccaggagttcaagaccagcccagaaaacataacgagaccctgtcttattttttttttaagtaatgcattaaatagatgaattaaaaatttaaatgcagggctgggtgcggtggctcacacctgtaatcccagcactttgggaggctgagatgggcagatcatctgagggcaggagttcgagaccagcctggccaacgtggtgaaaccccgactttactaaaaatacaaaaattagccaggcatggtggcaggcacctgtagtcccagctacttgagaggctgaggcaggagaatctctttgacttgggagatgaagattgcagcgagccgagattgcaccactgcactccagcctgggtgacagagcaagactccatcccaaaaaaaaaaaaaaaaaaaaaaaaaagttaaatgcaaagggtaaaaatcatagctatgtatctggaaagaactttcatagtgtgaatgcaatgaagtcaccaaaaattctaaattactatacaacaacaaaagccccaccataaacaaaaataaaaggcaaatgccacctgaaaaacaaagatttgcagtaagtatagcagaacatttgatgtccgtaatatgtaaagagtgcttacaaatcaataaaaagcactaatagctcaatataaaatggactaagtaatgaacaaccagttaataaaagaaatatgaaccttcatattaatatagttcatgtaaattaaatgaggtgatattttgccgatacaaattggcaacttttttttttttttgagacggagtctcactctgtcacccaggctggagtccagtggcgctatctcggctcactgcaagctccgtctcccaggttcatgccattctcctgcctcagcctccccagcagctgggactacaggcacacgctgccacacctggctaattttttgtatttttagtagagatggggtttcaccgtgttagccaggatggtctcaatctcttgaccttgtgatccacacacctcggcctcccaaagtgctgggattacaggcgtaagccactgcgcccggccctgcaaattggcaacttttttttttttttttttgagacagaatctcactctattgcccaagctggagtgcaatggcacaattttggcttactgcaacctccacctcccaggtttaagtgattctcctgcctcagcctcccaagtagctgggattacaggcatgtgccaccacacctggctaattttgtatttttagtagagatggggtttcaccatgcttgtcaggctggtctttaactcctgacctcaggcgatccacccacctcagcctcccaaagtgctgggattacaggcatgagccaccacgtttggccagaattggcaacttttaaaattataaagttcaatgctaataagggtagagttaggcagacattcttatatactattggtaaaagcatacatttgtataacctttctagaagcaattttgtaatgtgtagcaaaatccttaaaatattcatatcctttattttagtaattcccttcttggaatttattctaagaaaataattagatatgtggtcaaagatttatgcataaggatcatcatttcagtattatttatagcagagaaaatctgagaacaacctaatgttccacaacaataaaatggttaaataagttatagtataatcatatgataaaatattgttcagccatttaaaaacatatatttgaagaatatttcagcagagatcctaaaataatgttaagtaaaactatgcatgggaaaaaaaaaaggaattacacacacacacacacacaaacacacacacacacatatttttagacagagtctcgctatgtcacccaggatggagtgctgcagtggcacgatcctggctcactgcagcctccacctcccaggttccagtgattctcctgcctcagccactcgagtagctggaactacaggcaagtgccaccacacccagttactttttgtattttctagtagagatggagtctcactatgttgtccaggctggtctcgaactcctggcctcaagtaatccacctgcctgggcctcccaaagtgctgggattacaggcgtgagccaccatgcctggccagatatttatttatattttaaaaaggagatttatttgaaaaacataaaagcacgacagaacacttcataggccactttacacaataaaataagcaacaataggctggtaatagtgctataatcccagcattttgggaggccaaggtgggcggattgcctgagctcaggagttcgagatcagccttggcaatatggcaaaaccccatctctactaaaaatacaaaaaaaattagcagggcatggtggtgggcgcctctactcccagctatttgggaggctgaggcaggagaatcgcttgaaccagggaggtggaggttgcagtaagccaagatcgtgccactgcactccagcctgggtgacagagtgagactcttatctcaaaaaaaaaaaaattaaaattaaataataaaaaataagcaacaacatactttttttgtgagtataaacgtttaggtatactaacaaaagttgcatgagtatagcatttatgatcagacgaaccatattcataaagaaataggtcaaagagggaaatgtataaacacatttcactatagttggtaattgtgtgccatcagctttataattgtggttatctgaaataccatgatgaacaacctaagtcttttgacaagatggagcaaaaactacaatgggttaccactgtgggtcaccaccacatatgcagtcacccaaagagcagagatctcaagaaattttgtctttcacaaatgcagatgtacaaaaaggacatctcgtcatttactgaggaagtttcaacatttttacgtagatgcgcaatgctgatacacaaaatcaacattgtgataatgcactttcatggagtcaaatctgcaaaaaaaaaaaaaaaagcataaaaagaattacaactctcttaaaagtctctacacaatttatacctccagtattggaaatgatgcaaagatgaaatacgtagcacagcaaattatagcaaataatgctgacaatttaaaatagtgaaagaactggtcacgcacagtggctcactcctgtaatcccagcactttgggagtctaggtgggcagatcatgaggtcaggagttcaagaccagcctgaccaacgtggtaaaaccctgtctctactaaaaatacaaaattagccaggcatggtggtgcactcctgtaatcccagctatttgggaagctgaggcaggagaatcatttgaacccaggaggcagaggttgcagtgagccgagattgcgccattgcactccagcctgggtgacagggtgagactccgtcttaaataaataataaaataaaataaaataatgaaagaaaactaacctgtgattgtgatcttggagattttggacattagagatttacgtttagggattttgatcttttgggatgtcaacatttagaattatggcattcaggattgtgtctttcagaattatgatccaaacccttttaaaacacaggtgtgactgggctgctctttgtagattcctcccttgcttcctgtaatcctcaaggtaaatccggggtcctccagaagtttcactaagtgcttcacaatccagcccaaactatttcttctgtcccatttctcatgcagctcatcttcccctaaactttgtctgcttttccatgattccatggctttgcaggtcttgtcctttctacctgttgtcctgttatttcccttttccatctaggaagattatttattcaaaactcagctccagtatcatctccctggtggactcactccgttccaagcatttagttgctctctctgatgtgtgtccaaagctctttgccagttaaccccattagactgtaagagcacagaggccaaagtcttttccttatttttgcttattttctcagcagctagcacaatgcctggcaggtagtgggtgtttgaggaatatcagatcagttattaaattgaagatttctgacttttcccttcccctgtgatgagagagaacaggagaaagacagcccccaaagccatgacactttggggtcagaagagcccttcaagatgatctggtctcttcttccatgtttgaattccctccattaggaccaattatcatccaatcactgcttgaatacctcttatgagggggagctcattattcttcaaagcagtactctgattgttagaaaatactttcttaaaatgagcctaaactagctttaactttcaccaactgttcttggtttggctcataggggacatacaagaatcagcttcctctgcctgtgtcacccctctctaagcctcctctttctgccccccttttttctaaggtgctgagtctcactcccccttctactgtactgctttatccctctaaagtcagtgcagatgacctctctctcaattaatactctactgctgatgattcataatgatgttttacatatgtacgctctttatggtttacaacgggccttcacatacatttattattattttgagctcacaaagaatggtgcccagacctgccctgtccaaggtggccaaaccaggacacagcagggtgagcctgtcaccactttatgaatgcggctggaagtcacattagctgctgactcatactgaccttatcaactaaaacccctaccttgtctcattgctgagtcatgtctctttcatcctgtccttatgctgtttttttagatagaaattcagactcttacatttattgttatccttacttctactatttattgagtccccactatataccagaggtggacacttcagacatatgtgtattttggcatcttttatcacgtggtttattccttattaaaactgtgggtgagcattatgagctcattttgcaggtgggaaagctgaagttaagaaagggaagcaacttttgcaaagttgaatagcttataagaggccgaattgttttatgacttcaaagccttgctttgttctgttttgtttgaattataacagtgtgcctttcaaaggggaaggaggagcagaacagtaggacttgagtgcttgttgtatgactgatgcagtgataggagcattgccttcattatctccgttaagccccacagcaatcttatgaaaaacaccagtcatctatttgctatccacctgtgtctcctgcaaatgggaacagctcaaagcagaagggtatactgaggctttctgctgaatggtcctgcccctgaagaccttcttgtcacagcaggggaggaagaggggagctccagctccctaggggaagtcggtgcagctgcgttgctctgtaggattgagccactgagtccctggacctggtcagtccctgcttgcacctttaaagaccagactaaaaggaaggaggaaatagatggcaataaaatggtggacttccaatgtcacagacatgagggtttgccccctctctttggtcttggaaagaactgcccagctttgagtcctaaaggggagagtaaacgaaagtctgctgaaggctctaggtcagcatactggtgtgagtttaaagctttaagtccaggctgggcatggtggctcacgcctgtaatcccagcactttgggagaccaaagtgggagggtcacttgagcccaggagtttgagatcagcctgggcaacatagtgagacctcatctctaaaaaatatcagaaaaatgagctgagcatagtggtgcatgcctgtagtcctagctacttgggaggctgaggcaggaggattgcttgagcctaggagggctgcagtgagccctgatggcaccactgaactccagcctgggcaacagagtgagaccccgtctcagaaaaaataaaagaaaaagaaataaagttttagtccaggttggttctcccaaactatggaatagatagaaacatgtattaagtacttgctttcggccagtacttcatactgagttgcagggaccacaaagaataagacacctgccctgaagaggttcaaaagctattgattgacatgagatagaagtacagggtgcttccagcacatgaagggtcacctagatcagacaagggatggactgtcagaaaaggcttctgcaggagatagcacctgacccaagttaggaggagttggcactggaaaaaagtggataagcattctaagtagagggatcagaatgagcaaaagcagagaggtaaaagaaagcatccatttttagggggaatttgacccaagtcagcattgcaaggacatagaggtagggcctaggagatgagcccgaagaaggaggtgggtgccacttcatggaagatcagctgaagagtctgaacttgattatttttattgagacagactcttgctctgttgcccaggctagagtgcagtggcacaatctcaacttactataccttggcctcccgggtccaagtgattcttgtgccttagccaactgagtagctgggattacaggtatgtgccaccatgcttggctaattttgtttactttttgtgcatggaggttgggtttcgctatgttggccaggctggtctcgaactcctgcgctcaagcaatcctcccgcctcagcctcccaaagtgttgggattacaggtgtgagccattgcacctggcctgagcttgattttttttttacatttctattattattattatttttaattttattattattatactttaagttttagggtacatgcgcacagtgtgcaggtttgttacatatgtatacatgtgccatgttggtgtgctgcacccgttaactcgtcatttagcattaggtatatctcctaatgctatccctcccttctccctgaacttgattctttagtcaattcaaattacgattgcatctaaataccaaatatcacttcttcactgctggactttgacaaagcattggcatttaatctggtttggagatgttaatggcctttcagcccattgttctttccttagatttggggattatcaagtatcagaatgaggtggtcattcctttatcatcactgccatcatcatcatcatggttgccatcataatagccgaattatgaaacctagaattgtatatggaagagaaaggtgatcctccagttcgttaacctcaagtctgtgatacatcaaagcacacccattagaaaatagtcaaatcattacgtctctagtcatttgttatctgatacggacagacatttaaagattggagagaactaaaacaacaaagaacatacctggaacagaaatttactaaatgtttttaagctcttcaagtggagatgctatttagagcgggaaagggggagctattgagttgtccagactcgttgtgaccagggagcaagttactgctaatctccgtaggaggagtaaagctttctggcttcatcgggggtaggggctgggaactgggggaacaacttcattacatttccttctgtgtgaggaggggcttcaggaggcagcttcttctttttttttttttttttttttttgagacagagtctcactcggtcacccaggctggagtgcagtggcacgatttcagctcaccgcaacctctgcctccctgggttcagcgattctcctgtctcaccctcccaagtggctgggattataggcacatgtcaccatgcccagctgatttttgtatttttagtagaaacggggtttcaccatattggccaggctggtctcgaactcctgaccttgtgatccgcccaccttggcctcccaaagtgctgcgattacaggcatgagccaccgtgcccggccaggaggcagcttcttctgagaaatttgtgagaactcccactgatgttccttgccttgtttactattagggttctttgagaggagcccagagcccaggccagatgtgttcacaatttgaatttagtttgtgaattagcacatccactatggatctctaaaggaaatgtggctgttcatgttagtctttgaagttaatgtgtatttcctaatacccacatcagtccttcgatacaccagcacagcacaggcaaagtgggactgacccgccatccttctgcgcagctcctgggtgactactgaagctgatgtctacttagtagaggtctgggagattgtatggggcctggctgggacttctggtcagcgagcagacctttgaagaattggcttcttcaaacctgtggcccattcccaacagtgaggctgctgggagctggctacgtgctgtgggtccaggcagttcaagaggccttcctagaatatatgagaactctgcaaattttccttcagcctggggagcggtgagaaaggatgaagtgtaacagggccctgaaacctcatcccaactcgctattaagcaagggtgctcttttctaatctaatagagtaaaactgagaaaggggtcttctctacttcccaattccagggccttcctgcattcgctggtgatgatggagtagggtgaccttaggaggtgtgacttgggccctacaggctgtctgggaaagtcagagcttccctccatactcctcccagaacactgagtgggtggctgtgttgtgagagtcccttgagagcccagaggcagaaacgaactctttgcaagaacgacgcatctccagaacatcttctcagaacaaggctgccttcactagagctcattcagtaagtgctttaggaataaggcagtgggggtgaaacattgctttgaactgggctacctgaacagcaagcttggaagcctggagagcagcaagtggtgcagatttacaagacctcattaaacagtccgtgggattgatacaggcctttatacttggaggttctgggctgtccagcaggctgtgggccctgtgtccccagggccctggaacatgggcctgcagcctttctcagctctcacccttgtcgctttcctctggggctgcggagctggggaaggacggatctctttgcttcactctcatgaaatggcgcatcagtaagtgctacttaagaaaacacatggtctgcccctcgaaaaggcccccctctgctgctgccgccaccaacacctttctttattccgcccaaacctcaccaaggggaattcgaaacaactgtggtgataaatccgcctgcagataattggcaagaaaacaacacttgtgcagtatataacgttttatggttgtttcatgtactttattataatactaatgagcagttatatatcaggagctaactgcacgccggattagcttgttagcatgatatgaaatggcagagcaaacagtccaggcccctcgctccctgcatgcctcccccaccctccctccctacccctcggtcccatttgcactcagtaattagtatgcaaattaggccccgggaccacacaagttctagtatattacaagggctttattatgctcttgtgagtacatgatggaaacggcccatgacagtgtttatctcactacctctgtcttgccttcttctttctctctgcccctcttctaccccctgcatacacacacacacacaaacacctttctttgcgtggtctacaaccaaccccttcttgtatcagacctctaaacttgatagagttcactaggtctttctgcccctgtttgaacatatccagtgatgggaatcctgctccttctggaagccatagttccattccaattaccataattgaaagaaaattctccctttttctgtggttcttaatgtgtgtgtgtgtgtcacagactcctttcagaatgtattgaaagccatgaacaccttctacaaaaaaaaatgtatattaacgtttacataacattttatattccattttagggaccctaaacccatgcatagagggggatccatagacttcttgcctcatattgagccaaaatttgcctttcgttaccctaggagtaaagttctgtcctttgaatctcttcagagggagtctattctctttactatatgataaactggcaaatacttaagaattcctgtcgcatttctcaaattctttccccaacttccccaaccaatgatcacaagtcagggttccaagacatctttccatcctgacccacctcgccctagtcacctatcacctgaatggtacgaagcccagaaaagtgcagaatgttcccactgtgtttgtggtgtgaccagcccgcctttgttctgtgcactgcgcctctgccaatgtggctggagtcttcagaagtcttttggcaaatgtaaactcaaccagaattcctggatcttcttcccatgaaccttctcaaggcgtagcttctcaaacctatacttccagaaattctatttttagcctacatgcagaatagttactttcgtctgttaaatctcacctgtatgcctacttgcagaagtgatttttgaatactgatcctgtacttcatcttgttggctgtccctagacttatctgactataaatgtgttagtcatgctgttcatgccttcaagttgttgataaaaatgctgtacaggacaaaggacaaatctggtcatatgtcactggagaccttgttttcaaactctcatcaatattctttgggtgtggttattcagccagctctgtatctacttacctttctccagtattttctctcttgtcatgtcttttccgtctgatttaccctataaatgtttttttaatccctgccccttcttgaaacgatccccttgatcctgtatttccccttaagctactcttgtttttgtcattttcttcttagttgcatttcttgaaagattggtctacactttctcacatctcatctagaagtgagctggctggtatggcttctgccctcgctactgcaagtaaactgctctctcaaacagcagtaacaacctcggaattgccaaattctgtggacatgtttctgtctttgtctgtcttaatttcacttttgcatttggcaccaaaaatcattgccctcttaaaaagctctattctggccaagcgcagtggctcatgcctgtaatcccagctctttgggaggccgacacaggtggatcacctgaggtcaggagttcaagaccagcctggccaacatggtgaaaccccatctgtaccaaaactacaaaaattagctgggcgtggtggcaggcacctgtcatcccagctactcgggaggctgaggcaggagaatgacttaaacccgggaggtggaggctgcagtgagctgagatcatgccactacactccagcctgggcgacagagtgagactccatctagggaaaaaaaaaaaaaaaaaaaaggctgggcgcggtggatcatgcctataatcccagcactttgagaggcccaggtgggcggatcacctgagctcaggagttggagaccagcctgaccaacatggcgaaaccccgtctctactaaaaatacaaaaattagccaggcatggttgtgggcacctgtaatcccaactattcaggaggctgaggcaggagaatcacttgaacccgggatgcgaaggttgcagtgagccaagatcgcaccactgcactctagcctgggtgacagagtgagactccatctctaaataaataaataaataaataaagttctattcctatggttcgccgtgagccctgatgtcactctcccaggtctttcctgactctctgagcatcccatctcagtctccttgggtgactcctcttctttcacttgcccccaaatgcccgagctttctacttatagttctgtcttccctccttttattcttttgttttcattcaaaatgtgaataaataccattgagccactctacgtgccatgcaccatatgagagagcaagacacaaggattcacgtagcctggagcccaccgtcaaggagctcaggctaatcatcataatgcaatgtaatgagtgtctgcagagaggagagtatggaaggacattacaggagccaacaggaactagtgagccaacctggagagtgtggaaatgatttcacagaaaaggtaacactaaagtcagtcttaaaggatgagtagtgtttactaagctctccccaaaatctctcatttctgaatccaataccttatcatttttcatctgtattaatccaacactgttccagaattttctgattcccatcctactctttgcttcctctaacctgtacctctcccccaatctatgctccacactaatgatgcagcaaggtctttctaaaatgcaaatctgattctttgtaaaattcttgattgacctcttttgcctattaggataaactccaaactcttcggcgtggtatgaatactgtctcttactaacctgacctctgtctagcctgccagctctctttgagggccttttgtttggcaggtgttcttgcccactgtgatagggtccaccactgggccatgagaaatccatcatttaaaggcattcttccacactggcttcagctgaactttgaagaatgctccccttatgcagccaagctcaaagtctatgcctgatggtctccccaggatacctctgagcagccttcctcaaccactgcccacatctcttccccaggctgcagcaagaccccacagcacaggcagacagaggagagaacaggacggctgctgcccaaaggagaagatcagaaaggaagaatctgtaaagcatgagcacagaataatgggcttcatgaatacttagcataaggaagagagaaaaaaaaatctgtgtagcaggcagtttttgtaaagcgttgaactgtaccacacatcaccccctgacaggccctgatgttagctcctggaatggatcacaagagactcattagaaaaaacaaatattatcgcacgctgaaatgatttatggagaaaaatgaaaaattttgtgttgttgcgttccctctcactcactccccctcgcctctgccttctatggggaagttatttatggctctagacccttaacaagagaacagcaaagctctgagctgatcactcctgcaaactgcctacatttgatttttattagtgacttaaagcttccttttttttctttattgtcctgggtgaaccaaaatgcattttaatgcctgctattcaggccagacaagaaatgtgtagatgcctcccacacaaaccagccacgccagtgtctctgtccagaaccgagggaggtgtacaagaagggaccaagaaagaccaaactttctgagagcacgagtcaggtctccctggtgtgcaggccactagatatagcaagttgatttcctcgttttttggggcagggagtgaaccaagtaagtttcagacaaggaaaagagacagtaattaacatttgttacggtgtttgcaatctgccaggcattattctaggtgttttcccttagattctttcacttaatcttcccaacaactgagaggtaggtatcctcatgcttatttcatggaagacgaaactgaacctcagaaaagtcaagtaacttttccaaagtcagacagctagtaggccttgagtggtggctcatgcctgtaatccctgcacttcaggagaccgaggtgggtggatcacttgagaccaggagttcaagaccatcctggccaacatggcaaaacttcatctctactaaaaatatgaaaattagccaggtgtggtggcacacacctgtagtcccagctactcgggaggctgagatgggagaatcacttgaactcgggaagcagaggttgcagtaagccaagatcgtgccactgcaccccagtctgggtgacagagtgagactccgtctcaacaacaaaaaaagaaaaaacaaagtcacacagctagtaactgacagaactgggaatcaaatccaggtccatctcacaacattgtcagtatttatcaccgtaccacattgtctcctaaactggatcatgctatctctagaatcataacttctgagcactaactggaaggttcctcagagacttacttcacggtcccatcttctatccactgtaggagctttcccttttctgttccggacggtcatcaccatgttcctgttggaaggtgctgcttctcaaggcagcccagggcgctgcagagcagttctagacagccacaagtcctttgcacactgaaccgtcatctgagcctctcctgtttggtcaggtgctttcccattcagtcaccttgctctgaaacattgcaactgtcagattccttcttcccatatgtctcctggatataggtaattttataaaattaaattttgagagattcctcttaagaaaaattttaacttcagaatgcccccgggtggagcaagacctttgcatctctcgctgtgacaatcaggatccatgctatggcagagcctgggcttgacctaactaagcctttggggtccttttctgcctggcctgtgtgatcctggacctctgttcctgtacactggtcctctaggctctctggtttctccagctgcttcacatgatgccagcactgggccaagaacagagggggtaccagtgcagacccagtggaccctcacaagggagctttacagtgaccatcatttttccttttccattgagctgtgacttcctactgtcaatcagacagtgaacaaagatgcacaagaaacctcagtgggcaggagctgaccaagtcttttatctgtatctgggtgccgtgagtccaaggctgtggcctcactgaggacagtcagcagagggttacacactgagccttgagtgactagccttggaaaatgccctgcccatgcccctgtactttaggatgtcctatgggggagggaggaggatatagggaatttagcagaaagtaagaaactaccacagagatggctggggaaccaggctcaggcgcacaatcccagctaatcctaatctgtgttttccctccacagcgtgtccccaggggggagctagggttccaggaagagaggatggtgttcttgacaacaaggggctgggagccccagatgaaaggccatgggggctgcacttcagggtgatccgtaactcactctgacatctgaacagaaggaagggctgcccaggcccctgccccaccacctctcatttaatccacagggagacagggagcccagccttgggacgttgctagcagcttcccctgaaccctcgagttctcctgtagcaaattgggctgaccaaagaaggctggagaggggaggaaggcagtgctggagaaaggagtggttaccttgagtggggctgggggccggagggtctgcgcctcccctccctgccccagcccctcccaggcccgctccagggccagccgcactgggcctcattcctggagggccctgtctctcggcagtgttgctaggtgcggtgagcccaggcgcctgccaccggctggccaaggctctgcctggagaccatcggagagctgggaagaaggagctgcattatttggttgatccctccctccctcccccagcctcagcacagtgagctttccggagggatggttctgagccagcccatccccaggccttcctctttgtgcagagacctccccgtcagaccccccaccttcgccggctaccccctcccccttccctccggttgagcagagccagagttaagcctggggttaatgcccagtgacacctgcaggttggctagtgttgttgacatggggctggggggaggggagggggtgatgggggagatcgttggtggctttattatggagaactcagcaggcctggggccttctattgtccaagtggcaaataaataaataggagaaagtaagtcttccccatggcttaccgacgggaggttaacagctggacatgacatgacaaattgggcatttttctttggggactgatccttacagcagctagcagggagaatgagagagagagagggagggggaagtagagagagcaaaagcaagccggagcacggaaggggctagtcacagaagtcaacgtggaagccgtgtgtgcatgtacaagagtacgtgaccggggtgtacaggaaacattgcatcatgttttgggcattaaaaaaaaatacatgcaagcatttcacatgtaacgacttcaggagtcaatcccagaaccccaaaagctgggtatctggctgtggggggagatatctctgggatctgccttcttgaacccctcccccgtcctgccaaatggaaaaaccaaaaggtcaacgccagctctgatcccaaagaatctccttcctccagatgagtgggattactgggcagtggcgagtggtggagcaagcagcctatctccagcctgggcccggggtgagaactcttgcattatgcccagttgcccggaactggtcccagctggacagcagagcatcccactggcctgtggagctggggacagagagcagcagctctcccctgaccctgtcccatcttcctcctcatccccagggaatacccagcaagaggtcgggaggaccacaggagacaaccactcccaaacaatgatctcagttgcccactgtgaactggagcgggggtgggagaagaacagagcaggagcagacaggaaaatgcttgatctctgccggggccccagaaccatctgagccaaggactgctctccatccctgtcttctgaggctgtagattatagtgggtagtcacttgtgctctggagtcagacagacctgggatcaccctgttcctcttgttcttggccctgtgatcttggcatgctatttaacctctctgagcctcagtttccttataggtaaaatgggactaataccagtactagccagcacgaggttttaatgagttcatgcatgtaagtgctgagtgcagagtctggcacacgataaatcctttataaatgccactcagcattgctctggggctagccaaccttttcctccctgttgccctgtgttttaagattgactgagggctctatagaactgtcctccggagaaggagggaagtgcatctctagctcacctttctggaagttatcctttcaatctccaaaggctgggcatggattagcctaaagccttgtggaactttgccttccaagacatgtttgtttctagcagtgggctgcaaggagaagccttgtggctgtgattctgctccatgcccactccacggcggatgcctgaccagtgttccaaggacattttgaaggaagagaggatttctgatttccaggaggggttgttgtatgtcctggaatgcaatctctccattctcccactgggtacagagaaaaaccacaggaaaatggtgagaagatgctgaatgagttaatgcaaccaggaaatacttattgagcatgtaccaagtgtcaagcatggctctagaccctgggaatagagccacaaacaaagcgggctaaaatccttgcccttgaggagcttacgccgtagttctctaggaaggcaagcgggacacctcggcgttgcctccaccccttccatgtggccatggtccattgtgatcttctatgctcttcctgttggattcaaatcaggcctcacagaagagccagtcacaaagggaactcggagatgtgcaggacagagagaagagctgacgggacatctggtaccttcggttggagggagggcagtttctgaggattaaaagaagctttattgaagggaggtttgaaaggagaagaattgtggagaagaaagctactgtgtatttcatgctgattccatgccattaactttcaggcactttacatccattatctaattttatcctcaggcactcagcaaggcagttcacgttattcccaccttgagattcagaggaggaagtgactaatccaagatccataacagggaaatgggaagaactagatttgaatccagacctttagttcttccctttgcccaattatgctccttgtggtttgctggagaaagcctggcagagggtgcaagggcaacagtgggggtgggggtgcagaggctaggagacctgaccagagtgtagaggggttcacagggccaaggagaggagatatctagggggcctaaagatgggtgagacctctgagcctccctaaaacagcatactgcaacctcttcatcagaaacccaattttttttttttttttgagatggagtctcactcttgttgcccaggctggagtgcaatggcgcaaactcggctcactgcaacctccacctcctgggttcaagcaattctcctgccacagtctcccgagtagctgggattacaggcatgcgccaccacgcccggctaattttctatttatagtagagacgaggagaaaccctttcttgcatgttctcctacctcattgcaaacctttctgaactgagtgaggggcattctgaacctgagagagaaaggggctagttctctgaagatcatcaccagaccatagaaccaaagtgggtagaaggtttgtaaaaggaggtggaaggtgtgacaaagacaataagcacccgagatgactcacactgcttgccaggtaagcatgggctgcaggacgtgggaggagaagctggcgagctcactctcggtcctggttcttccggccacccagcctcttcatggccagtaccagaaggccagatccctgtcctcctccccaggcccagagccatggctcagtggccccccaggcccagcctaagaggtcgcatggctaggacttctacctggagaatcacctccaccgcaacatctgagagcaggagccacacaggagctttcttcttccaggaagtcccttcccccagccccctgctactcactcccctatataatattccacgttagagctcataaatgctgctgcgggtccccagcctgattgaatttggaagccattgtttacagacgtctggctgtacagggggatttattgaattttccatgaaatgttgctcccctaatgctgtaaaaggcaagcagaccacatcagaggagccctgcgttacaggatcatgttaccccgagatggagtgcttgcttcagagtcattgatgcaccgagctctggctctgaaaagtaagacctcgggcatcactcctgacccctcgctggcaccccaaagctgggacttctgagccagctctgcccctgcatttccctccacccatgtctggttagtctcaaatccctctcccacatccactctcctctccagcccacctgctatggacaactgcattgctacagcagcctctccaggcgcctcctggcggtcctctctcacctgccccagtcccagagtcatacccctcaaggcagatgacactaaggaggggttcagcaagtaaataagcaaaggaagagaaggaagcagggcagaaagaagggagaagaaaaccaaggtgttcatgttgtcacacattgagagggatgcttcctccagggtgcctggcacattaggccctgggaatctgtggacacgagagcccccaggatgggaaaaggcattgccaacagccctgtgagacagagctgaagtgaagatgtctccttgtgtgtgtcacaaaaatgcaactggaccaagccttccccattttaaaaaacacattctttaaaccctcctcactccttgagcttctgtccccttcactgcctcactgctcaaaggcttttttatatttaaccacttccattctctccactggctcatttctgccacagtccttacctctttggtgaatctgttctcctaaagattgttcatccacatctccaagtccatgttggtgttcacccttcttaacatctcttcgcctaaccctgcggtcaccctcctgaaacacttttctctctcggcatctctcataccacctcctggttctccttgcagacagctccttctctggctctttgccctcctgccaccctaaataaaagtaggtgtttcccagtgttctacctttgaccctcttctctcggtgcacactttaatctgatgagctcatccattcctgcagctgcagctattatctttatttagaggactcctgaatataaagctccaaatctgacctcgtgctgctctggtcccatttttccaactgcctggtgaatatcttcagcgctttgtccaatagacatctcaaaattcaatccgccatgtagccccaactcccatgataattcaccttcagcggtcattatttctgttgatgacattgtcatcctctcagttatccagtcatgagatcttgaagtggtctttggtatagctgctctaggcccatctacctactgcatactgagtatctcaacccagactcttaacacagtcttattacccccagcacccgcacacatcaactcgcaacttgttctctttccttcattttctctctaccacgaacagtaccgctattgtcccaggcccttaagccagaatcctaggcatcctcaccgtcttctctcttggcctcacatcccccatgtctcgttagtcacgaaatcctgtggattccttatcgtcccttatatatgtccccttatctctagcccctgctactgacttagttcaggtcctccctgtagctcacttatactgtctaaaaaatccttctgaccaatgttcaccatccagtctttctccctgccgtccatcctccccactgctgctcacatgatcttcctaaaacgtgactctaacacctgtctaaaacactccaacagctcctcattgcttccaggattacatcagagctctctaatgcctcctagcatttgcacacaagatttcctttacctggaatgtttcttccttccaggctccccacctagactccttcattcagcctctggtactctcccaattcttcttttctttttttttctttttagacaaggtctcactctgtcactgaggctggaatgcagtggtatgattgcacctcaccacagcctcgacctccaggactcaagcaatcctcttacctcagcctcccttgtagctaggactacaggtaccacatctggcttaatttttaaaaattatttttgtagagacagggtcttgctgtgttgcccaggctggtctcgaactcctggcctcaggcaatcctcctacttcagcctcccaaagtgctaggattacaggcgtgagccactgcgcccagcctcattctttaaaacccagctcagagatgctgtcttccctaacccctccaaacataagtggaaaccctttctttctagtaagcaactactgtacttagttcttgacactctcaaaacagctatgattggccgggcgtggtggcttatgcttgtaatcccagcactttgggaggccaaggcgggcagatcagttccagaccagcctgggcaatgtggttaaactctgtctctactaaaaatacaaaaattaaccaggtatggtgacacatgcctataaccccaggtactcaggaggctgagacacgagaatcacttgaacccaggagatggaggctgcagtgagccaagatcacaccagtgcactccagcctgggcaacagagtgagagactctgtctcgggaaaaacaaacaaacaaacaaaaacagctatgatgtagcattgcaatgttgatatacaaggccatctttcccaactattcatttcattagccccagtccctagcacaatgccttgcatataggaggctctctgaacaattgctaagtgaaggtcaagtttaagcgaaggaggcagagcgcacatgaggaacttttatcaccaaggggaatttttctctctccaccttttctgtggttctcaaaaagggtgaattccaagagtgatagtctcttgctcgcaacccatcattcctagaatcctggtgtttccaacagtaagaggtgttcaccagccagcaggtcctgaagccttggaactccctctctctcttccctccttgcccagcgtgatcagcctgatgtctcttccctcccagttctgcttccccattctagtgaccccttcctccccttcctcctgctgcttcttaactgggggactccagtgtgactgaagggcctcagagggaaaacaatgatcctccagagagagcatgtgttcaccacgttaggtaaacacgccaagctgcaggggccgcctgaatgaggggtctccagccagggatggggagaatcccacaccagcatcttagctggcagacagacccaccttcgccctgagtagggggtgggcagtagctctgaagagaagtagcaggacattgttttctcagatttcattggtttatttatcctacgcctgggctccatctgtcctgtctccaaaaagtgaagcagcaaggactccaagccaccagagaagccctgtcctcagcctgcagctctgcgaggacctagagccaagcggagttgggagtttgtcccctgcagggtagaagcctgggaatgtttcaggccctatggctcaattgcccaaagggatagaaagagagcaaataggccaaaaagatagcatgagcgtaggcctgagccctcctgattcctgactggtgtccctccacagtccccttggcaaagccaagagggccaggggcttttggagaagtgggccaagaaggctcgagaagaagcccagatgacccagacttgacctctctactgcaaccaagagaggcaggtgttgggtggagatgcttggggttatggagacatccccttggaggagcctgctgtgtctctcgggctgcacattagctgggaaggctgttgagtaccatgcagctggtcttggttttgcagagttctggacagcattcagttccctgaaatcagggacaacagagcaaatctcccctaggtgcatgggagaatctgcggccctctcaacagtgatgggctgataggaggaataagaaatggggaatcaggagagcaagataccttgaagagatgcagaaaggttgctttccatccttacgagtaggaacctctctacaatacaaaatcatggcagctcaggacttgccccacattcataccttaccttatcccagcctgaggttgagctacaggagctgtaccaaagtataacatagctaggctttgaatgaaggtttccagcccgtttagttctgagtgtatgtgtagcttcagcagcaactcagtggagatgctcagggcgttcttgggcctgttctagtccctgcaatgcttctccatggccaggttggaccccctgttcatttcactcaccacccccatgtgtctggtctcctagtgtcacatgacacacttgaaccatgctttccagagcccagatccatcactcaggcattcaggggatttggatatctcctagcacctccatcgcagcagagcagaaactaaagtcattgtcttccccctaaaccctgccaaaattggcccctctcctatcctttgtaggtctggaagtgtcacccaagtttactgtcatcttcacttcttgcctttttttttttttttttttttgaggcgctctgtcgcccaggctggagtgcaatggcatgatcctgactcactgcaaccttcgccttctggattcaagcaattctcttgcctcagcttcccaagtagctgggattacaggcacgggccaccacgcctggctaatttttgtatttttagtagagacgtggtttcaccatgttggccaggctggtctcgaactcccgacctcatgtgatccacccgcctgagcctcctaaagtgctgggattacaggcgtgagccaccgtgcccggccattttttttgttattattaataggactgatgaggattcatatttttgagaatgtctgataatttccttaggttagggtcctagaaaagaaattattgggtcaaaaggtataaacttttaaaaagctgttgatacgtattgatagactgctttctagaaaggttataccaattcacaatctcatcatcaatgaatgattatacccattttcttaaaccatcatccacattatcaatttttaaatctttactaatttgattagccaaaggggaaaaaaaatctttctgcattatggtagcaacctcccattggtctccccacctccaattcaccttgttaataatcactaggttatacatcctaagactgagattttaccacgcacttcttcactcagaatccttcagctctgctccccaacttgcctgctgcataaactgaacacctcaagctcccattcccacaagctatgctttagatctagtctcctcctaacacatacctccatttttacctccttatggggcatggttggcagccacctcctctgagggcctgactccaagctggaagtcatttgatgtgtgccagtggaagccattgcccctctagtgcctggtatatgccaccaaaccgtggacagcaggctactgaaactggagtatagaggctacttggttgggtcctataagcctcatctaagactatttcaaaaaggctccgcagcaggctcagaacttgtgagcaggaaaactccagatcctcacaatggcctcctttaggctgtctcagatgtgtccatcatgaatgaaaatgaaactcctgctgggtgtggcggctcgtgcctgtaagtccagcactttgggaggattgcttgagcctaggagttcaagaccagcctgggcaacaggagtgagaccccacctctacaaaaaaaatagaaaaagctagccagatgtggcagcacatacaagtcccagatacttggcaggctgaggtaggagcctcggaggtcaagtctgcagtgagccatgattgtgccactgcgctccagcctgggcaacagagcaagaccttgtctcaaaaaacaaacagacaaacaacaacaacaacaaaaacccatcaatggctccctgctattctaaacttcttcttttttttttttttttttttttgagacagagtcttgctctgtcacccaggctggagtgcagttgcgcaatctcggctccctgcaagctccgcctcccgggttcacgccattctcctgcctcagcctcccgagtagctgggactacgggcacccgccaccacgcccggctaatttttgtatatttagtggagacggggtttcaccttgttagccaggatggcctcgatctcttgacctcgtgatccgcccgccttggcctcccaaagtgctgggattacaggcgtgagccactgcgcccggcctctaaacttcttaatgcagcctagaagaccacatgtcatctgatctctaccacttttccagcctaatctctcaccacgccccgccttgagctacaaattccagccgtgctgagttactttccttttcccaaggcactgtgttccagctcctctctttgcacatactgttcccttcttcttctccctatctcttcctccccctgtcaactccaagatttccttcagatcttagcttagactcatttcctctgggaagctttcttctgtccaccccacaagagtaggataggtgccacttttgtgtatttccacagcactcctcatacccactcttctaataaggttatcttcttgtaattgcctccctgcttgtcggtctctccaacaaaattgtgttcttagtgacatcaggattatattttgtttattgcttgtggtatccatggtgactagcatagtatcttgaacatgataagtgccctacaaatatttgctgagtataagaatgaatgaatgaatgaatgaatgaatgaatgaatgaatgcttcatggcatccagctacccagtcctgacattctctgagtctcagtttctctctcactaaaaacgagatgacttctttttcattgttgtactctctgcaaacctgtagaaatgaacccctagtggctatgagaagctgcctaggccaagggcgtgggattcaattgctgtttggtttctctacactctgcccatcaacaggaggaggcacttagtattgaaagactcatggtagacaaagtaggataagactgatgaaaactttctggaataaatatatggtccagttagtgtcccatctctgagaatgcctgctatactagtcagtgttctagcaagaaacagaggcccacgaatggggtaacaaaggaaagtttaaggaaaggacgatttataaagagaaggtgaagtacttcagagctagcaacgacaggggagctgttactacccctgggattgaaggagcatataccagcacccaggaagaactgcggctatgaccacggctgcaggaggagctgtgactttcaggaaaggaatgctaacccttggctggcagagaaggagccagggcaatactcaccccaactgcttctctcctctcgttctctaatgtcctccatgtgtcaaaccccataggaatcctgaaggcaagcaagcttggttgttggggcagaagacagaaatcagctttcagggcacagaacagaatggagaagggtgatgtgtgtatctgcagaagcgaacagatatctctctggcccctgcccccaggaatggaggaaggatggagatgaggagggctgggtcttcttatccactcaggcttcacccaggacagagagcaagagccattaaagaggcaaagcccagaatttgggagctggcagcctggtaggcattgaggagggacttgggcaaaaaaattgaggaatgcttgccactgcttaggacatgtccttctcgcctacccttactcctttgctgtcttactcccctagcctagaactggatcccaagctgagacagaataggaatcctggcaggaatttcaagattgtgctctctgatgtattcatactcaataaagctctctgtcctggagaaaaaagctccaatgtcagacccaaggacaggaaacagttgggctgaaggggatcccattgatctgggacttggaatcagctgagaagagaatggagggtcaggaagatctaccctttccctagaaatcatctgaagcaaacctgtggggcttgggaacccagtgccctgcatcagagcagttccttgcatgcagccaggtggggagccagtctgagttccagctggaatttcatagcaagcaggtagaaggcaacggccctcccagctcaccttcaccacccaccttttcactcgttttttggtctcttcctttttatctccactgcttggttgttctagttcagacctgtctttgtccctcctcttagatttttgcaatagcttccttactagtctccctgcccacaattctgattccttaattcctcctccacactgtttcaagagtgatatttctagcatgtaaatccagtcatgtcttaccccttgcttaactttcttcaatggctcatttttgcctataggatcaactccagtctccttagcatagcactcaaactcttttttgagacagggtctcactctgttgcccaggctggagtgcagtggcataacacagctcactgcagcctccacctcctgggctcaggccattctcctacctcaacctcctgtgtagttggaaccacaggcacacgacaccacgcctagctaagtttttgacattttgtagagacaggatctcactttgttgttcaggaatgtctcgaactcctggactcaagcgattctcctgccttggcctcccaaagtgctgggattacaggggtgagccactccacccggctttcaactttgtatgatctgaccccacctacctgcccagtctcagttcctatggcctctatgcataccctaaattccagctatactgaacgtaccaatttatgtatttatttactttaagttttttgagatggagtctcgctctgtcacccaggctggagtgcagtggcatgatcttggctcactgcaagctccgcctcccgggttcacgccattctcctgcctcagcctctggagtagctgggactacaggcgcctgccaccatgcctagctaattttttctattttttagtagagacagggtttcaccgtgttagccaggatggtctcgatctcctgacctcatgattcgcctgcctcggcctcccaaagtgctgagattacaggcgtgagccaccgcgcctggcctgaatgtaccaatttatttttacctctgtgactgggcatatagctttccctttgcttagaatgtcttctatgccttcatctgcctgttgaactcctactaatctttcaagacccagctaaagtgatacacccttcttgaagccttccttgatgtcgttaattgtctcctcctttgtgcccctacccagaatgtatttctatcaccacatcattttctaattatctgtccacatgtttttctccccaccagactatgtgcttcttttgtgtgtgtgtttgagatggagtctctctgtgtcgcccaggctggagtgcagtggcacaatctcggtacactgcaacttccgcctcccaggttcaagcaattcttgtacctcagcctcccaagtagctgggattacaggcgtgcatcaccacacctggctaatttttgttttttcagtagagacaggtttcaccaagttggccaggctggtctcgaactcctgacttcaagtgatccatcagcctcagcctcccaaagtgctgagattacaggtgtgagccaccacacccagtgctatgtgcttcttaaagaaaggtagtgtatttccttagctttagcacagtgcctggcacatcaaacatgctccctagtcaattaatgatgacctgaatgaacaaatgacacccctctctacctgctgtcctctggtaaacctgccctctttttaatgcaactccctcagactggctggacctatttagggtatctccttccctctcttgccttttcctgtctgctcttcctgttctttttttttttgacagagtctggctctgtcacccaggctggagtgcagtggcatgatcttggctcactgcaagctccgcctcccgggttcatgccattctcctgcctcagtctccctagtagctgggactacaggcgcctgcaccacgccctgctaattttttccattttttagtagagacggggtttcactgtgttagccaggatggtctcaatctcctgaccttgtgatccaccagcctcggcctcccaaagttctgggattacaggcgtaagccaccgcgcccggcctcttcctgttcatttttaagcaaagttctcctctttacagatgttgctagacagggaggggaacccatggtgctcactatatcactgagctgaatgtctttgcccagtgagaaccccagggtgcccgaaatggctgaaacaatccctccgctaataggggaccctgggccctcattctgcatctctctaggggctgagttgaaggagcttctttctcaatccacatacatatatatgtgtatatatgtatgtatatgtatatatgtatatatattttatatacgtatgtatatataatatatatacatatgtatatattaatatataatatatattttatatatatatatataagcttcttgatagaaactgtttgtgttggctgggcgaggtgactcacacctgtaatcccagcactttgggagtctgagatgggagcatcgattgagcctaggtattctttctagaccagttctgggcaacatagtgagaccctgtcaaaaaggaaaaaaggaagaaaaagaaagagaaggaaagaaagagagagaggaaggaaggaaggagggagggagggagagagggagggaaagaaggaaggaaggaaggagagcgaaactgttcatttttacatcttgcacaatgctttgctcatagtaggcactctgaactgaaataccttgaaaactaggatcatccatattcactcgttcattcattcattcattcactgaacaaactgattaagggatgtacatgactgtgtctcataaatttgtccaaagatgtttaaattcatttatgttttctgctagacccaccatttgggagaatgaatttcttaagttcactggccacggtataaaatcacctttattcatcccaaatgtgttcgagtttcaaagcaaacccactttgcctacagtttcaggatcttgtgaataagtttctagtcaccttctctacaccatttgtgatttgtgatttccttcacatcccccaccagccttctcacttccagactgggtggtgagtcatcgacccttccccactgaggagcttttgcatgccctgcgtcttctccagggtgggacagagtgccacggctgagccctgcgggtaggactgttccagctgggcacctcaaggaacatgttctccttcttccgtcacatcttattcacagttctcttagccttttggccaacagcctcagggaactgtctaaatgaagaaggatttctaggtcctttgccagaaccgtggctgaccatgcagagttgagcactggagagggggttttgatgtgttcatcacaaaaggcattgccttgcacttgcccacatttaattgagtctgtacccttttgccctgaaatcatcctgccaactaaatccaaaaggatgctggagaatagagaataacatctatggcccagcccccactgtatatgcgtatgcacaccaagggccatacctttggctggatgcctagggctcttttctggcaccaggtgaaatatcagaatcttttccactgctccctgtctaattcaatcagatataaaatgtgtaagactttgtctaaaccttcaaagacctcctagtaggcttggggaagaaatagacacatatgatagtaccattagtggtagcatctactgcatattaaacatgtcctatatgccaggtgctttatatacatcctttatattgagtatcaactttaatccttacaacagccctgcaaggtgagtatttttactccatttgataaatgataaatgaagcagagaggttaaacaacctcccccaagatcacgcagctagaaagtttacggagctagaattcagacctaggtgtgtcttactccaaagcctgtgttttttgccaccaccttacatgatctcaacatatagcaatcaacatgacatgttatagccccggtgaaagagatcagttattggactgttttggtctcttctaggttacctgtcacctgtctcaacccaactttttcagaccttagcttaaagttcgtttcctaagggaagctttctccagcccccatgatgcattcccataaagccagttctttccctcacagctgttgtttaggcaattgtttgtgtaatgtgttcctttcctgttagaaggcaactccgtgagggcagagacaatgatagttttgttcagtgttttgtccctagcgcctagcccaatgcgcaacacatagtaagtgctcattaaacttgccttctcgctccagaacctcacttgctttctagttctcccctactcccctgccctttccaccttgcctccagaacttccttcagtggtgatggctccaacatcccccagccccagtcctcagccttccagatgcttgggtatcccaggagttttattcacactgccacgctgttctgtggaagcagggcttcccctcggccctagcagggcaggtgctgacaggagcagccaatagccaggatgccaggtttccctgtgctaagctttttcctgggaatgatttaaggccctgaacagataagtgaagagcaaacccgcaatgaagtcagcactctgcttattaagtggaaaaagctgtgctcggcttattgaaatgttcattagacagatatatagagatgagaaggaggaagggagggcggcggcaccgcaggatcaggctgcgctccagcggtgatgcagggggcatcccgggggagacttcggtctagccccgggaggaaggggagtggggctgggacagatgagcaggcctgttaggaagagggggccacggccctgactccaggaagccagagctgaaggaagggggcctgcgcagtgtgcgagggagctttggaagctgtcagtgctagctagctctgtgaggcagcagatagaggggacttggcccactttagagaatgcccacttctctgcatcgatgtcactgtctttgtcccaggaacataatttctgaagaactttgacccactttatttgcccactctgaaggcaagagggtgactgcttcctgagctctgagctcccccaaggaagggcttttcctggggtgggagctgagccttgccaagggcccccctcagcccaggaggagccacggctccttcagcacctcccggctctctggcttctgtcctcagtgcccatcaggcaggcaaccccagcaagctctggagtggagtggccttgaaaaagctgcagctacttgatgacggcgtcacctcctgtgatgtggggaggactcccagtgagtggggaactgggtctaaatcatccatgtgcctggcagtaacctggagcctggcccacggaaggcttcttattgataagctctagatggtggctgatggagtgagtgaaaattctaccgctctccccagttcagatgttggaaggggaaagaatcatggtgtgactggaagggcaggtgctgtttcccaaacaggaaaaaaaacagccacaagattttccagtgtcttcatggtctttcttgccatcatcagttcggctcctggaggtagagtcggtggtgaccaaatggacaaaaaaaaggatgccggctggaaactatgtgaacagaacaataaaaacagtatctgtagagtttcagagcattttcacaggatctcatttaatcctcattcattgattcagccagtagttggggtttgtttgtttttgttttctgagacagtctcactctgttgcccaggctggagtgcaatgaggcgatctctgctcactgcaaccacagcctcctgggttcaagcgattctcctgcctcagccacccaagtagctgggattacaggtgtatgccaccacacccagataatttttgtatttttaatagagatggggtttcaccatgttggccaggctggtcttgaaagcctgacctcaagtgatccgccccctcagcctcccaaagtgctgggattacagatgtgagccaccacacccagccttcagccagtagttgctgacctcctacttcctgccaggcctgtacatgcaccacaacctcagtgaatgaaaccaactctgtcccacccttgtgtagcgaatcgcctcatgaaaggtaaatgtcataacaattcttcattaattctttcattcagcaaacagtgatgccaagctggactcctgggaatggagaaatgaatcagacatgcatcctgccccagagaactttacagtctaggaggtacctgtacaagtaaatggatgattagaaacagtgtgataaagatactgaactaacccctaagtgcctgagggttaggcaaggcttcctgaagatgtgtgaactgagtctttaaaaaagaacctacgtggctgggcgcggtggctcacgcctgtaatcccagcactttgggaggccaaggtggatggatcacgaggtcaggagttcaagactagcctggccaacatggtgaaaccccatctctactaaaaatacaaaaattagctgggcatggtggccggcgcctgtaatcccagctactcgggaggctgaggcagagaattgcttgaacccgggaggtgaaggttgcagtgagcccagatcgcgccactgcactccagcctgggccacagagcaaaaaaaaaagaacatatgtttgctaagcattcagggagaaggaatttctaggccaagagaggtggatttgaggggaaattcaaacaggtcagccatggaaaaagaatggtggaaaatagtgttagtgagctagccaggggccaggcacagcagctcatgcctgtaatcccagcattttgggagactgaggcaggaggactgcttgaggccaggagtttgagaccagcctggacaatacggtgagaccccgtctctactaaaaattaaaaaattaactgggcatggtggtgcacacctgtaatcctagctactggggagagtgaggcaggagaatcactcgaactcaggaggttgaggctactgtgagcagtgttcacgcctctgcactccagcctggttgacaaagggagaccctgtctcaaaagagagagagagagaggagagagctaggcaggaccaaatcccaaaggaatttcccagctacatttaaagctaacttaacttagctaatttaaagctaactccttaaggagttagacccattctaaaagttcctgcagggtcagtgaagggaaaagaccacctcagcagcagtgcagaagaggggttatctagaggggccatctcagtggtccaagtgagagatggtgccatctgactagggcagcggcaccaggaaggaggggaccagatggcccagcatgaggtctgaacgtagtttggcaccctgctagatataggaaaccaaccagaaggtgtccatttcacaaggaggggagagggcacagaatgccttgtccagggggacccggagcagtgcggggaatccagggccctgcaggaagccgtggctgcttaaacccatgtgtcagggcccgcttgtgatgctgaggctgctgacacctgctcccaggccttgatgactccatttcccagctccctccctctgcctcgctgactttggaggtgattagtaataaaactttaacaagcatccataggtacgtctccctgtcacttttatgaggccatttcctgagcaaagatataggagcaccttcagtctctctagccatgttgttgctgccaccatttcagtgtctgcctcagcctgagcaggtcccagacagctccaggggctaagtcggggttggggggttggtgcctggaggaaattggagcatgcttagctcaaggaacctcaaaaaggcaggcacagctccctgtatgccctcgagggctctttggaaattgtcactgggaaggctggagccgttttcactgcctgggccattagaaatcaaagcaggcctcacttctttcttcccctcctctccccgaagtgtcctcttccatccccatccaagagttttgctctcctgcttcattgatcactatgtatttatccaatgccatcacaaatggacgttggaaatacagtcaagaattatacttgctctctgtcttgggggagctgtggacctgaatggggctgggaacaatagacactaccctgtaaccaaaaaacatggtaataaaagttctcatgggcacgaatgaagtgctttggtgggaacccagagggggatgcacttatgaggccaaggaaatggggagaagctggggaatatttctccaagatggtaacagcagacctgggccttgttgaatgaggatttgtgtgagctgggcagagggaaggcagcccctttttcctggtgagctcctaggtcctcaggggcgaggctgggctagccttgctggagctgagcctcctctaactggtctgagctgatgctgaggcagggccccctgagctggtggcccccctgcttcaggaggtggctgaagtggcacagtaactctggtagaaaggggcttcatccacagcagctgaggacttcagggggccccgcttccctcccttggccctgatggtacctgtttcaagtccacccagggagatggggccagatgaacgggaagagggagagctgctgcatttgccgccgtggactcctccctcgttcttgaaattctctgactctgggttctgtgacactagtgtgtcctgtagtatgtatgatgtagtgcaaagacaccatagagctggacagatatagtttcaaatcctagctcctgaatttgaatctctgataacatcttaggcaagttgccctctctgaacctgtttcaccatctacaaaatagagataatagtccatatttcaaaaggttgttgtactcctcgaatgagatgatgactgtgaagtgtccaggacagacttacgtccgtgttcttcttccacccctacctttcctaacctctatgactgctccctccagtcttgttcctgggctccttttcttgcatgagccccttagggtttcccagagctgacatctcttacatctctatcttctcttcacagctccctcctgagttagagacccacacttacagctgcccactagattcaattcaattcaacatttattagatacctatcgtgtgagaatgccactggcccccatgcctgccttcaaggacttggaatcctgtagagttttacccaatggccccagtttcttctgtgaagttggaattgaggtcatctgctaagagtggtgggagtaggggatgaatgggggaccagagagtggtaactgttaaaaatagctatcagagaaatgtttctcaaattcccccctcccttctaccttgtcactgccacccttattcagatcactgccatctcttgcctggaccgttgcaatcaccttctaactcagtggtttacaaagtgggctgaacgttggactcccctagttaggtggggctttttaaaaactctgaagcctggatctctccccagagattctgatataattgatctcagcatggcccaggaatcagcatttttaaagcaccccagttaattctattgtgcagccaaggtgaagaaccactattctggccaggtgcagtggttcatgcctgtaatcagcactttgggaagccaaggtgggtggatcacctgagctcaggagttcgagatcagcctggcccacatggtgaaaaaacccatctctactaaaaatacaaaaattacgcaggcagtggcatgcatctgtaatgccagctacttgggaggctgagacaggagagtcccttgaacctggcaggcagaggtgcagtgagcagagatggcaccattgcactccagcctgggcaacagagcaagactccatctcaaaaaaaaaaaaaaaaaagaaccactattctgttttcctgcctctgttctcatcctcactaatctgttctccacaacacatgtgctcagggggaaccttataaaacacaagtctggtggtgtcgttcccttgcttgtctgccccttagattgtaagttcctttagaaaagggacgatacctgaatcaactctatccccagcacatagcatgggcctggcctgaatcaactctttatcccctgcacatagcatgggcctggcctgaatcaactctatccttagcacatagcatgggcctggcctgaatcaactccatcccctgcgcatagcatgggcctggccttaggacatgcttggtcagcactccgtgaataaatgaatgagtgagtgaacaaactgatcaaccagtaaccaacaaactgacagatagatgttggttctgtgcctaggaatatgttggtgaattatagcagttcaccactgaaccaggagaataaggccagttgggtaccaatctggaagcctggggaaaatgcagggagggagggagggagggaagaaggaggcagtgagaggtcagaaaggcagagtttcctgagaggtgaattatcagagggaccaccatgggtcgggcaagcacctcagccagggagtaatggagttagggaggaagggcccaggcagagccagagagagccgcaggagccgcttaatctgcccctaggaagtgcaggctggggacagcaggcaggaagcagtgggcccattcctcagcgctaatgcccccagcctaacacaattaccccttccttctccctcagcccaggcaagggggaggttgcatggagggcaagcatgccccgcagctggggagggtgggggtcatggctggaaatccaatcaggagttccactttagtattagcctgagctacccattttagctggaggggtttgcatagatgctgggctaaagagatgctgctggaagatctgtgaaccactgccttccctgcccctccctgggtgccaatgggactggatctggagactcccatccccgtcctgcaacccagtcctcctgctgcagtcttacctgtcctctgaagccagtttgctaagtcttgaatcccacctcatggctggcccccactgctgcttctcactccccacctcagcctctcgccctccctctctgctccacattgatataaatggaggcttcggctgcctttaaatagtccgatctatcagaggggcacacgctgcccataaatctgctggggctgatggctccctaagtggactgataggagctatttccggcaaggtgttcagttactctgtccctcccatccctccccctagcttgcccttccccaggggcagggaccctttttgtcatctggtaattggcattttttcacttgcacttggtcctgcagagggagtgcagcgcccagcccagcccctaactggattagcattggctttcagagagggtccctctggggtcgaccttccagttcaagagatcaagatcgagctgttggttcaacaaggaagggggctgaggtgggaggtgggtacccaggggagccaagactaagtgcggagggagggggtgaatgaagtcctcagcccctctctggctaagcctgcctgtatccagcaccctagcctatggagcatggaagagaccagaagacaggctctggagctgggggtctccatcctggctgtcagagtccctctggccctccccgtcaaggctgcctcgggctagctgtgagctttccctttctagaaatgacctaggattgaaagggggatggaagtctgagactgggatggggtttctccagacaagtggtatggatctgaaacagaagctggagaaaccctagggccagctgttagacagtagggggcctggtgcaggaacacacacacattaccctaatttggagggcggctgctaatggatggatttccctgaaggagagaaaaaagacctctggaggctgggacctgctgggggagacacagaaatgcccttggaggtcaccccagtgacctgtggtcaagaggtcactatggccactcagagatcaccactaacatagctccatttcctatcccatccccctgtggttttcagagggcagaaagctgagccagcctcgttataccggcccaggcccttgcccctgccaaggacccctagaatagtcctgctaaggttcttgtgtctaaagaagaggaaaagctagagatggtgaagggcagagaagaatggatggagaatcactcctttaatgcatccgtaagacacttaccaagcttctctcctgaaatctgagttcttgggaatgggaccgagtggaggggtcagtgttccttatcagggtgcgggaggtgggatgctcttgctcatggactctggttagggaaccaggaacagtacaaacagaagacttggaagagtgttgttttgagcaaaacaagacttgcttattacagtgaccccatttctgacccagctgttggggattagaacatagcaagagggtgaagggaggagcatgtgatgagattcccagctgtgtatgatcctgggacagggacaagagttggccacatagcccccgccagagtctcagacctgaaggggaccttttctcctgctccagggaaggggctgagcactcagcagtgaccaactgagaagccccgtgaatgacaccaagaatgcctgttgaggtcatcaacagcatttctcaagcgatcttgagaagatcgtttctcaagatcaggagacttggagagagcctacccttactggggcaggggtgggagggtaagggaaatagactgtttagcagcaatcaagagagattctgaggtggccactaagaccctagggatagcctcacacagcataagtcgttgttctctcttcctcccttcactcattcattcgcttgctcactcagtacactctgactggagctcatggagctcacatctactagggagaaagacttctgaacagacatgaaactcagtgtaccaggcgccatgtgaacccagaggctgtgcgagtccctgctgaaaacctgcctggggagccccatttcaccctgcagctccagactccacccggactcctggaggttcccattgaccctcaggctcctcagactcaacttgtccaaagctgaactatgtgatcatgcctctgactctgttccccagtgagcatccctaactcagtgaatggcacacagagaatcagcgctgtgtcaccactgctggaattctggttcctcctagagtccctcttcttcaatctccacatccaactagagatccatcagagtgtccttttcaacaatgtaggtgacactgtgccactcctctgctgagaatcctccagtaacgagccctcccaatcagggtaaaatccttactgtggccacaaggccctgccagttctgcctccctcagcctccctgcactcatccccacctcactctgctccagccacactggccgtgtggcagctcctcaaacattctaatgatatgactcacatgtattatctcacataggtatctgtgcaccgatgcttgtctttcccacctgtgaccttgagcaccctgaatttatcttaattcttgttggataaattcacctttgtaacccccatccctagcacagtgcctggccacatggtaaatgtttgtttaatgtctgccaaataaatgaatgggcaaatgccagctgggatatccctgaatgaagaaagaccctagagaaatgtactagtctaactcctttgcaggatttggaaggcgtttctctgtagtccttgccctcctgaagcactctccagatgcccaggccaggaatcagcggggatggagttgcgaaggcaggagagtggcagcctgttcaggagaggctgggacgcgtgcagaaggttgcttgggtggagtccgagctcccccaccaacatgttgtgtagcttagaacttattatctctgtgcccttttattctttcatttatgggatgggatgggggattccatgggaaggcttcggaggctattcctccttgaatattctaggatgctacaaaagatggtttgggtccagacagactgggtctgggagctcagcaaaggagcctcgctttggtctttttggcagtgcagtttctaagcagaaaagtttggcttcagaacttggtccatttcagaacttagaggcaaaaacttccttccagccctttaaacagaccttgaggtttttggaaaactgatgaagaacaaacacttcacttgcgggcagtctgaggtgtgtggaagctaaagagaggttgtctgtggcaaatgcactgtctccccaagggagactttggaaaggtgcttttgtctgtttttagactagcctctctccccgccccactatccccaaaaattattataaagaattattgccattagtacgtctttcctactgaaaggagaaaatcgcctcattcataatttataccctcaattactattaataaagaaatatttcagcagaaaatcgcctgggaaaattacacgtaacattgcattaacattctatttgaacattttcatcacatttgttatagagttaataagagggatacggtcccctgacttcttcatgaaattatgggctgacgatgatagtttaatcttttagactttatataatatattcactttactaattgagctatccaaggagcagttagagatgttcttaaatgtggagacagaggaatcagggccatgactttgctgccagaggcaccgcctgtcaggatggggctgtgggcaaagcctgctgacttaggcaccagctcagaccccaccctggcagagccaggatctctacactacctgctgagaagccagggtctggtgggaaggggtgtggggctgctgagggggaacaaggaggaagggagaaggaaggccatggggagctgagaaaaggagacaaaaggggcatttctttctagaccactccttcaatagtcatttgtttagacgccctctacccgcatcgtcctgggccccagcaggagttcatagtctgaaaggggtagcaggcctatgatggtgtttggtattacacttggcagtggttctaggtgctgtgagctcctagaagatcgggcacccttgggaccatcctatgaaggcccctagagacaggtgccagagaaggcgctgcccctaaaggcctttgcagcacaaaggaaggagttgctgtttttcaggtccgaatggaagcgatgggtatatattttgggtaatggggaggagagctgagcgaagttcagacagtccagtcctttgtcactgctgtagtgcctgtgcttttccatccctcatctcagtgaacagcagcaaagctgagaggcagatctagtgagggtggaggtcctgttcctgactcaccttccatgacgcctttactggggcttttcttacaaaccccatccagcgctgtccctttcccttgtccacttttctatgacagtattctgggggatctttggtaacatttcttctgaaaattgcttgtcttcttccctactagaatgtagctgtttgtccgttccatttggcgctgaatgtccaccacacaggaggcacgccatgtgttaaggacttatgttggactaaggaaagtaaagtacagaggggtcggataatgtccccgagactatgtggttagatcagaacaggctaaagccgaagtctcctcctttctatttcacctctgagtcttggcacctctttttactttattgatccaatgtatcaggaatgggaaggcatccagacttctccctccttcacgctcatgtcgcgatgcaggtcactgtcatctcacacttgtgctattgcaatcttcctgcttcctttccggccctcccacgatctattctttgcacagcagccaaaataagcctttaaaagataaatcaggccgagtgtggtgtctcacacctgtaatcccagcactttggaaggtcaaggcgggtaggtcatttgaggccaggagttcgagaccagcctggtcaacatggtaaaaccctgtctctactaaaaatacaaaaattagctgggcatggtggtgcgcacgtgtaatcctagctactcaggaggctgaggcaggagaatcgcttgaacccaggaggcagaggttgcagtgcaccaagatcacaccactgcattaccacctgggtgacagagagagactccatctgaagaaaaaaaaaaaagataaatcagattatattactgctctgctcctaacttttccagaccttcctatcacacagaataaaatccagtgtcctcttcccaacctacaagaccctacagtctggcccctcttccatctgctctctctaccacggccacattatccccatcgttccttgaatacactgagtaccttccccatcagagcctttgaacttatttcctctacctgaaacactcctccttcgcagatcctcatgactctcttcttcatttcactcagatatctgctcaaatgtcacttcttcagagaggcctttcctggccacctgctgtcactctcagcatctccttaccctgctcattttccttcattttgcgtgtgcctacctgacatgccactgtgtctttatttgttggttgcctactccagcagtagaaagtaagttctacattcactgttagatttctagctcctggaacatggtaggtgcttaataaatttcttgaataaatgaatgaatgtttgctctgcttttgtctgcacatgttctatcagggtgatctcatgatcttccatgtaaatgctacaccatatgccagcagcttctaaatcttaacttcaatccaaatcaatctcctgagcttccaactcactttccagccacctacaggacatctccccatgtgtcgtatgtctaacacacatatgtccaaaatggaacataccatttttctcccttctttagctcccatttcattaaatggcaccacaatcttaaatgcccatccagaaacctgagattattacccctcttcctttctcagacctccatctaatcaatccctaaattccgttcatcctacccttaaatagctctcagatcagtccacttccctccatttccaaggctcctagcctagtccaggccacattgccatctctcaccccagtgactgggacagcctccagctggtctccctgcctccggtccttcctctacaggatgttttatggttaatctaaaacataaatcctggagtcagagataatatccaggcttctagttgaggaattagatgataatgactcctctcacattaaatggaagaggaggcagtctggggacatgtgacatttgactacctttgtggcattttaaaacatagctgtctcctcccactaggtggcagaaatcatctcattcatctttatagcctctgtgtcctcagcacccagcacagtgcctggcacagagcaagtgctcttgaatatttgttgcatgtgattgtaccctgaaattcacaagggaagggactctttgaaacccagcctcgatggcaccccgccactgctcttataatatgcatcatgtggttctgtaattcctgtttactcatctgactcttcactaaatgaaaagcccctctttcataattaaagctcagcacaaagtgggtgctgaataatgttttgtgaaatcaatgacaaagtgaatctctctctgtacattgcaatatcctatttactgttccttctacctccttctgatctgctggcctctgcagcagcaagaccagccattctcccaggcaggtcttctctggcccagccacttctcagctctctcggtgtctgtgactcattgcctcaagagtagcttttgatatctgccatcagctgctgccgctaaggattcaggtcatgcttgtgtctcttctcttcaataccaagtaacctttattgtctaagagaaatgtttggccctataattttgcaccattactctacttggggagagatacccatgaggaaggatgttgttcaccaagtaaacaatgaagggaaagatcctccaggtggaaatcacgttgaatgaaatggataaagatgtggagacttgaaagagaagttctcgaggccctcaaagaagaaagcacgcaggagaactgaagagaaagacaggtgccagaatgtggtacagggtagggggagcttataatataattataatatgataatgatataatataaattatataattattataagagtaataatggctattattaattgaatgcctaaaaccctaaaacgtcccaggcgatgtgccagctgcttcacatgcattatctcatttacccttcactagaacactatgtgttgggtgccaaggagtttgaacttcttcttgtttatcttgaggataatggggatccattgaaggctttgaaggagagttgcatggtcagatttgcctgggccctgcccatggaatgctgcatccagaaaaaagagatgtcaggatcaggacagcccaggggttatgactgagctatcagtccatgaggacaccgggctagaaagaagagaagagaccagaatctacagaaggaaacctagcagtgggcatcatggaaagcagacctggagtggagcagaggcctaaaggaggatcaagagcaagcctggaaggaaatcaggagagttcatatcagatagcatgagtttaatgagtttacatccactgacagttggatataggggtctgatttcccaagaggggctcaaggatagagatagaaaatttggaattaatagactatagatggtagttgatttcatggaaacatgtctccaacaggacaaaaaactgagcttactaggccctacatcatctaacccttgcttacctctctggaatcatccctatgtcctcttagagttattttccctctggtcatactgtaatattcagggctgggcgtggtggctcacccctgtaatgccagcactttgggagcccaaggtgggtggattgcttgagcccaggagttcgagaccagcctgggcaacacggcacaaccccatctctacaaaaaataccaaaaaatatgagctgggcgtggtggtgcacacctgtagtctcagctactcaggaggctgaggtgggagcatcacctgagcccagggagatggaggctgtcatgccactggactccagcctgagcaacagagtgagacccttgtcctaaataaatgaatgaatggatggatgagtgaatgaacgaatgaatgaatgaacgaatgaatgaataaataaataagaaaataaaaaatagtgtaatactcacatttccccagctgggccatgctcttcctcctatagcccttgccctctggagtgccttttcctaaactctcccctctgtttggaatgacctctgccctatcccacttcacttggctaactcttacttgtccttcaggtcatatttttaaattaagctttaaatttcttaccattgagaaagtccagaacacatgtttatcctgtgcttcctgcaactcatgagtatactttcttacactgttctgtgctccagtttaagaagactgggtaacatagaaaaagcctctcagggcttcactgtgaatctttaatacatttacttagagaagccagacccagacagttcaccagccccaaagcccaagagcctaaagcctggcccttcagtgctattttgtgagggtaaaggagtaagagagagcacccaggtcagcctgcccctgcactgccattagggattctgcacgttcattcctcctttgtttaataagcacatttgtttgctgtgtcttagatgtcactgcctttgagaagccttccctgacctccagcccggggtggggtgattcctctgtgcttcctcagccgcctgtgctaacccctatgggattgttgcttttgctgtggttttgttgttgttgttgttttgcatttgtgttttttttttattttttattgactcataatatttgtacatatttacagatcacatatgacattttgttacatgcatagaatgtgcaattaccaaatcagggtatttagggtttccatcacctcgagtatttgtcatttctacgtactggaaacatttcaagtcctctcttctaactattttgaaatatacatcattgttaactatagtcatcctactctgctatcaaacattagaacttattccttccattagaacttattccttccatctaactgtattattgtacccattaaccaacctctcttcatcacacgcactccctgcccagcctctggtaactatcactctgttctctacctccatgagatcaacttttttagctcccacatatcagtgagaacatgcagtattggtctttctgtgcctggtttatttcacttaaacaatgatcttcacttccatccatgttgctgaaaatgacaggatttcatttttttaatggctaaataatataccacattttctttatccattcatctgttggtgggcactcaggttgactctgtatctttgctgttgtgattagtgctgcaataaacatgggagtcaagtacggtgggcaaaggacatgaacagacatttctcaaaataagacatacaaatggccaacaggtacatgaaaaaatgctgagcatcactaatcaccagggaaatgcaaaccaaaaccacaatgagataccatcttacccagttagaatggctattattaaaaagacaaaaagtaacagatgctggcaagaatgcgaagaaaagggaactcttatacacagttggtgggaatgtaaattagtacagacgttatggaaaacgatatggagattctcaaaaaactgaaaatagaactaccttgcaattcaacaatcccactactgggtatttatccaaagggaagaaatcagtatatcaaagggatcactgtgctttttattgcctgctctcccactagtctgcaagcttcttaagaaacatttgtttaataaatgaaataattgtgtcccactgtgtgacatgctccataatgggccctgggaccaccaggttgacgaggacatggtccctgcccttgagcaactgccagtctagccacttgatcctcatccgtagagatcacttgggtgatctaccacttcactcaggtgaactaccatagatcacttcatcagagcaacaaattccacttgggtgaactaccatagatcacttgggtgaactagcatacattacttcatcagagcaacaaatgctttccaagtctgtgcatacacataattttctttgatccttatagcagtttctgggggatagtggtagataaggcagagattagttcccagaccttagctaccagggagaatagggggtggccaggaggagtgaactttgttggtgaactttgttgtcacaagttcaccacttgaaagaacagagatggaagccatgggattccagcagttctcctttctctggggctcctaagggcagaagtttggctgcgggaccagatcttacactgttttcattccatcttgaggctgatgccttccctggcctttgggcatgtaggattccctcccaattctagtgcccccagcctaagactggggagccctgggcaaggagaagccagtggctgggctgtgactgaagctccccagcccagccaggacaggatgggccccagtgtaaaccggatttgccttgtaaacagctgagcagctgggctccatcttggcaggggagcccagcaacaacccagcaggacagccccagcccagcagggcattgtccaaagaaaaaggggggaaaaaagctgagtaaacaaagagggatggccagttttttcgtctctgacttgttatttcagccggacaattgctgtgctgactgtgggtctggttgggctgggccaagctgaagtctcaatgatcttcctcacctcatctcctctcttctcacctcagctcaactcactttgccttctctactctaggctcacttctgggaaaggggtcaaagacggaaactgcagacaagtggggacaggctccaggagccgacaggagggtaaggaattgagcatttgccaagtatatatagaggtatatccaaggtcttgttagaacacagagcagaggctgatacagcagattcaaatagtcaagacagtctgtccaacattggctcagatagccccactctggctctcataggaaagttcactctacattccaataatcttgataccaaagttacatgtgaaaccctaggactgtcttcctatcaggtttcacatccaagccatcttcggccactgcccaagtacaagcccctgcagccttctccagtattttcagccccaaactgcagtgcaccccctcttacccgctgccacctctcctcccagcttctcccctctccccactgccacctctcctcccagcttctcccttctccccactgccacctctcctcccagcttttcccttctgccatctaaagcagattctcagctcttgaccacctcaaccttagtgccctttatcaccactttatgtgtccatccctgatcctatgccattcattcatttgacacatatttaataggcatctactctgtgttctcaacacttgaaatagtgacgaacaaaaccctgttaccaaggagcttttgctttagaagtgggaaacagacaatgaaaagatacaagatacttaagggagtgatcagtaccacaaaggaaataaacagcgtggtaaaatactggggacaatggctcacgcctataatcccagcactgtgggaggccgaggcgggtggatcacttgaggtcaggagtttgagacccacctggccaacatggtgaaaccccatctctactaaaaatacaaaaattagttgggcgtgtcaaatgccttttttttttttttttgagaaagggtctcaccctatcccccaggctggagtgcaatggcatgatcacagctcactgcagccttgaccttctgggctcaagtgatcctcttacctcagcctccagtcccagctaatttttagattttttgtagagacagggcctcaccatgttgtccaggctggtcttgaattcctgggctcaaacaaccctcccacctcagcctcccaaagtggctcagatgatgggtagaatcttccaaccagatgaatgcaactgggattttctttctttctttctttctttcctttttttttttttttttttgttgagacagagtcgtgctctgtctcccagcctggagtgcagtggtgcaatcttggctctctgcaacctccacctgccgggttcaagcagttctctgacctcagcctcccaagtagctgggattacaggcgtgggccaccatgcccagctcattttttgtatttctagtagagatggggtttcaccatgttggccaggctggtcttgaactctggcctcaagtgatcctcccaaagtgctgggattacaggcatgagctaccgcgcctggccagtgggataagtatttcaatttgagtccatgccaagggaaggaaggctaagctgaagagaagctctgggggttatttgatagtaaatttagaagaaagaagtcggcaagtgctatgggcccccatgcatctactattatttggatcccagaacacttcaggggatagagagttctgttccactctgcacttgtcaggtagcggtagatccacctggaggacaatgtccagtttgggagaagagacactgatcaacaactctaatcactcccacagaccacagaccctgatagtttgccaagaatgacacctgcctatggtttagcatccttgatcttcacaaatatcctgagagtgggataataacagtagctaatatttattgagtgctcacagtgtgcccaacattctttattctgttttccacacagaaaatcatgcaatcctcaggccgggtgcggtggctcacgcctgtaatcccagcactttgggaggccgaggcgggtggatcacgaggtcaggagattgagaccatcctggctaatacagcgaaaccccaactctactaaaaatacaaaaaaattacaggcaggcgcctgtaatcccagctactcgggaggctgagggaggggaatcacttgaacccaggaggcagtggttgtagtgagccgagatcacgccactgcactccagtctgggtgacagatcgagactctgtctcagaaaaaaaaaaaagaaaaagaaagaaagaaaatcatgcaatcttcataacaaccaagagatgggtagactaactgcatatttcaaatgaagaagcaggcagaggggcttaagtaacttgaccaagaccacacagtcactgagcagtaggaccaagactcagacccagactaccgaggagtctgagcaaagaaaggacagggaggcttgatggaaatcaacactagttgctttactaagtgctagtgtgctgcatcttaatctctccctagacttggacccccagtctgagctttgactcttgagttctggcgctgtggggcctaagaacagggtggctccatcactggggcaagcagcctcttacatgtgagcctgtttgtctaagggcaagaatggggaaaactgtgtacttgaagctatttgctaggactttgggacagttggttctggacactcatccgagacaaccagctatttgtggatattgtttattctttctgctcctctcctcatactgtgacttctgctgacctcctctgcttaagtaagtccccactgaggtcctgacctatctttggaccatgtcctgaagaagttgttccaggccaggcatggtggctcaagccttcgggaggctgaggtgggtagattgcttgagtccaggagtttgagaccagcctgggcaacatggtgagaatccatctctataaaaaataccaaaaaattagccaggtgtggtggcgtgcatctgtagtcccagctactgggaggctaaggtgagaggatcacttgagcctaggaggcagaggttgcagtgagccatgtcatgccactgcactccagccagggcaacagagcaagaccctgtctcacaaaaaaaaaaaaaaaaaaaaaaaaaaagaaagaaaagaaagaaagaaagaaaagaaaagaaaaagaaagaaagaaagaagaaattgttccatggagaaggttgtcccttcatctagtgttaggataaagaaactgaatctcaaaaagatgaagaaacttactcaaattcctgttgctattacataatgaagctgggattttgaaccttgggcctccaactccagatgctgtgcttttttccccttttcccaccatgacaatagaaaatgggcctaatgttctcagcagaatagaactggagtgcctatgggtcaggatatttgaaatcgggtcatgttggaaatcactgaatggactagaaatgttcaacttagagaaaagaagactccaggggacattattgttgtttttagatttccaaaaggctattgtgtgggacagagatcaaaccttttctgtctgagcccaagagtttaaacacagaccagtgggtggaacttccagggaaatagattttagctcaagctgtgtgtgaactttctaaacagccgaagctccccagagcagcaaagccgcctgaggatgtctggagcctcctggcctcggaggtgtttgggcaggccacctattaggaagattgtgaagacaggctagaccataagaccctttgaggctttatagagaacagtctggggttctgggctccaatcccagcctctcccagccttcagagctctggaagctgctgagtgccacacctgccacctgacctgctctgctggttgtgtgtccctccttcccaaagcatcctccagcttctccaggagactgaggagtggacagtggcatgcctagggcctgtgtccattcgctgtgtggccgccttctccaggccttgctcttcccttgattttgaatagagcttcctagagcaggaagtggagtcaaggccatgcccagagccagagtctgggccaggagaacttcatgggagaaaggctcatctgtgcttaagagctgaggtctaggccaagccttggctgagagagagagtgtccggaaggactgcctgtctggtgctgatcggggaaggttcatttgatgacatcttcattaggattttcctctcatcatacggactctgcaccacactcacacacatatataactattggaaaaacgattttaatacccatggcacattgtccttgtgtgatataaaatccaatgacatgtggcatttggaaaaggtcacttctcccatcaggattcattagcctgtttcagcctctacgccggcaggacaggtcccagctgcttgtcccctgcagtgaggccagttggacaggtggagcctacagggaccctccctggagagcaaagggcctccccagggtgccggccagggaatccctgctttggccaagctctttcccacacatgcctggggagtagggaagggtggtttccagaaaaaatgaaacctctggccaggcaaccatggctttcaggtctggagtgcatgggaaacggaaagtcaggaccaaaccctcagtgtttttcctaagacgatcatcctttggcagagagggacctttgagggactctggagagagagctgagggacagggtggatgcaaagaggaggcaaaggacatgagggaagaaagagtcctagggggctggggtgggcaggatcctgggccttcctctgggaacctgactggaacctgggatctgctggtgttctctattcattcctctttggcaaagctaggacccaagcctgctcttcttgctccattcttgtgttccttgtgtgctggggtttcatctctaggtgtgaagcagctgtgcccactagccaggtcaatggaaatggacattttctgtcaatgctggtgtcaatgtggccaagggaagcgcccaccagcaccagcatctatgcctccctgactttccacattcggcctggccagcactcaccttgggaagttacttccttacagctaaacggagctgcttctcagatccttgggctgttggtttgtttgatgggagtcaccagatcacagaagaactctagttgcagagtggaagaatgaggacagtcaaaggaagagagaagactttgaaaaaactagagctggaaaccaagaagccagtaagcttggatgaggggaacgggaaagagatgcaccctaaggcaaagcctgagaaactggcagcccacaaaagcaggggtcctgctcctgagcggcaatgtccatccactcccacatccatgcacccctcttatatgtctgttcttgccgtccagtatttaaaggatgggaaaagaagggccctccagcaaagagaataatgggtgcccagtgatgcaggaagaaacaggggactgaggtacccaaagccaagtaaaaaattcaagaagaagcgagtggtgccgggcgcggtggctcacgcctgtaatcccagcacgttgggaggccgaggcaggtggatcacttgaggttaggagtttgagaccagcctggccaatatggtgaaaccccatctctactaaaaatacaaaaattagctgggcgtggtggcaggcgcctctaatcccagctactcaggaggctgaggcaggagaattgattgaatccggaaggcggaggttgcagtgagcaaagatcgcgttactgcactccagcctggccaacatagtgagactacatctcaaaaaaaaaaaaaaaaaggcactttgggaggccgaggcgggtggatcacctgaggtcaggagttcgagatcagcctggccaacatagtgaaaccccatctctactaaaaataccaaaaattagcctgtaatcccagctattcaggaggctgagacaggagaatcgcttgaacccgggaggtggaggttgcagtgagtcgagatcacgccattgccctccagcctgggcaacaagagcaaaactccatttccaaaaaagaagaagaagaagggagtgatctactgagctcaagtcactgtccgtggagtccggtgaggattactgagacttaaccatcagaactggcaaaaagggaacgcttgtcaatcccagccagagcgctttcaagacaatatgagaggggaaaaagagaaaatgatgaatatcagtttctcttttgaattttgcttccagaagcagatatatatatatatatacttatacaaagattcattattcatgtgagaaacatttattgaggctctaatctctgcaggttctattctaggctccgtgtacccagaagtaagcagcacagtccttgcccttggcttctcgcaaagtaatcagtgaatgaatgggatgaagcctcacttctcccactgacaattttagcttcattttcatagctgttcaaacagatactagaaatctgtgccctctctgtttatgaagttcagcatgtcccagcttttctaacctgtccctattccaaatgttttgacctattgccataccatgtagtcacactggattctaatttttgatttagaaaatgtggtcattactggattatttcgagaatcaaaagaatcaaagaacatcacttctgtgatgtgctaagtgctctatcagtagaaggcattattcaaaactggcttagactagagaggcaggttcagccacttctttctttgtgcattcagggtaacctgtacgtccttccttcccagcaccaatctcctttctttttaatgtgttttaaggtatgtgcctctcattccaaattgtatctgacacagggcctggcacgcagtctaatttctcagtaaagatttattgaatttctgaatggatggataaatggtgggggcatagacaagtagacagcaaattatgatttaagacagaatgaaatgataattaccaccactaacattttttgaggacttactatatacaaatccaatgctagttcctttacatgcattctctcacatcattctcacagctacaacatgaggtacatagcatcgtgtctcttccagatgaggaaacagaggctcagagaggttaaatgacttgcccaagacaccaaggtcacctgaagacctgggaactccagctcgagcagcccaggctgctcaccctgacctagccagagggttacaggaaatgtcctttggcccttagattgtccctcctttggtccactcaattcagaacccagacaattggccatgaacccaccacttacgtcttcacccctccttcatcagggcgggtcaagctagtccaaccctagcagccgctaggaaggagctgtccagagcgtggttcattcctcttttatagcccttgtcaaattccaaagcaagtcgtaaattcattaacctcgtagggattaagctgtgcagcttacttagcaccataaacaagatcattgggatgttgattttccccttttattgctgcactcaggaaagcctagctggctccagctctggaaataggagttggctcccctgaaggttgtcaggatggtggggaaaccctagctggctgtccctcagtagttgcaggtactggaacgtggggctcaggtatatgtagcccaagaattgctccccaagcttgtcttggcacagccagaagtaacatttctttttgttttttgtttgtttgtttgcttttttcttttgagactgagtctcactctgtcgcctaggctggagtgcagtggcgccatctcagctcgctgcaacctctgcctcccaggttcaagtgattctcctgcctcagcctcccaaatagctgggattgcaggtgcctgccgccacgcctggctactttttgtatttttagtagagacggggtttcaccatgttggccaggctggtctcgaactcctgacctcaagtgatctgcccacttccgcctcccaaagtgctgggattacaggcgtgagccaccacgcccagcccagaagtagcatttctaatccagttgcctgagctgtcaccatgcatcctagggaaaggcagaggagagaagcccaaatgtctacccaccaggtcacctggctctcctgacaaagatggtattaagatgtcatctcccgtctcctgactccccaggccccgtgggtttcctctagtgcctctcgtccccaggtctgtttaacccatctatctctccagtagactaatgtccctcactagcaggaactgttccctctgctagcacttgggatcccatttcctcatgtccgtctgaagcctggctccagcagtgatcctctgtcctggagctccaactctctttcatacaccaaaaagaaaatccagaccctgtgcttcctaagacaacggcaatccctctctctcctccctccaacttctggaacagtgtcatgcctgacatctgtctgcactgcttccctcccattcactccgttaaccatggctgttctacctaagtccctacctctcccttgaccctgcttttgccaaggtcagcaacaacttcaaactatcaaatccaatagatgcatttcagtcatttgtttgtcatctcttactcagcagatatttagtgggatcctaggggctggtgacacaagagtgagcaaaacagaacaaagcagagaccacgagaagttaaatatagcacagtgaccataagcacagcctccacctaggttcataccttggctctgctgtgtgaccttgggcaagttccttaacctctctctttttctcatctctaaaatgggataatcatagcaccgttgggaagattgttgtgagattgtctgacctttaggtcagagcatggtgcacagcaggtgctctggctatgtttggtttaggtaatttgcctaacattataccctggcaagcagcagaccaggctgtagacccgaatctacctgactccaaaaccttcactctctgttgtcatcaggctgcctccctgttcttcctgcctcccacctccacccccattgccctgtgctatttgggctttgcatagggtagttacctggaaaacatttgtttaatgtaataatttaatcagtagttctgtgtttggggagtctaggtagttatttaatgggaagaaatgaggtggtggaaagggagctgttttgaagagaagataattatttctgacttaacatgtttcactggaggtgacaatggagagtccaaatggacatgtcctttgggcagttgacaattcggtgtgggcattcaggagagacatcaaattggaggcaggtttgggagtcctggaaagttgacgttcaagagggtaaaaagataaattctctaagagcaaagggcacagcagtgacaaggtccccggatcaggtcagtggaagaggcatgagggacaaggtaaggatagagggtggtgtggaaaggaggacaggagcgctgaggaagagccccagatgcctgaggagggggtcacagctccagggacccagggagctgctgcggatgacaccaggacagcgataagagctccatcccagacggtggggaaggaaatgaggcgacaggcacaggtccttgttccaggaggcagactagaagacagaagaaaggaaggagatagaggaagcggcaaggtccagggaagggttggcccttttaggagacagttacacacaacgtagaagacagaggagaaaggaccgctctcgtggcaaaaatgcaagagcgagaggaatatcgcaagggcaaggtccctgctgaggatggagagaagtggctctaagggacagtaggcactggttttggagaaaagacaaaagttctgaaaattgagggaagatggaaaatcaagtggaggcaatggatattaagctgaagagagaagtggctaactccttttacatggggttctcagtaaccgcatcataacaatgataattaaaagtttatatatgaaatattgtccccctccagtctctaccggagacacctcaactgcccttggatgggcagttgatcccttaacaacatgggcaaattccccctaattcccagttccttctgttttttttaaagttggtgcagtttgaaattccactattgtatcttcttctcttcttcttccttttttttttttttttttttgagacggagtcttgttctgtcacccaagctagagtgcagtggcacaatctcggctcacggcaacctctgcctcccaggttcaagtcattctcctgcctcagcctccctactagctgggattacaggcacccgccaccacgcctggctaatttttatatttttagtgaagacaggtttcaccatgttggccaggctggtctcaaactcctgacctcaggtgatctgcccacctcagcctcccaaattgctgggattacaggcatgagccaccacgcccggccactgttgtatcttctttaaggcatttttccccttctcttcatcaccttgtggcaaggagggggtggaaagagatggggaacattcccgccccctctgtgctggcctcggctcctttgacagggaagagggagggggtggaatggtctctcttgccccgcaggctgctgtagtctagctctctggtggtattagtttccctggccaacagacaggcatcagggttctctgtagggctggttctcttctagggcacatgtgttccgataacttaacctgcttgagcctttgtttcctcttctgtaaaatgagtagctctggcttggaccggccttacaggggcagtgttaaggattagacaaatgcttgtaaagcaccttagacacagtgcttgctccacaaatgaactcccattaccagatgcgtgcgtgagatagctcctggcatgaatgtgcatttgcggctatgtccagatgtgtgtgtgtacctgtgtgtgcaagggagagttatgtgtgggctggggatggggcacccttgtgagtcagctattgcctgtgtcattgcctacagctgaccccgaggccataaatcctgcctctgtacccgctagagtgaacaccttatagcccaaggtcaggcccatgaatcataagcggcgctggcaggaagcaatcaggcagggctgggtagagctgggcaagagaaggtcccagtatttggaccacttgaagaggagccctgggcatatcctgcaatcctgatctctgggagccgggctgttctcagcaggacggcagctcccatggaggctcgctggcagggagcccttctctacttgaccgcatctctcctgctggggctgccaagcggcagacctgccctgccaagacaggcctgtcctgcatcccgggcaccagcacggccagtaggcgagctgctcttcaggcctttcccttggaggcttcagagtccttagcccagcacgctcagcctggtggatgtggagtagccgccctctaagccagatgattttatttcttctttgcctttccaatctgtcttggggaaagtggccccaataaggcagtcctttcactctgaaacctttttatgactccaaccataattaactcgagtaataaaatttttcaaatccaaatagatataattaacatttaatgcccctggttggtgctggtagctgggcccattaagagcacagtattgattgagaaggtgagccagctgggccgactgctgggccagggggcagaggtggctggagcttagggctggctatgagcagggccccagcacaggtgtgaggagggtggcaggtgaccaaaccccaaccctacctggggttcaggtcatgactaccgaggctggggtggacttcttcctgccatcagtttctagtggctctcccaccttcagactctgccatctcaggcctctcctgccatgaagtacttctccaccaaccctcaccctgcctgtcatgtgcctgaggcctgcctcctctcctagaatttatcaggcttcccaggacaaggctgtgtcttctctctgaggggccccctggctccagggcatgccccttcccactatttctcctttctgacttgcctgctcagctgtgtgctgcaggttgaactttaaacccactggtcagatgaaaagccatatctgtcttctagacatgacttacacctcccaccaaacttcactttccccaggaagctatacagtgagacagtgccagaagcattcatttgaatcccaaccctccatttcccagctgtgtgaccttcggcaagtcaccatgtttccctgagccccagtgttcttatctgtgaaataggtataacaagaatatccacctcctggccgggcgtggtggctcacgcctgtaatcccagcactttgggaggccgaggtgggcggatcatgaggtcaggagatcgagaccatcctggctaacatggtgaaaccccgtctctactaaaaatacgaaaaattagccaagcgtggtgacgggcgcctgtagtcccagctactcgggaggctgaggcgggagaatggcgtgaacccaggaggaggagcttgcagtgagctgagatcatgccactgcactccagcctgggtgacagagcgagactgcatctcaaaaaaaaaaaaaaaaaggaatatccacctcctaaaggtggagtcataacagtcttgacctcacttaggtttcacaggattcccaggtcataggaattactgtctccattttacatggaaaaactggcttaaggaggcaaaatcctcatcccttgtgtcttatatttctgtctctaccaatagttaatttaatatatgtttataaacaacacctaagctgggactacaaagaatatgatgattccttgactcaaggtgctcgtggtctgggggtatgaggcagggagaaggggtgcacacaatcagctggtttaagttaaggctgcacgggaggtgagcaggctctggaccctggtgcaaattaagatgcaaaacgctacaggaaaaatgggtgaaggtcatgggcccaaggcaaagccagatatggggatggacagggcacagtggggctgatgtgtgtggttctgtggcagtgcggatgctggcccaggtatggtcttcagagcatgcgttttctgtgatgatccctgagccaaggagcaggctggtaccaggattcacaggtgtggtttaggacatcccagctcatccactcagcatgttagaaggaccagccttccaggcaatcactcatatgaggccctttggtgagctgggcagcccaagccctgctgggcaaggaaagtccggggaggggctgaaatccttcctccatccaactttgctactactgtgtccccctgctcccaagcttgtggtcctgtgctctccatgatctcagtattctccatccttcacggggcttcctctcagtggtactttcccagcctgcaggagccccatgcttcctcagagctctcatggctcaacagtggctttatatgtagggccctgaatacatcctgctttaggctaggtcttgcattgaactaaacttgggtgattctctgctgtgtccggttccccgctccccagaatgtttgcccctggcaggctctgttctttcagtccagctccatgcccagtgctattactcaggaggccatggggagtggatgccgctgataccagagatgatgaataggaagcgggggggccagggaggattcattcaccttccactaattcattcatttgatgtcactcactgtgccaggccctgttaaagaaatagacaagtaaaagtgtaatcacaattagggaagtcttgggggctagaggacacacaatctagccagatgcttctgatagtactgcctcctagaagagttaaccttgaagctgagccctggaagatagttttccaggcagagggaacagcatggtttttgttttgttttgttttttgctgtttggtttttctttgagatggagtttcgctcttatcacccaggctggagtgcagtggcatgatctcagctcactgcaacctccgcctcctaggttcaagcgattctcctgcctcagcctcccgagtaactgggattacaggcacccaccacgccatttttatatttttggtagagacaaggtttcaccatgttggccaggcaggtctcgaactcctgacctcagatgatctgtccacctccgcctcccaaaatgctgggattacaggcatgagccactgcacccagccaggaacaacatgtttaaagacccatttgagaaaccaaaagaattcagtgggaccaagacaatggtgtgcaaggtgagaggcagcaagagaggaggctggcaggtcacctatcgtccatgcgcaatgcccttgcaggccttgctaaggaatctaagtcctttcaagtcccagagccattatgcacttgcagtgggacttaggtatcttgcttgacttctctgagtcttggttttattcttactaagtgaggtcagtaattccagctacgtccgccatgtctaaggatccaactgccttgtgctgggccagtccctggcttattagggtgtggttagaggcatggccagagcgtgaacttctgcaaaggaatattctagtcacaagccacaatttcctgtctaaatattgagggggcaacaacatggtctataagtcctcccggctctgaaatgcccgcagaaagaaggcccatgggaggccccactcacctttagagcctggaccctctcactcctctgtcctcctcctcctccagccatactagtcctgctgggctgcctctgggcctttgtcttaattttcactccactcttccttctcttgccatctgacactccagacttctctcctccaggaagccctctccacctccgagccctgacctcctcctcctcctccttactcctcacttcatcctcacagtggtatcttaggtgctcaagccgtcccccatcctgtgagcttctgagcctgggcctcactccttactccacacccccagaggactggcccacaatctttgagggtgttccaggactaagtttggaaaaggacatgataaaaatgaaaggaatgagagaagaaggaagggagaaacagaccaacagacagagagagagagggcgagggaaggctctgcctcaagccaacccagcctcagtcgtggtatacttccccgaattccttcccgcagcaccactctgtgcttagaaccaagagctaggagagcaagggagcctgggactggcacttttcagctagggggagctggtggtggcagggcagagaggcccattgcgcagctggtaacaggctgtgcctggccaggcctcccagctgcccctctgtctcaggcccttattgcacacaacatccagcccagccccctacgcagctgccttcctcatgacacagccctgtgttgtcctgttggccactgaccactgtgcctggggaagggccaggccttcctgggaggaggaactcgagagcctgtgggctcccaggttggcagcccccgccctctgcactcccaggcccatacctgctctgtgattccccgcttggggcaggaaggcatgctgagagccactctgcaagtccctgtgcttcaggtggtacacgctcctctcattcatttgttaaagcaaggtgggggtgagtattatcatcctcagtctctaggtggggaaaagaagactcggatgggttacagcagttgcccaaagacacatggctagccatgcttccaggtgctttcaagaccaggtctccccgaggccaaagctcatgttctgccctcccagctctttgcctaactcctgttccctatgacagcccagccctggccctcgcattctgcctacaatggagccaccaggataggacgcagggagtgggagtagagggggatgccatgtggagagaaatgaggatataagcttgaggagagaggaaggagtttttgatgggggggatgggcccagagctgccatggtgtctctacagctctctcttttggtcacagaagcccagcaggcagacacagaacagatccaggagcagaccatacccaatcttctctcccaacacaggcccaagcctgagccagcccacagggacccaccagtttgtttggcaaagcccttttccctgttccatcccatgccctagacccgcagagggcagcaagagatgagacccactgtcctatcacagtcctgataaggatttctttgaccagatgttttcagtgtaggagtcagaacacagcatcggactattaggagcccaaagtttcatttttaagctttcgaccaacatgacctcaggcaacttttacctttccctatctaaagaaatttttcatatctaaagtgctaaatatcacaagatatcaataataataacaggccagggtggtgcctcatgtctgtaatcccagcattttgggaggccaaggcaagaggatcgcttgagcccaagagttgaagaccagcctgggcaacatagtgagagcctgtttctacaaaaaataaaaactacctgggcatggtggcacaggcctgtatcccagctcctcaggaggctgaggtaagatgatcatctgagctcaagagttcgagggttcagtgagctaggatcgccactgcaccagcctgggtgacagagtgagaccctgtctcaaaaaaatttttaaatgatataaaataaaataattgcactcttaaaaatcacaaaatatgagacttaaaagggataaactcttggccgggcatggtggctcacgcctataatcccagcactttgggaggccaaggcgtgggtggatcatttgaggtcaggagttcaagaccagcctggccaacatggtgaaaccctgactctactaaaaatacaaaaattagccgggcatggtggtgggcacctgtaatcccagctacttgggaggctgaggcaggagaatcgcttgagcctgggaggcggaggttgcagtgagctgagatggcaccactgtactccagcctgggtgacagagtgagaccccatctcaaaagaaaaaaaaaaaagggataaactcttatagtccagcttgaataacaacctaccacccctgcaggaatccgcttctgcactacccagaagggccaggcagtggacagaaaaagaaaagtgaaaggcccccaagagaaactttgatttgaaaagaaaagccctggagggcgctttgcctccccccctccctccttgttacttcattccctcctcctcctttcactccctccatcctacccccttcacctgcacttgggactgggctaatggacatgcttcctcccagccttccccacgtcccaggaagtggagcccatcgggcagagcagagccgtacggggtaaggcagagacagaactttccccaacagaaatggccttgcagggagagtctgggagagcagggagagcctgttctcaactagactgccaaattgctcttttcctttgtctggagcaatgcctgagctcccttgctgagttctgtaagagcctgatccaggcatgtgtccccagaccctattgccccaccgccctggctcaggctggtatccagaagaaggtatggcagaggaccaggaaggttatcagagaggctaagggggcattcggtcttgggacaggactgaagcaatcaatagcccattgggaactggggttaatttggggaatttggattggattggattgaagtttaggacttgggctaggaggtagggctgggttggttcaaagtactggagttaggtttaggttcagagcttctctagaaactgcccaactcatgctggtctagctaagcccatctccaaaaaaagagggggctctacccttggcctctgattcggggctttatttaaagacataggagtgagggtgaagattggctttggaagacagcagagccagtgcctccccactatggagccgtttagttaggaccttgccactcaaagagcatccacagacccgcagcactggtctcacctaggagcttggtagaaatgcaaaatctaggatccactctagagctgctgaatcagaatctgcgttttagattaacctccaagtgttccatggacacttaaagaaagtgtgagaagcctggtgaaggctctgagtgaaggaaggcccgaggtaggggtgggaggccaaagggcacccaacacctcggccggctccggggcccctgcctaacaccccctcccagtgctggagccacagcgacacctactggccacggacacctaggccaccccctccaggacgcccgggccctgtggtccatctggcccagccagtcctgcaccctgaagctggcattcctgagttctgggaatctggctccccgggacagactaggggagcaggtacaggatgggccagggctcagtgcacagcagggttgtgtgcaggctggggctctggggcctcagtgtgaagaagacaggatcagtaagcaggtgttttctcagggacatgatgctcagatcacatccccagccctggcattctctccagactcagcaatactgagcacgtgtttgtctgctctcttcactgaaaccctcagccagaatggacagggtacagctttccattccaaccagcatcaagcagatgccctgtgaggaacagagatttttattttactttttattttattattttatttttatttattttttattttttgagatggagtctcgctctgtcgcccaggctggagtgcagtggcgcaatctcagctcactgcaagctccacctcccgggttcacgccatcctcccacctcagcctcccgagtagctgggactacaggcgcccgccaccacgcccggctaatttttttgtatttttagtagagacggggttttgccgtgttagccaggatggtctcgatctcctgacctcatgatccgcccatctcagcctcccaaagtgctgggattacgggcgtgcgccgccatgcctggccgatgagcaaagatttttgaacctatgtctaaatgactcttctggaaatggacttttaggaaggacaacaactaaaaagcaactcaaggaaggggagcaggtaggatatttctgggatatttccactgtagtggtttctggagactcccatgaaagaattctaagtcaaaaggggagactgaggccaaagggcagagaagtaaaaagacagagaaggggctgggtgcggtggctcatgcctgtaatcccagcactttgggaggctgaggcaggtggatcacctgaggtcaggagtcagagaccagcctggccaatatggtgaaaccctgtctctactaaaaatacaataattagctgggtgtggtggcaggtacctgtaatcccagctactcgggaggctgaggcaggagaatcacttgaactcgagaggcggaggtggcagtgagccctcgtgccattgcactccaacctgggggacaagagcaagattctgtctccaaaaaaaaaaaaatagtacagtgctttgcacagagtaagcatttgattagtgttaccacttccctcagtcacaaaaaaaataaataaaggaaaaacgatagggaaggaagccgacccacttccaaggcaaggctcagctgacccatcccaagggacctggctggcccagggaggagagaagggcctctttctaggcagcagtgagcctcccctcccatcattcccaaatgccagttattgctggatcccttccctctagtccgctctcaactatgaggagtttgcccaagaactaaatgaatgtgattgcccaccagtgtttgccattagtggtgattagttaaaacatcagagtctaaacagtcaattggttctaataattaatactatggctcagctgtgattgagagagaacaagcgagtgggagagaggaagggaggaggataagggacatggaaaaagaagagagaaagggattggcagaggagctgcagctctgtagctaccatttcctgacccacatgccagatgctgtgctatagagtgcatccagctccaaattctgtgctctttcgagacattttatgtaagttataccaccaaggtatcctaatcaccctgttaggcaagtataattattatcttctttttataggtaagacaaaggaggcacaggaaggtaaaagctagcagatgctccgtaataatttggtgaatgaatggataaataaatgaatgaagtagccagaagtgaaattcaaacccaggttagcatggctccaaaaactttggggggaaaaggggcaaggaggggagaatttgaagagacaaaggaaaacaagacagaaaacgtacatccttctctgtctcaacatacatacacgcccttctctctctctctctcatgcacacacacacacacacacacacacacacacacacacacacacgaacctccctcacctccctctctcacgctgtgcccctccctcccatccacacctctcacgttcttttcatacacaacatgtctgttatgcacccctttctctcatctcccctcacacacccactcttgcacacacaccgtttctcacgaatgtctcccagatggctccggcacacacgcacctctctgtctcatagaagcctctcacatgcacatattcacccctctctcagccacacttttttatttctccttgcacacttcttggtctttctcactcttacatggacctctttctctcatgtacacgcctcctcttcccggcgcccttgtctgtcttcctcagtgcgctatctccagtctcaaagacagtttgggaaatgaaataaacatacacccgtctacctccttcacatacaaccccccactgtctcctcacaccccaccccacccacctctctctctctctctctctcgttctctctcgaacacaggtgtacactttgggacatatcctgaaaccagccccctcatgccccctgcccgccccctccaagagtcaggcctccagatgtgctctctctggctaggcttgctaatctttgaactgtccccagatcttgaatggtcatgtggactttcctgcctggtgatggggagggggaaacagggagggggctaagcccagagtcctcagttattctggagcaggttcagctcctccccacccctccccaggtcatgagcagcagcaggagctgcaagcgagcaagatggctgtgtgtgtattgctattaatcacccctcctggtccgctaacgaggctaatgcggtaagtgacaatagcccatcttggttcctgatttaggggctcaggacggaagctgggctcctgggagtgaagacgtgaattctccacgacactaaaccttcaaataaatctcctccagtcagagaagcccagggcactaaatcccacacgccggtaattgaaacccttagagctttcttgggtagggaaattgctgagtgagagagagaaagcgtgcagcccaggggttccgggtggggcttgggcccacagagaggcctgccgagggctctgggataggggagctgctggggaccctctaggagcacgtgactggccatatgtcctggtgtgcatgtctgtcagtgtttctaggcatgggattttgctgtctggttatgttcacatggtcactggtcacccatttcccaccaggtctatgaccacttgatattttggtaaggagagcagttctggagcttctgtatttcgagagcttctaccctttgacacccttagggcctctgactctcactgaccatgaagcaaggcttcatttaagcaaaagaaggtttcggcattgcctcaattgccttccttcccctatccccacctctctcaccctcacacttcccccaccccatctctctttttttccagacattctcctgcaggcctttcactcccattcacttagtccctgaatcatttaacagttactaatacccaccctatgccagactgtatgcctagggtcttgagtgttccaggatgaatcagagaatctctctgccctcaagaagctcagcatcagctactctgggcacactgcctacggggtagccctgctccacaaggagcagtaaaaaaattaaataaataaataaaacaaagagctcagaatctcccagacaagacagataaataaataattgcaatattatatgatgtatgcaataatcgacatatagacatatgtggaacatagcatgaaaaagagagtagttaattattagggaaggcttcaaagaggaagcattgtctgagtgtggtcttcaagaataaatagggtcaggcgcggtggctcacatctgtaatcccagcactttgggaggccgaggtggacggactgcttgagctcaagagttcaagaccagcctgggcaacatgacacaaccctatctctacaaaaagttagctgggcatggtggtgtgtgcctgtagctacccaggaggctgaggtgagagtatcactgagcccagcagtggaaattgcagtgagctgtgattgtgctactgactccagcctgggcaaaagagtgagacccagtctcaaaataaaaaaggaataaatcacagttaaaagttgcccatggggagatgatggcatggtcatgagcattattggcagtgagaataccagatgaagagctacattttgtccagccagagcacacactattgcaagatgggataggaggctggagaggggcatgtatgataaagagttcagaatgtatgctgtggctttaggaaccagggaaggatcttaagcagctgaatgataggatctgatttgtgttttaggaagatccttgtaactgtagggatggaatagattagaggggagagagatacatgaggagacctaagagtagggactgaatatgaagatgcctaaactagggcaatgaagaaaagaagatgattctgaccagtacttaggaggtaaaaacagggaagatgttgacttactggatgtagggactggagtaaagagtaaaaattaagattgtcaatttagggaggtctctggatagtggtaccattcactgaaaccaaaagcaggaggagggcaggtctagaggaaggtaagtcccatctcagacatgttgagcttaaagagcctatgggacatccaagcagagcatcttctacgcagtgttgtacgtggctcagattggaggtacaggctgagggaatgaaaccagagtttcagagatcacacatagagtgtggagagagggagaagtgaatgatgacaagggcaatagctaacatcagaggcagcagaatagcgtgactaagagcatgcatggggctgtggtattacataagtcccacacagccacttacctcgtaaccatgggcaaactaagaacttctctacgcctctgtttccttacttataaaatagggattaaatagtacagtgctggccgggcacagtggctcactcctgtaatcccagcactttgggaggccgaggtggatggatcacctgaggtcaggagttggagaccagcctggccaacacgatgaaactccgtctctattaaaaatacaaaaattagacagatgtggtggcacacacctgcagtcccagctactcgggaggctgaggcaggagaatcacttgaacccgggaggcagaggttgcagtgagctgagatagcgccattgcactccagcctgggcaacaagagcaagactctgtctcaaaaaaaaaaaaagtacagtgcttgccacagagtaagcatttgattagtgttaccacttcccttcttcctcatctcttcaacaagtacttatctatcacacctcagcttgtgtctctaggtttctctgaacaaggcaaatatctatattacaggctcccacagcactgttgacctctttttggtacaattgcaattttacaattgtacaagtatgttattgcatctgttctctcactagactgttagctccataaggacatggatctcattgtatccctagaccccggtatattgcctagcacatggaaggcactcaacaaatatttattgggctaataaataaatataactggagtatctattgtggatgatcaccaaggacctcactgagagtagttaccatagaatggtggggatgaaactcaggttgcgatgagttaagaagtggttaggaggtaaaaaagtatgggcagcaagcaagagtctttggagcatcttaggtgagaagagaaggagaagaaaaggccattagtaaaagggtgccatatggaagagagagctgggttgttgatgctgatgttgctgtaatatgggaaagacgtgggagttgatatgctgatggaggaaagcatgaggaagggaaggagaagatgcagtagagagggagaacttgacagttttcccagggaacataggcaggattggtatcaaagcccaggagaagtgattaggctaaagtaggaggatgcctgttccactgaaactggagggaacagggaggtgagagtagatccacaagctgaggaaattcatgcctaaggactaaatttcagagtgaaggaggaagcaaggccacctagcagagagagggggacaggagatggcgaggcggctcaagatagtaaaatattattgaattgtctctgtgggaaagaggagacggagctgaccaagagcatgcaaaaggattgtttagtggtgctgagattggaaactgtgaatttttattggcacatatctgcatggttttgtgattttccccagctgtgcttagccgcctgagtgtctgagacaaaaaggagaatagttgggttgtggagaaggcaaaggaagtaagaagttgagtgtgttggcaagatggtgttgaaggtgcacaagggacccaggctagcatccatgagtgcgtggtggcttgggagttgggagaagggaagagggaggagcaagttaaatggatacaagtctttgagagggcttgggggagagggagttccgtcacgggttctacttaggttgatgacaaggatctccaggaggaagtcaagaacaggaaaaaaaataataggagctgaggaggtcaggacagtgatgggcttcggggagagaggcaagtgtgaaagtcctgggtgagtgtagagaatggtaggtaactgacaaggtgggctgtagcatggtacttgacctcaaagagtccagagggtggagaagcaatgagctggaagacactgagtccactgcctggcctgaggagcatggagttgggagaataaacagcctgcagtggagaggacagcaactgagtggcagcatctccaggttccggggaaagtgagtagagagagtaaagggagtatctagagactgcggatggagaggagtttattggcatggtcctctgtcccagaggtcatgctgggaaggtagtggagagacatcagtcggagctacctccaccactaccctctgtccactgcatccctcccagaactgcctgcatctctagcctgccttccccaacttgatgtccctcctccttcactgactcccgactccaccccacacacacataccgctcatctcatccatccatccattcctcttcttcccacactcctccttagttctctcctctccagacccttcccctgccctgccccaccccatccggcctgagtgagcaggaacccctgcaccttcatttctcaggtcactgcttggctaatgggctattaatttgctcaatcgtcccctgtgaggcaaactcaatttctgccagccagtcgtccctccctgtcgacagcgtgattgattggaggaacagctgtcaccgcccggctgcctgctccctgcctccttctctccgagtccacaccacccctcctcctcctcctcgggccgccaccctgcgcccatagaggcagcacacccctgccacctgcccaaggatctgtcaccagcaatgaaaaatgacagaaatatttaaggacaaataaggtttcccaacgcaattgaaaatgattacaggcagctacagatggggccaatctgatgcgcagcagcaaatcaaatcgaatttccttatcggcgtattattttaggcgttatctggcacgttgatgcagttatcaattcaatttcagccgccggtccgctgtttactgtctcgcctttgctgggaaaaggtaaacatgctcagcccagcaaattaatttctggctgaagccagaggctgcaaagaactgctacccaggacccactgcccccaccttggccccgggctacggtgggccaggccagcagggcctggggcaggccagagctcacccagggagcagaagccccactatttgcctgcccaagtctgggcccagacccaagcaggattcagagctcctgggaggctgaggtgaccattgttggctccgccgctgctgccagggagaggtgaaggtctcccattaattcccagctaaaaatgacaaattcatcttggacgacaattaaatgaagtcagtaattgatgctaattgatctccagatgcaagggctcccctcagccttagcagcacgtggctggctgctcactctccccacccagcccttttcttcctctacctccctctgctgctctcatagtccttgttccctccctagggttctgggtctcttaacccctcaggtgtgagggaggcagctggcctgggatgtgctagcaggcagcgcctgaggccaggcagctggcccattgcccatccagccctgcaggcacttgtaatcagtgccccacggtccacccatcagcctagaaagcaggtaacactgccctccttggcagctcaggatttattgcccacagctgcggaggttcccacttcatttttataagcccatcgtcagaaccagcagggggtaaagcacacttgaagttactttcctttaaacagtacagtcttagcattttggctgcatggcaaggaaggcatgagagagagtgaagtgtgtgtgcaggctagggagaataggcaggtatagtgataggtgctcaggtgtttgtctaaatgcaaaaaaatacccacaccgtgtgagcacttgtgtgtgccagtgccagcacaagcatgtgtgtgtccagacacttgagaggatgcatgtgcaggtccacatgtggatattttccagaatcaggcccttcactgtagtctgtgaagcctaatcccagggaactctgggaggccctgcctgccccaccctccactggcccagcccaacccagggagatgtctggaagttattagctaaaggagagaaactgaattgtagctccacaagaggacagaggctgtagttatgtttgaaatagccaaggtcatgggtgtgaaacagctgtggcccctgaagccccgccagtctctgaacaggttggctggtgcctttggccggagcaaaggctcatggggtcaagggtttagcttctatgaccaagactcagtgagcttgcttgtgccttggcctggagcctttggctccagcttgagcccaagtctgagcctaaacctgtccatagactgacttcacctggctgtcttgcagatgtttgccactggccacccaggagccatgtctggctcaatccaggcaccttctattgctagagatggtaaatagcatgcatcaccataggagtcaggctcttgtacctggagctggcaggaggccatgtggaatgggcagtgccaaccttgagtttctgcaggcagaatggagggagaaggaaagatggcaagggtatgtagccatgaatgtttcacacctgtgtattatatctaggtatgtgtgtcacatgtaaggaacctcatgctgtgtgagagggtctatacatgtcttacagaaagaagaggaacagataaaagcatatataggggccgggcgcggtggctcatgcctgtaatcccagcactttgggaggctgaggtggtggatcacgaggtcaggagatcgagaccatcctggccaacatggtgaaacctcgtctctactaaaaatacaaaaattacccgagtgtggtggtgggcacctatagtcccagcttctcaggaggctgaggcaggataatcacttgaacgcaggaggcagaggttgcagtgagctgagatcacaccactgcactccagcctgtgacagagtgagactccgtctcaaaaaaaaaaaaaaaagaaaagaaaagcatatatagaaggatagctgaccagactagaccagagtcagggtgggacaaggaatcagagaaaaaccccatggcatctcccagctggcatctgcctctttggggatttagcgaggtcagtgattacttattcattgattcaaacaatatttattgatttctactattactatgactattttctcactttgggctatgcattctgctacatgctggggctatagcagggaacaagttaatttttgccctcaataaatttataatctaaagaaggtgatagaatcataacaggcaataatgacactgtgacaagggctgtgatagaagtagcacaagaggcttcgggaacacagaggaggcacccaatacagtctggaggagtctgggaaggccacgtggaagaaggaaccctaggttgcatcctaaaggatgaggaagagttagccaggttgtgcaactagcccctgtcctatcctttttggttgtttagcaagcccaaagcagaaacaaataggcctattgggttccaagtgactctggaactgctgaaaatgtcacctctgccccacgggcaccggccactaccctggggtctgggcaagagggtgcacagctgttcccaggacatccctgggcaccagaagaaagcatgggccacagctaaatacatatctctcccctgcccgccctacccctacctcctcaaccagggatgcctattaatcctgacaaatgatgacttacgaacatgtaatgcaaactgattcatcatacattcaaatccgctgccccgccccagcgggaggccccagccagacaagtgtattacacggataatgtatttgacgtattaataaaaccagccgcattgctctggcccggagactggggaatgccaatatacgatgacagatcacatattgatgaaatccagatgtttggaatcatagtcttggggcctcgttcatattgactgaaggtaaaaaatgccatctgtcagcatgttaactcttgctgtcccatactcagcagaggcgccaatcatagttttaagagaaggaggaagggactgagtgaggggagagtggatgagtaattaggtggtttggatggatgacaggtggatgaactggagggtagatggttgtgctatgtataagatgagtggatgggatgcttttcatgccttatgtccttgacctctcaacagcatttgaccttactgaggacagtagagtccttgcaactcttcctttcttggcttcaatgacatcacactttccttgttttcattctacctcttggctgttccttcttagtccttgatgccttaaacttcctctaactgtaaacgaaggttctgttccagacactcttcctagtgtattctctctccctaggtgatcttgcctactctgaacttcattcatttatttattcaataaatatttattgagcatttaccacatgccagacattgttccaggcacagaggacacagtggtgagcttcggtgctctatgtcaatgtctcccgggtctagaactctagctctggctcacatagagtgcctactcagcattttcacatgaatgtctaatagttcctcaagctaagtacatccaaaactcaactcattttcttccttaccaagcttgctgctcctcctcccattccataaatcagtcaatgttctaccacctagaggttgctcaagcgagaaaccttagagtcatccttaactcttttctgtcccttaacttccacgtccaatccatctgcctctgttcatctccggcatcgtcatgctagagcaagccgccatcgtctctcccctgagttagtgagataacctcctaaacagccttcctgcacttgctcttgccccttagaccactggctactttgcagttagaataatcttttttaaatacaagtctgatatatcactctcctgtttaaaactctctgatggcttctcattgtatgtttaaaaaaaataaccaaaatcactaatgtagtttaaaagtcctccaggatgcaccctctctatcatcatacctcagcactctgcccctcactctctgtgctccagccacattggactctttccagttcctcacttaggctctttctcctgtataccttcaaatgtgctgttttctttttttttttttttttgagacggagtctcgctttgtcacccaggctggagtgcagtggtgcaatctcagctcactgcaagctccgcctcctgggttcatgccagtctccttgcctcagcctcccgagtagctgggactacaggcgcccgccaccacgcccagctaattttttttgtatttttagtagagacggggtttcactgtgttagccaggatggtctcgatctcctgacctcgtgatccgcccgcctcggcctcccaaagtgctgggattacaggcataagccaccacgcccggccaaatgtgctgttttctatctagagcaccacttcccccaatcactgtttgactggttcccacgcatccttcagccttcgctgaatgtcacttccttcaccttccagaccagatgatatactcccctagttctgtgtacttttttttttttttttaagacagggtctcactctgtaggccaggctggagtgcagtggtgcgatcatagctcactgcagcctcaaactcctgggctcaagcgatcctcctgcctcagcctcccaagtcgctgggactacaggcacatgccaccacagctggctaattttttaatttttttgtagagatagggtctaactgtgttgcccaggctggtctcaaactcctggccttaagcagtcctcccacctcggcctctcgaagtgctaggattacaggtttgagccaccacaccggccccatgtacttttcttttcctaagaccactctggggacaatcgtttcatgtttctatccattgttaggtcctaagctccctgagggcagagagtgcgcctgtcttcattattgtctggcatctgtgctatagcgacccctaatgggcatccagtaaacatctgtggagtcatattgaatcattagctaggtgagtgggtaggtaggtaggtagttgggtattgttcaggtctggattcagacagaactggatttaaatccctgctctgaactttgtagctgtcaccacattgttctgagccccattttcctcatcagtgtgatagagacagtaacacctacctcacagaactgctgtaaggattaatgagataaagtatgtgtagtattgacctacagccaaatatataatgatacttgatagacagttgttgttattacaaatggacagataatggatagatgataggtagatggacagatggataaaccgacatataaaccaataaccagatatatgggtaatgatggataggaagaaggaactccatgggggccagaggagctagggccagggcacctactgagtggtaaaagatctggatcatagaagggaagaaggccagatataggcaaggcagggcaggtgtcaggatggggcagatataggcacaaacaacaaactttgctagtgtgttactggaggcactaatgactcctcacttgtacacagccctgatttcactggatcttcacagaagtcttgggagttagatatcattatccccatttcacacaaggagaaatgaagctcaataacgttaagtgatttgcccaaggtcacacagctagcaagaggcagctctgttgaattctgcttgaagttcctgtttcttggtcactaggaaatggaagtctttccattgcaggggttggggtaggacacacgtgtgtacacatgaacacacacatatacccacacacatactcttaaaagtcccagcctccatggccatctgtcattacagtcaccctcaccctcatttcaaccctcctcatccctgtcagacaccagtcgatcaagccatgccttttgtggtctgtagagaaaaaatagagatggaatttgttgcttggacaagcagaggcgagaatggaactctcatgcaaaagaactgggacaaaaccaaacatgccaagccagagaggcaatcacacggtggggagctgcaaggccagacgtgggtgagtggtcaaggaggggagggctttccctttgaacaagacgcccgacctctatatgtccaattctgcaccaggcttcgctgtggaagatggcagggaaggggcaggttgtgccggcacttgagttgcctgttcccaatggtcaaccattcccaacagaggggggcagcagagggctgatctaggaccccgggtacctgaggccttgtttcgaggcgagagggctgggctggctggagcctggcccaagctaggaagagggctgccttggcatgacctcttctctcctcctcgacaggcctgtccttcgcagcttaccatcagtcactccctgttggagcctcactgttgtccagcaggaaaggtattctagcagctcagcaaggaaaagggactctctggaggtcatacaacttagggagcctccaggctgggacctgattcccctgactcccggtccctgcctctgcagagtcgcctccctgctcttggagctggagttgccctgtgtaaggctgaggatggggtcagagcccctcccctccctgccctcctcctgcttgcagggatacctgtggcaagcagagaagtggaggtggcaggcactccgcgactggggcggtggggagggaggtgaggtaatgaatgtggacgggaggcggaatgagcgatccatctttgcatgggaggggagggggctgcgggcgttccccccacgcactcacacactcaatcaggcgctgtcagacctctggccgcctggcattttggtgaagaatctctcagctaaaaattgttgtcagtcccatttcctcgttatcagtgcaagggctgaggcagcgcccggggattagcaggaacggcaagcgcccgcacccgccatcctctgccgataacactgggcctcccgcctcacctcccccattcatcatctttagcactgacagcccatcccagtccctgtccccatccccatccccttgtgcttcccgcatatccccactatgctgctcagcccagctcctgacctcctgagggagcgaggcctcctgaggagggacaggattcaaccaggcctgtgtgacctagacccacatgtggcaaaagggtttggccagcttttgggggttggggagtgtcatgagctggagagaggaacactcgagaggatgcctgctgacagcctgcctctggtgggctcggcctgcccacctgtggtgctgccggcagtattggagaagggattcctgcatccaatgggcagctgaactaaggattccaggggcctcgccagcctgaaatggacttccagattctgggagctgtggaaaggaagagccagaggatgcttcctcccaagcctaggaagagtatggggttgagggcttcatttccaccccagcaagaccacagccccctcgtcttggccatccccagcggtttttatggcccgttttatggccactgtaatggcccaggtcaaaagcttcagggagctgtattctgggaattatgcaaacgcggagcaggcccagggccagagtatggattttgtcattaaacctgggcaggccatgtcgttagtgcagtaaaacccacgtcatgaccacaggtctcaatataaaattatagagaacacagcgggggaggggacacagggggcccatggccatgctgacacttgccactctaacccctgagaaaatgggggtgggatggagggcagaggctgcagagtccctttgctgatccctgccaatgctattcctgaagcttggaggcaggaagagggcctgttgtcctgatagggaaactggggccaagctcagaaaagtagaatgtccctgtggcagcaaagcagatgaactgagtacaggtatgtgggaatgctgacgcctggtccccatgcttggagtgagacatctgggctccaggaagccctaagaaccagacttggtgtaccaggctaatgggggctgaacccctgatatttccagctcagctcagaccccatgtctgggatccacctctttctccattctcctgtcttaccattgcccccttcagaccccagtccctgcctcaattatctgttccagcaacctgtcaactcccttactcactcctcgtgcctcccactgagcatcacctcgcccacagatcctgccaaccttgctggccccttcccaccctcccacaaatccttcatatcctcctcatagttctcaccagcactgactgcagtcacgggctctctttttgcctttcctactaatttgtgttctcctcgaggccaaggatgcattatatttatctctgagctccagtttctcctagaataatacctgacgtagaataattgttaaatgtttgctgagtgaaagaatgaagtagtgaaatcaaaagccgagtacagaggtctgtgtcccattctgagcctcaattgccctagctgtaaataaaatggcctggagaatgtctagggtcttgttcacctgtgagattctctggctaactgaaggcaggagcagagctgagactggacgcctcatctcccacctcccagacctgggccacatctgctgctgttactcagagcttccctccagctgtccccgagcatctgaggcacagccacctgatcagtaggacttcctcccctcctcagagaccttgccacacggactgaagcctcctggatggctggagctgctgtcccagccctccaaaggttatctggcttctaggacagtctgttcttcatccccacctttcttctccccctttctcttttcctctcttttgcttcatcatggagcatctaggctatgccagacctgatataaattgtctataaatataaagatagataagaaatggtctgtcccacaaggaactcacaacttattcattaactcgttcaattgcctgatatacttctaaggtacagcttaaatttcacttctttggttaaaccttctcttttttccagtcctcaaaactcacagccaaacgaagaattcctccttcgttttagccctcagatgactctatctgggcatccaagggagccgtaatcatcctcagtctggtgtcaaagggaggtgggttttgtgctcagcctgaacttgaggcttcctcaagtacaaggttgctagatttagcatataaaaatatgggacatccaggtaaatttagaaaattagaaaatatgggacatccaggtaaattctagaaaatgataaataacttttagtataagtatgtcccgtgtagtacttgggacatgcttatacaaaaaaaaaatttattatctgaaattcaaattgaactgggcatcctgtgtggaatctggcaaccccttaggcaaccatcttgctcatgtctggcatggcctttatctctctgaaagctgattttgaccccctccaggaaccagtgggaagaagaagaaggaaggaaaatctgggctcaaactaaagtcctttgtgcagtcagagcatccatggatatgcagggatgtttctagattaatagggctcctcaaccccacacctgtaagcagaggccacagagcatccatggatatgcagggatgtttctggattaatagggctcctcaaccccacacctgtaagcagaggccacagagcatccatggatatgcagggatgtttctagattaatagggctcctcaaccccacacctgtaagcagaggccacagagcatccatggatatgcagggatgtttctagattaatagggctcctcaaccccactcctgtaagcagaggccacagagcatccatggatatgcagggatgtttctggattaatagggctccccaaccccacacctgtaagcagaggccacagagcatccatggatatgcagggatgtttctggattaatagggctcttcaaccccacacctgtaagcagaggccacagagcattgtgtgtctccacaagtggcaacagaggcggtttaaacatcccagccggccaggtgcggtggctcatgcctgtactcctagcactttgggaggccaagatgagaggatcacttgaggccaggattcgaaaccagcctggtcaaaataatgaacccatctctataaaaaaaataaataaataaggccaggcgcagtaatcccagcactttgggagaccaaggctggcagatgacttgaggccaggagtttgagaccagcctgaccaacaagatgaaatcccatctctacaaaaaatacaaaaattagccaagtgtggtggcacatgcctgtaatcccaactactcaggaggctgaggcaggagaaccacttgaacccaggaggcagaggttgcagtgagccaagatcacgctactgtactccagcctgggcaacagagcaagactctgtctcaaattaattaattaatttaaaaaagaaaaaaaaatagacatcccatgggggatgtgtcctaatagatttctgagaggggtggctggctgaggaggtaccattcatggccacagcctctggagctgcaaggaggaggggtgctcgtgggctctgaaaccctcaggcccctcctctaggccaagaagccctagagggcagcagcaggcttgggtttcaggactgggatgctgggtctgcctcctggactagcccagcttacgcgtctgtctgttcttctcccctcactaggtaagaagaaagcagcggcattgttcgacagccaggccccaatttgccccatctgccaggtcctgctgaggcccagtgagctgcaggagcatatggagcaggaactggagcagctagcccaactgccctcgaggtaagccacctcccagggagcctgcctgctggaggagtccactcagggttctggccaccggatcccagaagcagccgcctggcccataccccagcccctcgggaaaagacaggaccctgccacccttctccacaactctgtttcaatcctcagatctttccgctgaatggagccaccttcctcttcttgctctatttttggagatgggaggagagtgaccccgcaggccccagcctcaaaggaaaacatgagaggagctagacaggggtgagccactgccaaaggcccagcactgccatgttgagcctcagagcagaataaaagcagcaggtcctaggcctggcaggcccctcagaagtgcagccaagtccttcctccagtggggtggacactaccttctctatgaatctcagtgtctgaaagatgacaatcttaagaatgtgctcaggtgtgtcccccactgtcccaccccacctcacccccagcctccctcccttgtccctgcctgaaggactgggctgagcctcctcaagggcctggtggaggagccaggttatcaaaaagagtagaggagaggtgtgacaaattacctaaaatcttagcagtttaaagcaaccatttcattgtgctcgtggaatctgtgaggtcaggaattcagataaggcacagaggagatggctgatgtctgctccatgatgtctggggccttagctgggaagacttggtggctgggagctgggtcatgtgaaggctgcttccctcacatgtctgggggttgatgctggctgtcagctgggacctcagctgaggctggaatcaaagcacctacacagggcttctccatgtggcctgggcttcctcatagcttgccaacctcgggatggttggacttcttgcatggcagctttgggctccaaaagcaaatgttccagccaacgagatggaagctggatcaccttttataacctagcctgaaagtcactgaatctcacttccactgtattctattgattgaggcagtattagaccacccagaattcaaggggagaggacatacaccccccttttgatgggaggactggcaaggtcaaattgtagaaacgtatgtgggatggaagatatggttgatgctgtctttggaaaatataatctgctactgagggacggtctgccccgctcctcccagtccgacccttattcagttcaagtcatcagacttgactgatcctccttccttctaccttcttaccgaatccccatgcaaggtgcaggggatcccatagtgaatcagaatggtccctgcccttggaagttcatagcatgagggtagggagggtcaggcagtacaaacccagagggatggagactgctatacgggaagaactggagcttgggggtatcaaggaggcaccaaacccagcacagagcaaagaaggcttcctcagaaggtaaggcctgagctgaattttgaaggaagaaatatttagtcatctatcgctgtgttacaaactaccctaaaacctagcagctaaaacaacatacatgtattatctcagtttctgtggtcatcaattcaggaacagcttagctggatggttgtgggtagtagtggctactggctgggagtctctcatgaagctgcagtcaagatgtcaaccaaggcaacggtcatctgaagatctgactgggactgcaggatctgcttccaagatgctcactcacatggctgttggcaggaggcctcagttcccccacatgtgggtctctgcataggacagcttgaatttccctatgacatggcagctgacttcccacagagcatgcagtccaagagaagactaaggagggtgccacagtgcttcttatgatctagtctgggaagtcacacactgttgcttctactctattctattctattctgttcactaggagcaagttgtcaagtccagctcattctcaagggagaagaattaagctctagaagctctacccattgaagggaggagtatgaaagaatccatgggcatataagactataccagtgataataataataatccttgttgaatgctcactatgtgccgagtactttacattgcattaatttatttaatcttcacaacaaccctctgaagtaggtgacaataattgctcccattttacagaggaagaaactgaggtgcagaggagttaagtgacatctctaaggttgcacagctagtaagtgatgaagataagattcaaacctaaagtaatctgactccagtacccatgctcttaatcactccccatccctaccccccgcccacacacacctgggattggcctgccagtggcagaaagtgggaaaaaaaaatccttctgcagctgggttccatattttggctgtccaggaggagtcctgtgtaatttgctcccagaggaggacttctcctaccagggtcagagaatagaggtagaggctagaggagcatgcccagccttgtaaaagcagtgtgccccctaagggcctggagaatgcgggcccccagctctctgtctgcctcctcggtgagggccacactacagtgcagtcccaggtgctccacacctgcaatgtccagggcatgcacttctgccaacagccttcctttttccacacccccacccatgactctgcacaacccccttatccctcacatcctcccagagcatccccgtgtccatttccccaccccaagctccatgcttctcacggctatgtcttgcgtccctgcatctgtacccctcacgtcgcggcccagcccagcacccctacgcccatgccccctccgtctgtgcgcgccctgcgcccccggcacgcgcccccctccaaccgggtgtctgacagccggacagcgggatctgcacagcaagtgaaattcccgtcggatcgataaagccgaaacgctggcggcgacgggtcgatggttttatctgtctcggccccgccgcgcccggcgcgctgacagttggaccggccggcaaaggcgttcaagggcagccgcgcccgcgccccctcccctcgcttctctcgccctccctccctgcggccgctgcgcccaccggactgtgggctggaccggcccgccgccgccctcgtgatttatctggatttttaattggaaaaaatttgcgaattaattgatttcaggaacttgccaattaacattgtaattgggtgcgtgataaattcccaaggagcgtgtcagctccctccgggctgacggccgttcagcggggagcgcggggagggccccagccttggctgcccttgccccgcccctgcccgctctcgggaagccaagacagcagaggaggttgggaaaagatgacacactggggttcctgagacaccctctccactcctcaccatcagctccctgagcagaggggcctgaaaccagccatttcacagatggggaaactgaggcccgcaggagggcagagcctgtgtgtgcctcacttccagggtcctagcagagcccacatcagggcagttccatccaccaaaggcacatctttggaggcttcctccccagctctccctcctcccctcccctctcctctctgccccagcccttctttcccctgctgactcctccctcttctctcctccaattgtcccttttcctctcctaccctgcctttgcctccattgcctcctttgccctccctggccttcttcagcttagccagctcctgagtctgtggatgctgccgccaggtgccctccatcaacctggacacgtcccccctccacttgactgcatcctaaggggctcttcagactggcctggtgttccacctcctgcctccctttgcccaacagcacaaagcacaccccactaggagcaggctgctatttcagacacactcacgggctcacagagagaagcaggaaccttccagctccagagccagggctggctgtgtttcagacacagacgcaaacatatacaggacatgcaggtgcacacacacacccattccaacacacagatgtgcccacacacacaccctgaaagaagccttgtcccatgggtgtcattcccacaggtacatgggtgcacagacacttacaggaagagcaatcagaacttcctttggcaaagtccttacacttttcaaagcacttttccatttgagatcagaggctgtgctaacactctctccctcaccccatcctttatctttccccttctcaaccccttcacaggggttccatcagaccccagaacttggccaggtagaacaaggagggcaaagttagatggaggacagattgtggagggccttcaatgctggaggacgtccttgatggggtggagagtaagccgaacattcatgagccagggtgaagcctggtcagagagagacaagtgggaggggcatggttgcaaggccagtgtggagtgtgggttgggggaagaaacaggaggcaagggaggaggtcggccagggtccaggggaaagttggtgaggccgacccaggacagtggcagtggcagtggggatgcagaagagggaatgacgacagaccaggtggaggaagaagccacaggacttagttggggtgcttattgggaggaagctttctaacttgaatgattgggagagtgatggtggcagagaagcaagtgtctgagggaaggaggggatgttgggcaagctcagcctaagatgtctctgggttggtgatgggggagggactggatgtgtggagagacaggcagggacatagatagatgggggctggaggttgaagggcgggggtggaggaaggagttggcccccagacttcccagtggccctcaggcaggagtttccatccagagagatgaagtagccttgggcatggagagattgcacaaagctaaaagttgggcttggcttggtggggcctgaacttagagagattctctgggaggtttctggagccattcaagatctggcctctgagctgggaagccagctctctggccagcactttaaaagggctcaaagaagccagagggaggctgggtgactctagagaagaggcggggtgtggagatggcagtgcccccacccccacttaagccttatttaaggccggcctcggtgtttggttgggtaatgaactagataaacaattccccaaatagattaaaacgaagtgtaacttacaaaggcggctggtgatgatggtttattcccgggcagtgcaccatttctttatttccaaggataattcagtgtaaatcaccttaattaaaagtgtcagcccagcccatgaatattgtacttaggaatgcgtttcctgggtcccagttataatttaaaacccatggatcactaggcagcgagtgactgagcaagggaggaaatcgttgggggcgggctgtggaaatagggagggatgaaggcagagctgatgggctgggcgggagccaggctgcctacagctgcggacctcagacctgtcttctatgaggcaggcccttcagcagactcctcagcctctgggggccaagcacactgggaggtaatcaggttgttggagggaagatagggagggggtcccttgctcagagagaggcaaggagtctcaggtagtaccaatgcaatgcaagggacagtgaagagtgttgctaggaaaagatccagaggagtggatcgccaaatgacaggctgggcattctgaccctgaatgtccctgtttctgttcaccagcagagcaaactgaagcccagagtcagcagttcccctccccaaagtcacacagaaagcaaagaaaaagaactggattctgccctctatcctaagccctgagtgtctttagggaggcagcatgggcaattaaaagccagcactgtgggcttggccagatgccaactcaaatcccaaaccctccacggactgtgtgaccatagaaatgtcatttgacctggtagtcaactttgtagagattttgtgaagtttcaatgagataacacatgttaaggcctgcgcctgtcacatacagtgggtgtacaatcattgttcattccttccttttctgctgtcacctgatccaactggagataatactcttatcctaggccaggtagagcaagcatggtgttgtacagtagatacctcatttccgtaccagaaatggtgatggcagtatttgtttactgagtgaatgaaggagtgaacgaatgataaaagccataaactcaaaaactagttgctctcaaaagcagctccgtgcccttcttgaatccccagtgcctacatcagggctggcatgaaccatttatgagcaaaacataattgaatggaacctgttgtagctagccttcctagtctgtgatgcccccactgtgtgattagactggctgacagctctgtttttacactcagaccttggcctcactctgctgctgggcctggtggcctctgcactgggatatacatatgttatgtgtgttgtgcatctgtgtctacatttgtgggtacatgtgcatctgggtgtgtgttggtacacacaggtgtccatatctacgcatgtgtttattggacttgtgcacatgagcagctctcatctaatctgtgtggctgttgtgaatcttttttttttttttttttttgagacaaagtctcactcttgttgcccaggctggagtacagtggcgcaatctcggctcactccaacttctccctcctggattcaagcgattctcctgcctcagcctcccgagtagctgggattacaggcgcctgccaccacgcccagctaatttttgtatttttagtagagacggggtttcaccatgttggccaggctggtctcgaactcctgacctcaggtgatccaccagcctcggcctcacaaagtgctgggattataggcgtgagccactgcaccggaccatgcatctgtctttatggacatgtgtctgggaatatgcctctgtggccctgtgcatctgtatgcgtgtctgagtctccaggtgtgactggttatatctgtgcctgttggcagaattatagaaagtctatgggtatatatgtgtgcgcctttataccagggtttctcaacctcggcacagttgacatttggggtcagataattctttgctgtgaggggctgtctggtacactgtaggctgtttaacatcctctacctactccatgccagtagcaacctcccctccctccgctcaagttttgacaatcaaaaatgtctccagacattgctggatgtcccctgtgcaggtgaacatcccttccccttctcccctgtcccccactgagagtcactgctgcatctgaatctgcctgtgcttttgctggcttgtccggtacgtttgtgtctggccctgtgggtgtctgagctcatctgtggatgttccttatgtctacactcgttaagtccctatgtgccccatgcattctgccttggatgtgtgtctgtgtgttcttctgctttccgggtatatctgcaggtgtgctgtacgttatacctcatatgtgtgtctgtgcagggaccctatgtgaatgggctgtgtctgcctccgtgcattcatcagccagcacttctgtgagcatgtgtgtgtgtgtgtgagtgcacgcgcatgaatgtgcgagcacagatgtggcaagcgtagtgggggcagcaggcagggagggacaggaacagggatattaatgtttctgaagtggatctgatttgatacgtcttgttccattgtcagcatctgtttagcagggatttgtaatactttgtggctctggatcactcatgcttagcgcaggatgtggccttgcataccaattttgttattaaacacagtcctcgcctcccccacagcccatccatcacctcccaccccagcccccgcctgctctgagccgcccaccatatttcagggcccagctcccgcctgcctgccgcgcccgatgccggagggcctggggctgacaaattgaatcagggggagatcattcctggcctaacacagtttgcagcatgttggagggagaattgacaagagccctgtcagctccatcaccccaatcccacaggagctaagagcgggctgggaacagggggtggagagaagggggtctccaggacaggcagaatcttcagggctgatacgaggagtcaggtaaagcccctttcttcagatccactgggaaatctaccatgcctagtgtctgtgtctccctcccaggggccagcactagcccttggcccaagagagaggctgagccactcagcccatgagagaggctgggccactgggattgaaaggactgggtggagcttggctgagctgggctgggctaggcggtctatgccttctctgtctttggggtcttcttgctactctaccgttgcatgccctgggcagcaggtagaatggttaccctgttctcttctttcttggcagcaagaattcccttctgaaggatgccatggctccaggcaccccaaaggtaggtggccaattacatgttttcctcctgcccatactaacctaggcctacccagaactggttcctcctgagaaaaaggagcttttctagtatcctcaactatctccagcttttctaatatcctcaactatctccaggtcttgaacatcatcctgaggcctagggctgcgccgtgtgtgtgtgtaagtgtgtgtggtctgtgcatgagtgagagtatgctcatctgacttcctcctcttccagccaggagaggggtcagagccaagaatggcctgggagatgtgggtgacccagacactaagggtgagaagactcaaaggaagaaagtgagctatagcagatgaagaaaaataaagaaatgcaggtcaagatagtgcagggccctagaagccagactatgggggcacaggggtgtatgaatgtgcaggtgtgtgcgtgtgtgtgtgtttgtgtgtactttgtcctgaggggaacaaggagccaaggaagaggctggactcttttggggagctagtctgcctctctgaacaaaccctgtgggagaaagacttgaaagcatcagttggagaaagggaaagtgaagagcaaatatctggctcaaaggaggggccaagaggccttagcacaatgacatttgtatcaagaactcctcaaagatggccatggacacagtgggtactacttacccaaaggtggttttgaggggatggatacatggggagaaccaaaccctcactcactgagtatccccttccccattcctcggtagaagactgcatcctttttcccataattattcagaacaggaggccacccctagcccattttatagggagtgaggaatgactatggaagatttgggaatgggtggaatcagtgaaggagagtgtttggagagattagagcaaaggccaaggtgagaatctgagggactcctgcacttggtgtcaagataaggtccaggaggcagggaaggagacagaggaggaacactcagtgagttaagaggggcacaggagagcatggtatctcaggatcctaaggaagaaagtttctaaatgtatcaggtggtcagcagtcaaacagggaaagactggagaaggggcccgttgtatttagaagtctggcagtgactggtgacctctaagagggcagttttgggaaaggagccagagtgacaagtatcacttccatggggtagacccaaataccctgcaagcctttcaaaggtataggaatggatcgtgtaccttcgtttagaaaactgctcacctgcagcaagctgggagaggaggagcagagcacctagccctgccttgggtgggtataggccttggccaaggagtcaaagccccaaagagaaaggggaggctgggggtgccaggcagctgcagactcacagaggtagcgagctacactcactgagtgtggcccagcctgcagcatttaatggtgtggttcaggaaagtcagagacaagcttccaagtcggccaccacaggtgacagctgacacctgagcatggctggcagggctggggacttggacatcagtgaggcctgtgttctaaggacaaacccctggcagacacagtctacctccgtccctagctccccacatatacagacccacacacacactcaggtcagaatacagacataggaagtcttaaaacatgtgtcctgaaaccacagacacaggcatactgaccatgagacacagagataagggacacttgctcacccacttccagatatatgcccacacccccaaagctgaatagttcagggtctatcctctgccttgacctaggctttagggaagcaggtcgtgagtggaagaggcgagagagagaaggttcaagcaagagactgaaaggacagggagaaggagggagggaggaggaggagagggcgagggggccttagacaagattgatggcctcgttgccattaagaaaaaaattagccggtggcggctatcatattaaagggtgaagaagccgtgaattattttcttaaagatcttatcgcttacaatgataattttaccttccaaaaggccacttttaatgaggcgaagagccaggcaaaaagtcatgatttaatgccgggattttttttcaaaacacattttactgctttttggtccatgtttaaaaagcaccagtgacctttttttattccgcttgccccaggtgtaatgccgaggcctctcagggcttctaacctagagagaatgagagagagagagagagagagagagagagagaaagcgcacaaacaggagctttttcatgggccggaggtcggggtgacccacactgttccccctcgttagcatcttccttgggaccagagaaggagaagaacattgcctgagagcacctcctttctgagctgagggctgggtcacccatgaggcctcccactgggcttggatgggtgaagaaggagctccacgttgcagagaatcccatgcaggccctttccagcctcttctctcctccagctcctggggtatgggcaagtcagggagccctgccagaccagcagctgtcccttccctttccagggcccttgcctgaggatgtgcagcatggccaccgcatgcgggtcacatcctaaggctcagccggagatgaaggataaatggctgctccatctttcccaaattgctttctttgggctgtcactggcgatttggcatggttttctaagctggggaagactcctagggaactgtgtgcttccggctcagagctgtacaggctggagaaggtggggggaggaagtatggattgctttcaggcctccaggcacccagtttgcagctgaacaggccttggcaagagcgggctctcaggcagaatgtgccatgtggtatttagaattgtggtgattgcacacaatttcaagcagacagtttattaatctaaactgcaggcgtatgtagaagaggccatacaagattgacatggggggattagttttgctggggtttttgctggggtcatcaccgtagcaccgggataaatggacccacatacatccctagctgcacgtgggaaactcacatgctatttaatttactgtctccattgtggggctgccatcagcctgtattaagggcaggcggggtagcgggtatatggctttacccacaacccttcatggggatcccagagtctctgctctccaagggaaaacaaaacatatatagtctcagcctactcggagtggactgggagtctcactccactgggacagagattagcctaagcagggtccctcaaggggtctctacccatccctaaaaccaagccatgctctcccacaaccacactcccaggacttgaccccatgcctttagaatctcaagagtggtctttctatccctcagcctccttctctttgcctggctccccaaagcaccacaggactgggaactctagggactgactgtaggtctcatttggcctgaggccacatgtcttttttcttcttccagtccctcctgttgtctgcttccatcaagagggaaggagagtctccaacggcatcaccccactcatctgccaccgatgacctccaccattcagacagataccaggtgaggaggggtggtgagtggccatgagaagcaagctcacctgggggagggcttcaagagcctgcccggtgctaactcctcctctcctctgtaggccacaggagaggcctgaactgggtttggttccccctgtgtcccgtgcccctaagtgaactcaggaggcatacgtgtcagggaataggccttaaatagatggattttagggagagatgccaaggtcacatgggctccatgggctctgagcacctctgaatcattctatccatcaggaagtatcctatggggtttggtttcataagagacccagatacatagcccagaatcacctgaagatttcagacttcaaaagcatgataccggccgggtgcagtggctcatgcctgtaatctcagcactttgggaggccgaggcaggcagatcacgaggtcaagagatcaagaccatcctggccaacatggtgagaccccatctctgctgaaaatacaaaaattagctgggcatggtagcgtgtgcctgtagtcccagctacttgggaggctgaggcaggagaatcgcttgaacccagaagatggaggttgcagtgagccaagattgcaccacggcactccagcctggcgacagagtgagactccatctcaaaaaaaaaaaaaaaaaaaaaaaaaaaaaggctaggcgtggtggctcatgcctgtaatcccagcactttgagaggccgaggcgggcggatcacgaggtcagcaattggagaccagcctggccaacatggtgaaaccccatctctactaaaaatacaaaaattagccaggcatggtggcgggcgcctgtaatcccagctactccggaggctgaggcaggagaatcacttgaacccgggaggcagaggttgcagtgagctgagaccacgccattgtactccagcctgggtgacagagcaagactccgtctcaaaaaaaaaaaaaaaaaaaaaaaaaagcgtgataccttaagcaaataaccattcaattctgccaaaccttggtatcaggcccagatagagagacaggcacacactgcctgtgagtgtcttgggcaaataggaagggagtcatcacacagtcctacaatatcatagcagaggggcctaagggtagcatcttagctataaacggaccttctctggagtaggaaggacaaagaacttcccccaaaacttttgtctaaggagaggcagagccctgtctttaagaaccccagagccgttagatgaaagagaacagtgccctattccaaggaacatttgtccaaatggcaacagggcttcgcagggaggcccagtgtgagaagggaagaacagccctgatctgatacagaaagacagggctgcagggacctgtaagcttgggtagagaaccaggggccctgctggcacacctgaccctttgtgggaattaaagaaaggtgttctctgcaccccttccttccagctgacacagcctggcctggcacagggtgcagagcttggagagtagagtgcccagcacggctggacagactccgccgaatgcctttgcatgggactcaaactgcatagcccaaagtgcaagccctgggaagggatccctgctctctctaagggaaccccagtttcagaaaggaagcccaataagcccctgggagacactgccccgatccagacaaccctggttcaaggcagagaaatgaccagaccccagggaattctgatctgatagggaacagagacaaggctttgttccagagcattctggtccagaggaatagacagccccaccttcagaggcctgtcctctgtactgcactcacggcatgcgccttgccatctgttcaactaggaaagagtaaccatcaggcaacaatgcctcaactccctgacccaccttcctccccacaaatgtcagtatttcttttatctcctagagactatgaggaaagctatggactctcttgcctaaaaacatacgcatgtgtttttacatacacacaggcacacacacatgcagtgttatacatacaacttcaggaggttaggaaagctctagatcccatcccaataccacttggagatctctgaagcccaggttaagacccaagaccctgttctagactctaagcacacctccgaaagggcaaatcaaactaggttgtgtcctacaagataaagctgaagctccttatcatggcagcgaggccttctgtgatatagattcaacctatatttccagcttccattccaaatactgtccatgaatcctatgggctatgctcactgaactaatgctaaacactccctggatgaggcattcctttcttgcctctatgtcttttcacatgctatttcttctaacagaactgttttaccccactacatcaaatttctatttatccttccaaatcctgcccaaatatcatctcctccaggaagtctttctggattagctatctcttgacccttgtgtgtcctggttattgccccgtcaccctacattgtgatcacctgttcaggtatgtttccgttatctacaaaccatcccaaaacttagtggcttaacacaactcattatttatgatgctgtggttgactgggcatttcctcactcatgcagctcattcatcctggaggactggctgggctggaaagtctaaaatggcctcaccgcatgtttgggagattgggtgtcttggctctcttccatgtggcctctcatcctccagtatgttcaatcagctttcttacttagcagtctcagggcagtgtcacaccaagagggtaaatgccaaagccgcaaggcctgttgaggcctagaatctggaactcacacatcacttccaccactttctattaagcaaagcaagtcacaaagctagcccataatcgagtgatgaggaaaggcagctcttgataggagaagatgcaaataattctggccatatttaatctttcacaatgaatctgactccactagacttggagtttctccaaggcaaggaccttgtcttatccttcctttactcaaacatttatttagtactgactcatgttcagcttagtgtccttgccttcaaggggttagatttgcagatagacaattatggtccagtgtcttgagtgctatgacaggagtataaataagtttctaggggccaggcacagtggctcatgcctgtaatctcagcactttgggaggccaacgcaagtggactgcttgaggccaggagttcaagaccagcctgggcaacatggcaaaaccctgtctctactaaaaatataaaataaaaaaaattaataataaagaatacgtttctaggatactacagtagaaggaggagaaaatcagagtaagcttcacacaggaggtaatgactgaaaacggactcagagaaggaacagaagttcacttggcagacaaggaagaaaggttactccagatataaagacaacactatgtagagaacatagaggtgtaacagaatgatgtatctggggacctgctagcagtttgcttttgttagaaagtagaatgcaaggaaagttagtaggtgaagctggaaagcaacccagagactagctgggtatcccatcccttgctctttacacaaggcctggcatgtagtagttgttcagctatgtcggatttttaaagtcactgagctaggccttgaaaccagggggtattggtttctggggttttgtttttgtttttcatagagacagggtctcactatattgcccaggctggtcttgaactcctgggctcaagcaatcctcctgcattggctttccaaagtgctaagattaaaggcatgagccttggtttctggtttgaattctcatttacttagcccctgctgactaactaaccctctttatcattacctcacttaaacctcatagcaactgtattcatcatgcccagtctattaccaaggaaacaggcctagaaagaggtgactcttctaagaacacataaattgtaagtaacagaattaggacttgaacttgagtctgtctggccctaaatccgagattgtttcccaacccatcactgggctcagggcttatctcataaagtctttctcccgttcccactggtgtctccttcatgcaagacgctgtgctgggtaaatggctagagatgaccttccaagtacaagggacagatatgtaaacaaacaatcaaaatatacatgatcaaagagaagcagtggaactgaaaactcagaggaggcatcaaacccaggcttgggggacaaaactaagtcttgccagagtcctgaaggatgaacaacagttaaccaagcaagggatactggagggcatggaggctctctggcctggagtgcagagcatggagtgctcaaagagctagttagctctgcaaagctgagtgtcaggaatgtaaagggagagaataggagtgagagaagagtctggcaaggcagacagggaaggcctatatgccttgatggagaaccactgaaggatttaaagaaggagagggttaattttgtccaatagaaagatcacattgtgtgtagtgtggaggatgggttgcagagagagaagctagagaccaaaagatgagacgggaacagctgcaaatttcgagagctcgtaagattatgtatgactggagcacaacgacaaccaaggtaggtacaaccatggaagaacaactcagggctgacttgcctttgcccagtgccatgctgggctctgggttcacccaaataattcacacacggccccaaccctgaagtggtcagtccactgataaaaacttcacaagcgatgataacggcgcagagatgaatgtactcttacacaaggcaaagctatttttcagttagacctggaaggatgagtaggagatacagaggtggagatgagaaaattagcgacctttcaatgtacactttcaggatctagaaaaggattgagtgtgagggatggagaaagtggggtccaggacgactctcaactttcttctgtgggcacacctgagtagatagtggcttcctcttatgaacagggaacccaagaggaaggcctctgtttggaggatactgagttccatgttggccatgttggccgtgtgggtatgcagtgcctatgggagctccaggggccgtgcagcagacagctgacatgttgggagtcctctgataacagaactggatggcctaggggttgggcggggatcgcccacaggcgatagggaattcggacgccttgtcccctgtaaagcacccaacgcgatgcctctgccctaagggcagccgcgagaaaggcaggcacaggaggcgggagccggggccgggcgatggggcggaaggagccccgcagcgggaggggtcgtggagtggggtggaaggacttcgcagccgctaaagattgggtgggtaggcttcacgggcggtgggagggaccccggggaggcttctgccggttgctacccgagtacaaacggcagcttcctggtctctgtccggccgcccccgccgcattgtgaactttcacccccagcgcgcgacggcggcagatcacgtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggaagtaggtttgtttacgggctgtttggggcggagcagctttggtcgggggtccggtgctggggcgggggccaggactgcaggccgcgcctgacgctctcttttcttttcttgcatctgcccgcgatcttctcccagacctttctgcgagtacgagccaaccggcagacccgactgaatggtgagtcctgcccggcccctccctccgccccacccccggcctcctccctccctccctcactgcctgccgctcctggcttgcctgggtctcttcgactctggggcccgttggcttcttcgcagtcacggcgcctgagtatgtgcaaaccaaagctgccgctctcagtttccccgtctgtctaatggaggtatggcgcccagctcttgcccaaacctctctaaaggccctgaagaaccctgggggggcaataagtgccggagaatgaggaacgagctacacaattctactcgggagctcagctttgaatttgcaaactgctgggacctcactatacaaacctgcagggcgctgagaatgtttttcttccagtttttaatcagtgcccagtagtgtgaatacagcccctctgctgagacttgacaatacagtgagatctggagttcccacggcaacaggaactaactcatcccagggctctttgagttatcagtcggcccacatttcacaaaggtgatcagcgtgggctcgacagctcttagaggccttctctgaaagcaggccgtgtatgcactacctagcagccccccttttggattcaaacctctggagcattcctgtttgctgaatacaattgaatgatcctagctttttgtgcttactggggtgtggtatctggggggtggctgtaaggggtttagggtctctgggtcagctggtaagtgagagaggccatggagttcaagatccccagctcttatcacttggtttctgctgccaggctgagccctagtctggaaaagggagaaattcatgatgggctggcgccatgttaagcaccattctcacaacgcctctgagaagagtattacacaccttttgtgaataagaaaacaggctctgagaggtgaaagtggtttgtttaaaagtacacagctgggatgtaactgagccatgattcaattgaagtttgtttcccaccaaagcccgtgtttctccaaccatgccatgctacctccttggcaaatgctttgattcttcctactcgtacgtagcctctggatagagaacagaactttccctaccacactttggtaagcttaattcaggatttagaagatgaatgggaaggtgaaaaccaaacctgccttccttctctgagaatttgcagatgaagcccagtccattggggtgctttccagggacaacaagggatcatctgctggcctgtgtgtcctgagcaaggagcgcatccagtattgtgcctttcttgaccattccatgagattcgtttccttagtcattgaacattgtggtatcatcagcaccttcttccccagggaggcattcccttggtgtaggcatggtagggaggaagctttgtgttggcacactgctccttactacacttctagaactctcagggtcctttgctcaatgcctttctgatgtttcacgtccattctccatcccagccctggctctagagtgtcaaggctacctaagtctgagattccaagagttagggcagccaaaatgaagagttctcgatctgtgtccacaaagtcaagtgaggcactaggacacagtcatgtcacctatagtgaagacacaggaaagtgaagagatggactgggctacagaccaagtttcctcaaactccatgcccagttctggcaggatggtagctttccttttggtttgggtctttctggggttgctctgttttggagttggagtagctccctgcctcaggctcacaacaggcaggagctggagccctagcacactcactgggaccagtctttgttgatgctgctcagttaggaggtccccttgaaacaggagggcattctaggttgtgaagtcagttctggtttcctatcttgcctttgccactttttagctacttggacacgtaccttgatctctctaagctttgggtttcttcatctgttaaaatgggataatgcaatctagcttcagcaagtggtagtaaatgagctaccttgggtaaggtacttggctgtgagcctgacacacggtagaagcttaaattgtaacatagcagctctcacctgtgttcccctcctagattgcattcatgagcttcccgttagggtcactgtccatgagaaagttcttcctggccctgctttggggaacctttccctcctttgctggctctccccactccccatcagtctggtcccagagtagccatctctgatcctgctgtggcattctggaagggactagagggaagagagtttcttgttttgaccccttcctgcttcagtgacaggagggctacagagagggattagtgagctaattagaaatgattgcattgctcagcattaattagcagtgttgtgggcttgcagtgtgcactttggaactgagccccctgtgggacaacatggcaggcagccctctgcctccagggcctgccagcccctctgtactgattagaaatgatggaacaggttcgggtgggcacaataagggctgccttctcagggttccctgagccttctgacctggctgccaaaggtctgacccagaccgtcttacctttatgactgggcctcagtctcctcttctgtgaaatgggattagtggacctcagagaaattcttcctgataagattctaggtgggatgctaggagctgtacctcagggctcttggcccaggaaccaaagaggatttagctgatgagtgaacagcaggccaagtcaggccatcggaggggttaggttctagtcaagagatgctctttagagttgtatttcctgacaccaaaagagttcatggtcttggccttctggagagatacctagcaacatggagtgtctttgctcactggatttttattaaacactgcaaatagaaaggtatgggtagaccttgcaccagctgcagccaaagagtggacttactcactggcttagttagcaccagtctcctccccaggtgctcttggcaaagcccagtccccaaaggagcaggaggtatttcaagatgagggccagatcaggcactgaataaaaaggccaatggctggcaagaggtcaggatgtgtcagctccactgggaccctgggggctgcagtgaccgtctgcttgttctgtgctttgttttcggtttccccgtgcagctcggattgggaaaatgaaacggaggaagcaagatgaagggcaggtatgtcccctgtgcaaccgccccctggcaggatcggagcaggagatgagtaggcatgtggagcattgcctttctaaggtagaggggccatcaccacccaccttccttccccgctcccttcccccgacactagctgctgactgcccctgaatctgtgggctcttggggtctccatgtggtctcagcagcttcttcccttctgaccactgctctctccttttgctttcactctcactcattccctccttgggctccagcggaaaactattgggaagaggcccaggtctttgacctctaaattggtttgcttcaaaggagccctagagctgagggcccacttggcacaccacagctggggctagagctgtgccttcgttgcagactgtggggagcaggtggggatggcctgggcccagcatgatcctgctctgctcttcacagagggaaggctcctgcatggctgaggatgatgctgtggacatcgagcatgagaacaacaaccgctttgaggagtatgagtggtgtggacagaagcggatacgggccaccactctcctggaaggtggcttccgaggtacaagcagctgacacgtagacattggcactctggtgccaggcctctgctgggtatccatctgctggaagccaagaggccgaggctggtggctggtcatccatccgttccaccacgtggggactgctgctggtggggctcctttgtgaccgtgctgcctgcctgtgatgtgcatattaaaatggatgtatttgggtggggaaatggaattgtgaggctgcaagctaggagtgacgaaggggggctctcagcttcgggtgatgcattgaaggtgacagccaagccgcgttagcacctgcataaaatattaaagggacggttatgcatttatcactccatccctcttaaggctgataaatgagaatccagcaacctgctgtacacctccagcactgggggccctgagggcttccaggcaaacacattggattttcctcctcctcctcttcagccctatgtcagggaaatcagttacagaggagagtgagttatggcaaaatttgacctcccatgagcttcattggtgaatctaattttagctctgatcccatcccttctccctgggcgccctctgccctgaagcaagaggggcctgggcccagctgctccctccttcccttgggctctccccagttgctacaaaggagtgtgcagggccctgcccatctccagtgccctcccagctccttggaagagcaaggcttgacaccccccaccaggtcagacagcagaattggttgggtgcccagggttagtgacttgttaaactccccagccttgggcaggggaaaaggggagctgtctgcctcttggcctccagctcttctctctttctgtgcacaagcacagctggtactgcagcttgtggtcattaagtgagccaatctgcttcccgtctgcctctctctctgggcaacacctttgggaatactgctgtgtatggtccctggggaatctcacagcagctgggaagaagttctctgccttcgtggggccgtgctacctgggcagatgctgaggagtggtctctgcagggccgtccagtgcagactggttccacgaaggggctaagagcccagatgagacattatgcctctgggcgtctctcacattacccaggtgtttgggggcaagccaaaacataaatcaggaaggttagtcagaccaaacagtctccctgagccggagctggagagtgttagtttgccatttcactcatcccgtactggagccttcgagtatctgaggccctagaagagtgagcagcagggctgacgactgtcccatgagttggacacatgggtgtccgatggcagccacacagggtcagtttcaacgtgctgctctggttagctctgttggcagctgcaactgctcacatcctccattgctgtggcaccttcttaggttccttggcacagacctggacctgatggcttctgggcaccagacagggcttatggaggataaagctgcaaagggcctgctgatttgacaagagtatttcccctgtgccgggatgcacttgcacagcagtgtgaggggctcttaggccccgggcgggtatccgttttccctgagtgtttacactgtgaggttgttcctttcaagaattcctgaggggagttcaaagggggcttttctttgagcgatttggagagcgagaatgagagtgagacttgaagagggaacaggggccggaggtgcctttatctgcagagaattgctccagctttcctgatagaagctgctgccgcctcttaaacagcttagtgcagtcaaaagacaggcagacttgaaaggctgttttacagcgagatcagcgggggccacgaggcagagagcggggcgcagtggagcggaggaggctgaggctcctcagtgggggggctatcaaagggaggccctggctgatccctactgcctctgcccccaaaaccctgtctgcaaaagctggccatctgtcagcctaccctccctggccaggactgataggccctaactcttggggggttgggtgtggcctcgccaggcgggctggtgtcagtgcagcgcattgatcgcccgccgggcgggccgggctgcaagccgggcagcgcgtgcttaatgtgattgaaaggcagttaaaatggcggtgaccttttcaggaggaattagattgcctgccaagaccggttagagggagtgataacgccagctgaagaagctgcccagcagacttcagagagaaggaggcagaggcaggatgagcaggcgagtggcgaggcccatttaaactgcgctgtgcgtgctgacagaacagagattgctgtcgttgttagatatgaaagaagtgaagaattgcagataagttcctgtatccgatcacccccatccctcctcccagagtagggcctcttcttcatcctcagcaaagcttcccaccaggcccctggaggttggtctgatggatcagatcggttacctcaaatgtaatctgctgtgggaagcagtgaacgggcaagagtttcggtggagacacttggctgagggcaacaggccttagagatggggacctgtggttactgaggaggagctccagatatctcaggcctgggagtactcggattgatattttaggacaaaataaagaagcagacagagcaggtgagcactgaggtaggtcccactggaaacagatttttgaaaagactaaaggaaataggtattacttcaagaaagtaagttggaaggaatttttgctgcctaggaggcactctgaccttcccaattctagaagaaatacttaagctgtgtgtctaagttgttgattgtcctttcagaaccatagattttctaacctgctactgctctttacataaaggacagcacacagagcctagtgcgccaccaacattccactaaaagagatccgcagttagggagaaaagatgtttttcttgggtaccatgccaaacctgggcagagcaaggggcttctaggctagagaagcagactacaggggaacctaactatacagcccttaagacaagcctgcttccacctgtagtctaaggaggtgtgtgactaaggagccatgcctttcctctcctgtcctccatccagctcctggatcctggagaagagacctatagtggtgaaccatggtccctcctgtgtgttggttgccagtgagagttcacccaactgcattggggagcccagagctcctcacatctggaagggacatgctggaaagaggacatgggaatgattggtttcaaataaggtggcaatgatgtgggcacaagagtggtgagatggagaaatttcccaggaagcttcacaggaaatggaagcctgcagctgtatctttaagccctggcggtgactgcgttgctaaaatccagcatgaagcccctctgaaccaaacaggaggagtgggtagggaaaagaagggtgttaagacagtcagcagtgcagggtctttgtcctgctcaggtcctggcctgaagcgtttcttatctttcatgagttccttacatttaagccggttccaagtagctggatgagaagtcatgaagcaaacaggcagagcagctgtggcacaaatcttttctcttcttttcttttcttttcctttttatttatttatttttgagacagagtctcactttttcacccaggctggaggctagagtgcagtggcacgatttcggctcactgcaacctccacctcctgggttcgagagattctcctgcctcagcctcccgagtagctgggattacaggcatgtgccactacaaccagctaatttttgtatttttagtagagacggggtttcaccatgttggccaggctggtcttgaactcctgacctcaggtgatccacccacctcggcctcccaaagtgctgggattacaggtatgagccaccacacccggcctggcacaaatcttttatctggctatttcttgataaaacttcagcgccagaagtatggggcaagggggtaagaggtgttgtaagccccagggcatgggcacataggccttgccctagctgctgccttctttggtgtgctagttctcaaaagaagggagccccaggtgctaaaaatgtcccccagtgcagctctgctgttggtccagccagtgacaggtgttggaacagcacactgctggaggcggtcttggagtggagagggttgggctgctgccttgtgactccctaccatctttagttctctctgtcgcctgttgggaggggtgaggagaggtggcaaggagcaaggcaccttctgtcccccgtggcaactgatgggatttaatcgccttttggaacacaattgttaagctaggacagagggagtgcaggcagaaggagcaagtatcaatggttttaaacggcgtctgtctctctgcgtctctcctgacgtgaggcagtgaaacgcgttatcgaggaggcccggaaagtggctaagtgcgtttgacacacgccaactccctgcctccacactggataattgcattgtcaactgttcagcgaggtggcaggtgacactgcaggccgattgattgtcccgcatcgcagctccccagactgtcagctccccaatcgatggcgtttacacaagacaccgtaactgcatctgtaactaattccagtgtaaaactcgccggaagctgctgcccctgccctccgtgttggagagcacaggcccctggagggccccgagacgtttcctttctccctgggctctggttttgttgggagcagcaggtgaggaaatcgatgcctccttttttgtggtttcaggttccaggacgatactgcccccagtaaacgggcatctccagtttctcaatcgatcatctgatcaattgattaaattaacactgattttttttttctcccttctcaataacccaggaagaaatgagtttatgggagaagggtcgtttttataaaacgtagacctgtgtttcatttctgcacttaactctctccctctttgttgctcagttttcactgtgaggagaaggatatttttttttgcactacccaccccgccaggaatggacaactctggcaccaccctgctgggtatcattgaccatcaggcttaggttgcctatgggtgggggctcaggcctttatgccactttaagctggggcagaactgtagcaagaggccctccctggtgactgaagggtactctgggccatcttggaggtcctgggggctgagttccttccctagatagcagtagtaggagtggcagcttgcctgttatcgctggagctacatggaagaggagccagagacttggaaaggagctgtctgtgccatcttgcctctgagtactggcttgggatattccagcagctgagaacatcaaacgactgtggagccttcctctccaagcgggagggggggcaagctggcgggggcgctgtctgcataaaacggctttatggccgtttctttttattatgattctgccagaagtcagcaagtgacatttcattaagaaaataaagtttaatgtgctgggaaagaggttggagcaggctggggcagcacaagagtgaaattggcagcagcagcctgttctgaacacctgtgggggtagggagaggttcccaacatctgtctcagctggaggatggggtcagggtcagagtgaatggctcagaccagaggcagaggccttttctttggcaaacaaagtgtgtcgtgctgtccatcctgcctcactggccagcggaacagaaagctgctgcccggctgggagctgggatctgataaggaaagttgtatcctgagagatttctctaggccaccagctaactaggacctaatagagcagtgtcgccagtgtttagccagtactgctggggtgtgctgtgtggcaccagccatcagcctggccagctctgctgggtgatgctgagatcacaacagtgagtcaaacttgggacccttgcagcttccactctggtgagggacagtgacaataggtggtaataaatatgattttggagttacacaggattctgggtggacaccagggaagggacacctgtgtataagaacgtgggaagccccatctgccacgcagagcaccatgaggatagggatcagatcttgaagctctctattctcaacatggagccaaacagaggatgagcccaataaaggttgaaagaatggcattgaggtgagagttctttcctttagcagggatttagagagcagctgctctgtgtgggcactgtgagttaatggtaggaggcatggttgggctgagtcagacttgccaaaggagcaggcatgtatattgtagaccaggagggagaaggttctaggcagagagcaggaggtgcggaggcatgggggcatgagaaagcacaggatttgggagaccacagtagctctgtttaatggagtatgagtcctgggccaggcatggtgggcagtaagactacagagaaaaggacttcaggctacagggctgctttctgcgttgagaagctggggcttttcctggcagctttggggtaccctgttttctctgctttgccatggagccatattgggctcacatgtggtgccagggttctctgctttccacttataaggcagggctaggcagggccaggccgagcagaagatgtgaggccagctgctgagctgcgtgtacttggggaaggggggttggcaggacttgggtgccgcaagctgtaagtgaacctgatagctacattctgattgatggtggagtttgtctcccaaactgtcagagggtttatggaggtgccactcacccacaaggcgggaattgcttgtcaggacacctggccgtgtacaggagacagagctgtaacttggtgttttctcagcttaatggccctgctgctgacctgacctgcctgctgcctcaagtgtgtcagtgcctcagggtagagggcaaatgaggactgtcagggagaggtggattgcaggctgtgcctggcatctttccttcccgatgctgcttgcctttgggattggtggtgtctttgtgagaccagagactggtggggtagaagggagaaggatcaagactcagtgtttttcagggcttgaaaaatggagaacattccagatggagtgaatagcatgagcaggggtcttaagagcagcatatacaggctatgtttgtggtttggtgagcagcctgtgtgtgcacatgcttggggtttacagagtgaattagtagagagcaagagtaaagacataaatggacccagatcttcatggatctggctgaggagcctgggcttggttgtgcatgcagtggggagccatcaatggttttggagcaggaggaaaggtggtcagaactcagtggtaagcagaatgaaggaacagataagaggcctgaggactccctacaagacataccctaatgagagtataaggacctgagaggaaagagtggacaagcagaaatgtctgaaatcatcaggcagatactaagctgcttcctcacttctttaaggatttccttgctgatcccagtagccacagagtctcacattcttttgtccctggcagggctgtgctggctagtgaggtgtggtctgagacccactaggaggaagtggggagctggggggaacagctctatagcacttgaccctaggctatcaggaagggtggtcctggatgtcagagagatcgcctggcaggtgagcaggcctggtgtagccccagcagctcgcccctccctctgagctgagagtccgtctgtggctgtgccagatgcacctcaggggtcagccacttgcgtggcccatggcctggcctccgctcagcctggttgccttcatggactgctttgagaagtaggtgtgcatgcctgtcctccctcgtctgtcccttcttaatccctttataactgcacttgtccaggaatctgggctgagtgaggtggagatgaataattaatgtcaggcgcttcagacaccaaatatttgaacagctgcctggtgtttttgctggcaaggacctagcggccaaaatcaggatgttggccgggggtcccactctgtggctctgattggccttagccagcctgttctctcctctgatggacttgtcaggctggataatggggcataggggaggccccactcttttcctgtgaaattcctagacctgaatttttctgtcctcttactgttcttcctagacctggaagataggtggacagcaggcctgggctgagtgtccccgaggacgtgacataatatatgaatgggctagtttatgagcagagaccacttggagcagcatgcagtagcagagaaagatgaggtttgcagagtgaagggcctgaaatgtcagggtcaggggcactgaagtatctggctctatacatcccaggcccaggtttccctctgggccttatcaggtccaaagcctaacccctacctggaggcaacaggaggggcacccttggcctcgtcttgtccccaggccctcctcacaccctgcttcccacaggctctggcttcatcatgtgcagcggcaaagagaacccggacagtgatgctgacttggatgtggatggggatgacactctggagtatgggaagccacagtatccttggagcactatgggggctggtggggctgatagggcaggcacagggaataagaaaagtagctcttctagtattcacctgcaccaccccccgggccagagtctcagctttggccaggagggccatgctctcctgaggattcaaccctcatagcctgctgcaaactaggatccattgtccttgaccaccatgccagatacacagaggctgatgtcatcccctgcacaggcgaggagcctggtgaagccaaggagagagaggcacttcggggcgcagtcctaaagcaagtgtgggcacaggcttgggcgggtggagcagagaaacaggaagccctgaggcaggggttaacgcagtactgaccctcagggctgtcctgcccgccttcaggcctcactttgtttttcctccctcctttcctccagtggcggccctcccagcacgcgcatcacacctgagttctctaaatgggccagtgatggtaagtcctgccccaggttaggagtaatgggggagagggggtatccctagatggtggtgactgactcaagcccaacccctcacctgtgctgcccagtctggccggagtgtgagttgcccctctgtcccagcagagatgccatccaccagcaatggtgaaagcagcaagcaggaggccatgcagaagacctgcaagaacagcgacatcgagaagtaagtgtttggccaggagagagccctgggaccacagttcagtgggaggaggggccctttgctagcaggaaggcctgctgccagggcttctggccctcccaagtgcagctcagtgctgctgccctgggcacacggccggcagtggagcccagctggtgctaagcgtgactctgtgaattgatcactgggccacggccccagaagccttggcggtgggaggagcagtccacccgcctgcctgcctgcctgcccgcctgctgcggcggccttcgcccggggaatgtgatgtatggccgcccagcccagccggcacacttgattcatctccagtttctgtttcttaatcgggagctaaattggtttcatttttcttgtcccgggtggcactcgcagtggattttaggcaggaacattgggtatcatcacttctggtaggaatttttggcctgggttctctggcagaggaaaagggatccattagcactttgcccagggctgagcaacccctggcctggatccctgggaaccacaaagatttggtatcagctgggcatcttcctgccttcccagaagcccaaggaaggccagttctggcctcaggagatggcattgtccagtctaggctgcctggtgctgctgccattggtcattgcttaactccagtacccaccccaccttctgactgcaggctaggttgcctggggttaaaaggcagcctcttcattccagggccagtgttccatctttgcctcctgccaggagagtggattggaggccggtgcagggccgggtcggtggcccagggtcacctcccatttgtttccctccattttgtgttgtcataaattcattccagcccgttgtggttgatcagtttatctcggccggggccgcgagtgctgctggcatgatgtatgggccgcggcgcagggcccggctgcccatgaatcaccgcagctgctccgtgtcagcgccggagcgggccgtatgggttctgcgcaaccagcttgtggtggggaggaatgacgtatggatgtttatttaataattctctcctactccagctgagcagggcgggcggggttgtaaggggcacccaccctcgtctggaggggctgctcataaatcagaaagacaagatcattaatcagggatggcgcccgagggggaggtgggggcagagccagtggcttccatgaaggtacaacccacccaaggctggggggagccaggatttctgtcccacctgtgtgagcacaggcacccgtaggcagggatctctatgatgaggtggagactggctcagtcatgtgcagagctctccactgggtctggatctgctgagactggggcccatcagtccccgtgatttctctatttcttgccctagatctgttttactactcagggaaaaggaatggtaggatgccatggctcctccaggaatctccccaccccatgccctggagggactcaggaatagctcacagccagcctggaccaggggttggaggcttgggtatttcgccagagccaagattggagggcaggtgtgtgctgagcacatccaggataggtaggctctggagttggctattggccttcagtggggccttgtagctcttggagatggcatgggaaatggcttcattctctcctggcctcatccttctttgccattccagctctagttctctgatttggggtttgggagttagttctccattctggtgtaggctgcccccagctgcaggccttagtttccccatctttgacataactatataggactaggcaaattctcagcttagtccttggagtggaagggagcacagctacaaatccttgtctccttatcaggaatttacctgtaatccagatggggatggcacatatggcattgtgcaaaatgccagggaaggagcctgctgttcggaggcttgtgaggagggaagggatggtaaaggcttccagagccagagagctaaatggaagcccccagggaatcagccagtaccaggaggaaagagtcagagcctttcttggcatccctggaaagaggcaaggcagagggaatcatggaccctagggtgatggatttaagtgtccctgatacaaggacacagccactaaggagtcacgctctgtgttgctgctagctccccaaaggaaaaaggccagagattgaagttgtattgcccatgaaatgggaccactaccctccctgcactcccattaccactcacatccagcaatgacaggccacctgtaagctctcaagcttcctgagccaattgtctcccctaaactgcagaacaggtgcccccaggagactgtccttgcccaaagtccacgtcccttatgattcccccgcctcagtccagcctctgcttcctgattgagtacatctgtgaaacctgagctgttcgtacccccactcttccagcatcctcagcagcttcctgctgtccacgagataaacttcagctccttcaggtgtggcatttgaggtcctcttgcatgccatctcctttcttactgtagcactttgcctacatgtgggccttctagccagactgggctcttgggcctcttggcctctgtttctgctgttcccttggcctggagccccacctcctcctgggtgtagccagtatagtcatggtcaatcacacagttattagttgatcatggaatcagtctgccaggtttgaatcccatctccctgactctgtggggaccttgagcaagctacttaatctttctgtgctttagtttctttgtatataaaatggagatattagaatcttatggggtttttgtaaggtgtaaataagataattatcaatccctcagtacaatctctggcatttagtaagtgcttaataaattttagctattttatttgtattatcattattattccctaaggccagtctcctataccatcttttctacttttccaggaagcattcttctccatctgtgagctcccctggatcctgttcatttgttttaggagggtgggaaggttccttgagagagtcctagctattccctgttcagcagtgcagcccaaggagtcctggaaatgcaggagggaccttcaggtgcagggcttggcccacacacaggactaccagggcatctgatatatctaggaagtaacaaggagccctggaggcaggccagggctgtggcaaagagacctagatcatgtgggacacgcctagtccctgcatctgtccccctctccctggagtttggacgggccctttcttcagcaggtgtttgctcacgtcccatgcctgaggtggggctcttggccatagtcagtattggtggagtgagcagcccgccctcagggaacccatactcaggaactttacactgctgtggtggagttcacacggggggctgtgagagccactgtgcagtgctggctcaggggtctggaaaaggcttctgggagggcatgggaacaaaactagatctgaatgatgaggcagagctagtgagtcaggcgagggggtgcagagggatcacagtgcagaggccaaggcagtgaaaaaggtggcgtggatggtgacacataggagtcgagcataaaatgcgtggcaaggtcctcaggggtacggcgggctggggctggaccaaggagtgtagtggagctctctactccaagggggacattggaatgttggaagtcacaccacgagagatttgctttgagaacataaattcctctaggcgctgggagagtggaatagagatgaggggcctggaggcagaaaggctgtctggaaaaagttagtggtggaattggtggaagacatctgagagcctggactcatggtggtgaggagagatgccggagatactaggagagatgacagatttgggtggttgggaagactgcgaaggagtggttgaaaatggttccctggtatctggtgtagaaattcatccgaatgggaatggaggaatagagagggtgaggagtttagttctggaatgtggaatttgcagattcaggttatcagagaaagggggcaggcagggatgcctaggggacatttatgtatttggttctggaattcaagggaggcgtaggctggaggtacagatgagagatgccagcctgctacccaaccatgccttcctttttacagaatcaccgaagattcagctgtgaccacgtttgaggctctgaaggctcgggtcagagaacttgaacggcagctatctcgtggggaccgttacaaatgcctcatctgcatggtgagtagaaaagaacctaggggtgcccttggtcaggcttccacgccctctgggggagttggagagggtgggcctacctcagagtgaccccttctctgccccctcctccctaggactcgtactcgatgcccctaacgtccatccagtgttggcacgtgcactgcgaggagtgctggctgcggaccctggtgaggtggcatgggggtcggggaatgggaggccgctccgggcactgcccagatgtctgtgcttatgcctgagcctgcctgggggaagtggggagcatggcgcaaaggagaacagagccaggagccaggatatttacccgcaggatatttacccccaggctcgctgcctctcctccccaactgcaggtttaggaacttctccccctccatgagttcactgcattctcccttccccgccccggtccccgaaggcccactgcatcacacagactggtgaggcctggggtcaggaggaggctggctgtaggtaaacaggaccagggccttggcccctccccctcccattactaagctccttctgctcctgcccctgttcttcgctcaggagcagccattaaaatgtcgcccggagacagtaataaaaggctcggacgtgggctctgtgtcctgatcaaaggccgcgtgtaatctcgttagggctgcggctgccacagctggacccagccttgttctcattactggggctcctgctgcggggctggccaggcggtttgatcctggcgtccccccaacacaggagcgtgcctgcctgctcacagaagctgcctatgcgtccccagcctgggctgacaggaccaaggtctcagcacacactggtgcagagagacatggctgcaggcccaggtgctcacatgcgcacacatggctcattgtgtagaccagagccctccctgttctccctgcagggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagttgctgcctgtgtgttatgtgtgtggggtggtgggggagctaactaggggaggtgggctgaggcagttaaggggttaattcctggtggcaggatgggggaaaggacttagctataggtgtatgacactgtgcagggttggtctgctctggggccgtggagcatttggtttggaggggggtggggctggggatctgggctcctgactattgatgggtaggggctctaggttaattctttatcgatgcagaatcgtcagctcattaatcacagaagaggtcagagcttgggggtacagaggggatgcaagctctatcccccaacctaggctaggagtggccacaagcttgggtacaaacacaagccccaggcctctatccctttctggtcccctgaaacataccagagaccacagtgggatcaccctatcagcctcccaggcttttgttctattctccaaatgtatctctagtgaccatcatcccagtgtagctactgcctagattctcaaatggaaagaatggaaaccctattatccaggatggaccttcaagtctcccatgtgctcagagaaccaaggctggagagatggcactttgacccccacagctccccactgccagtgaggtagctcagcttcctagatgcctcccaggcaggtgctaaaagttacatgtaagtcttcacccacaacagaaagctgtttggagaaaaacagtcaaggccccagagtagccccatgactccagacttgctttgacaccttgcacaccaggcccatctgcccaaatccccagccttagttgcccattttctctgggatacccacagtgaattcctcagaattgggtccagttggcagctcctgccaccctttgcacccagatgaagcacagacaagtcccccttggagcccagcaaaggcccttcacagctccacgcccagtttgatggcacccaatatcctgaacacagggatcctggggatgtacacagcctctgtcgaggcgggtggaacagctccagcgatggctgagggtttgggaaagaaacaggtttggaagagaagagtgggtaggtgagggcaacggagagatgaagaggaggctcttaatgcccagttcctgtcaggccgacttctttgatgtctttagtctcccctcccacaagcttggactcagtaggtccttgatggctggttactgccaccctgggggccatatggtctctaaaaggggccattaacccagagtgagggcattccactgaagcccgccctgctgtgggagccttgagctgtctcatggcacaggctgcactgccacctgttggccatggctaggaatgcagccacacagcatgggaatccctgccaccatagtggggactcaccaaggactgatgggatgcagacagaacgcggctctggggacaaaggatccatcatccccaagagtcagctcccatccagagcttttctagccatctccttcactgccccctaagccccgtgatcaccacggtaagctcattcaatcaaatatttattgaatacctactatatgccaacattgtgcagtagtgacttctagaatgatcaatgatactgaactatcaggctgaattcacctcttctgcctagagagtatctaagtgggtctcccttccagaagatgaaggagtttgctatttcagcccaaatccccttaccctggttctggtctttagggcttgggagttagctcatcccagctcctgttacaatgctgctgccttcctgccccccactgtctctggcaactttcagcttgcaactttcccagacccagcggcttcctagcaaagtgtggtagagccaggcaggcccctaacctcagctcctcatctggcttctacctcagactcccaggcaatggggtcagaggagcctctctgagtgaactgccaagtgggagccatgtgaatggtactttacactgtagggcttcgccctgctggagcaaagatcatagcccctatccgcagcctgacgctacccctgaccgatataccttccctctggcatctccccacaaaggtcaccttccattcaaggaatcaaaactcaactctggtaacaggcacaaagtttcagttatgcaagatgatgaagttctgaattatgcaagatgcaagactattcagttctagaggtctgccgtgcacataatctcttaaattttaagtatcgtacacacttacaattttgttaggtgatcttggccaggcgcggtgactcatgcctgtaatcctagcactttgggaggctgaggtgggaggatcacttgagcctgggaggttgaggctgcagtgagccatgattgcaccattgcaccccagcctaggtgacagagtgagaccctgtcttgaaataaatagataaataaataagtaaagaaaaaaagagagtaggtctcatattaaatgttcttaccagagtttaaattttaaaaaatcaactagggctcaccctcaacacccccctccatttgtcaacctctacagcctgcatgccacaggaatcagcagcctgactgttgcacttgtccaaacacaactgactgcaaggctcccacagacacatgcccaggcactcctgccccttaggattctgtggtaagcagaccaccagcagacagaggcccccaggagacaggcccataggaattttctacttaggggaccgcaaagtcccaaagggctacagggagttgaacgagaagagtgcccgacagattgcaggttgtggggaggtgtcaggcatttatttctggagcagaggtgagatggagcaatggcctcagcagcggacgcagttgcgcatgaagtcgacacagaggcttgtgtagtaagtagggtagtcacggaggtggctgacgtgtgcagatgacacgaaatccacagaacgcgccaggacccggcgtgccaggcgtgcctccaccatgcgttctatgtctctggccaggactacttcgtcagccctcgagtagaggtagagctcgggccagcgagagcccgcgtcctgtagcctgtcatagaagtgggtgtggaagagggctgtgatgggagcaagcaggacgtggaacaggacgaccaccagggcaaaggccaccagcagcaacaggcgcagcatggcggcccggcgctccaggatggctgccagggcccgcagagcccctaccaggttgctgtcaccaggagcgctgtcaaagatggtgcccaccacacgcaggcggcagaagcgacgggtctgcaggagctccagcacgtagcggtacagcatgacgccaccgttgctgaagacatggaagagcaggggctccttctcaatctcataatcaaagagcagctcgagcagcttctgggccaaaacacgaagtgaagggatacccagtgactcggagaagaagaccatgtgccacggggctgtgtatcggattacgatgcagccctggggagagaggcctggtcagtcctcacagatgaggtgggggtagtgggtacaagctaaggtcagaggggcccagcaaccccagcctgtaggacataggccatggggcccacagcgtcagcaatgctctgggtcctgcttcagcctgagcccaccagcccgctgcccacagacacaggtgccttctgggcagggaaggtatacttaaggcccatttttggactaattgcttcatgctggccaagccctcttggcctggagtggtatttgaggcccagagcctgaagcatatactggagacacctgggctgaccagaggaagtctctttactctggttccctcctgtctgtgccccgcactcccatcctaggccttgcacatttgggatggggcctcactgcttggctataccctgtcccagcacctcagatctgcactgtccctacctcccagacagaagtagtacccccatgagaccagtacccgagagctggcctgcaggcgccagccctgaccaccagaggccacttctgagccaggcccacatcactttcatcactggtcactgtcaccttccctctctcccaggctcctaaaaacagagtccatactctctggactcagggacctgacactcaaatgtccctggttccccggcctgggatcactcctcatatctgccctgaaattccaaatacagtaaacacttgttcctcgaattctataatctgggcccaaactccctctaggtttctatattcctcacgcttgggccaagggtgccacaatctccacacaggtccccttctaggtcagttagaaaagccaccatgcctggctcctaatcccctctcatcctcctgttcagagacaaagggccctttgtcaggggaatgtgactttggagagtgctggggtcagacaggtccgggttcaactcctggcaccactatgtatcaatagtaagaacaaggagcagcttactactttctgagtctgggtccccatctataagattacggtgaaattgggataacacccacctcataaggttatgggtaaaattagatgaaaaaaaatgtatctcaaatgatcaaagcagtacctgacacaaagtaaactctcaaccaacagcagcagtaattagtgatgtggtagtgacaaggagaaaatcgtatggccacagtagttaaatgacccatggctaaacagggatggtcagcagaggtaccttgccatcagccgcctgacctcctagccctggagtgcctaagcatccctcccaagactctgaagaggaggctgcttaaggccacccacattctcccaaatgctcaaatctgacagaggcctttcagtccccactgtatgtttctccctggcagcatctggaatcacacactcctagaaatattatcttgcagcccagtctcttcaataagccagtaacatgaaaaaaggggctgttctatagcctggacgacatagggagaccccatctctaaaaaagaaaaaaaaaatggttgggcacagtggctcacacctgtaatcccaacactttgggaggctgaggtgggcagatgacgaagtcaggagttcgagaccagcctcaccaacatgatgaaaccccgtctctactaaaaatacacaaattagccaggcgtagtggcacatgcctctaatcccagacacctgggagtctgaggcagcagaattgcttgaacccaggaggcagaggttgcagtgagccgggatcacgccattgcactccagcctgggcgacagagcaagactctctctcaaaaaaaaaaaaagaacaacaacaaaaaaaatactagcttggcgtggtggtgcatgcctgcagtcccagctactcgggaggctggaggcagaatgattgcttgagcccaagagttgaggctgcagtgagctatgattgcaccactgcactccagcctgggtgacagagtgagaccttgaatctaaaatcaggtggggaggggaagagttctggatttaaaagagccttaagaagaaacaaaataactagatgcaatgtgtgatcttagattggatcctgtttggggcacatccgctgtaaaggatgctttagggacaattagggaatctgaatatggactggaaactaaatgagatcaaacaagaaggtggagatcatgatctgaaaaaagcaggatacaaagcagtagattcaataggtctcatgtaggtaaagagaagatatacccccccaaaaagctggaaggatatacactaagtgtaaatagaggtcatctctaggtgctagaatatggtgtttttgttttgttttgcttgttttgtttgagacagggtctcactctatcacccaggctggagtgtagtggcacgatcacagctcactgcagcctcaactttccaggctcaggtgatcctcccacctcagactcccaagtagctaagactacagacacgcaccaccgtgcctggctaattgtttcaattttttttgtggagatcaggtttcaccatgctgtttaggccggtctcaaactcctaggctcaagtgatcctcctttctgagcctcccaaagtgctgggattacaggcatgagccacagcatccaccttgttttcttttaaataataaaatattagagttttgggttggactttttttttttctctacattcatcctgtcctccctattggaaagtcttcctttccaagactacccctcccccaaccctgcaacctcaacacctctgccttctctgggatcttactccatctactttctccctcatgccttctgcccaagtagcatctttacccctgccctgtacaacggcccatttcccaaagactctgcagattctgccacaccttcctgggttttcatatccatctctggccactcctcctttccttgtaggaccctcttcatcttccactccattaagtttgggttcctcaggactgtcctaggccctcttctgtccctctacacactccctgggggatctcatccactccagagcctatggattctcttctagtgttccggtctcaaaaaacacacccccctctacccaggaggtgcccagccagaaacctggcattaccctgggaacctccctatccctgtgcccatgcccaatctctcattaaactaccattctacctcctgacaaactcctcaatccatcaccttacctctaccgacacccccaactccaaggtcctgactaccctctatccctggatcatggcaagcccctctaaactcacttctggcttcctgccccacccctccaatctccccgctactctgcagcaaggaactttgtttattttgagacagggtctcactttgttgcccaggctagagtgcagtggtgcgacttcggctcactgcaacctccacctcccaggttcaagcgatccctaccacctcagcctccctggtagctgggactacaggtgtgcgccaccatgcctggctaatttttgtatttttagtagagatggggtttcaccatgttggccaggctggtcttgaactcctgacctcaagtgatctgcccgcctcagccttccaaagtgctgggattatagacatgagtcactgcgccaggccaaaagggactttctgattcacgaatctaacatcacatccctgcttaaataccctgaggaccccctccaagccccacctcttgccgggtacctgtcccttcattcttcatcccagccatacttgactattcctggtccccctgcctgccctcaaggatctcaggctaatgaagaagccagacaagccgagcccagtgagcagaactcgcagctgaaactgcccgcagtgaggctgtctgtaaaaagcaacaccagagccccagcctcggaggtcggggagagacttcaagctcagaactacattttcccccagtctctctcccattccagggccaccacacacctcagtcaggcgggatgtggacgtgggtgagtggagggatgctgagggaaagggggctcagctggcctttctcccaggtgcccccccactgctcagtccaaggcttccagctggcagttggagctgtctgtatgggtacccctgcaggaggctgtttgggggagagatctgggctgaggaggggaaggtggagctggaggcccaagatgtgagagaggcttccaaaatataaccaggtcctgctaaggccctctgcagttaccacagtctctatatccaaccttggttggatgagaagaagcgtgaatctcttttccaagaggccctactagtctgggaatgtgaaaggtgccatgggcagtcataagacagaaactcacctggtgggaaaggaggaggtcctgggagtacaagctatgtccagacacccagccctggctcctgctgcccgcagaggcactggccagttaatagggactggagcctgggctgactctacaactgtagggcacatcaagggtgggctgcccattgtggaatgcagggaggaaggaaggggaagccatcaggagaccaaaggggtcacgccaggccacagagctggcagccaagtggggataatcccaccaagtccctataaccccatggccttcctcacaggcttttttttttttttttttttttgagacggaatctcaccctgtcacccaggctggagtgcaatggcacaatctctgctcatgcaacctccacctcctgggctcaagcgattctcctgcctcagcctcccaagtagctgggattacaggcacgtgccaccaggccggctaatttttgtatttttagtagagacagggtttgaccatgttggccaggctggtctcgaactctagaggctgttcttaaagccattcccagtcctgcctcaaaggtggtcagccctcacggcagcccaggggagagggcaccagagtactcacccttttgtggtagatggcactgtacttggcaaggttcttgtccttgcagccaccccagcccaagagaatcaccacaggctgccgagtttctgcctccttcccacctgggctggggctgttctctgaaacacagatgtggactgtcaacaccagagctggggtgggggcgggggtgactgcccaatccagagtcagcagcactccggctgctgcaggcagggaacaacgggtgccaggcccaggcatcctgccagcacgcatgcaccagttcccaccccgtgctgctccagctgcctttctgcaggaggcaccatggggtcaccggacaaaccaacacaagggcacctttctttagagactcgaagacagcccaagtgaggaaagtaaataccttgtccacgccctttcctcttctgatccagggctcagcgaactacaaccccggggccaaactgagcccactgcctatttttgtatggcctgcgagctaaactaattttcacatttttaaatggttaaaaaaaaaatcggctgggcgcggtggctcacgcctgtaatcccagcactttgggaggccgaggcggacggatcgtgaggtcaggagattgagaccatcctggctaagacaaaaaaatacaaaaaaaaaaaaattagccgtgcgtggtggcaggtgcctgtagtcccagctactcaggaggccaaggcaggagaatggcatgaacctgggaggcggagcttgccgtgagccgagattgagccactgcactccagcctgggcaacagagtgagactctgtctcaaaaaaaaaaaaaaaatcaaaagaatattttgtgacacgtgaaaattatatggaatttaaatttcattgtccacaaataaacttttattggaacatgccacacttatcatttacttagggtctatggctacttttacactaagaacagcagagtagagtagttacaacaagatcgagcgactcacaaagcctaaaatattgactggccctttacagaaaaagtttgccagcccctgttctaattccatgagcagatggaagaagagggtcttttctgagatggagtcttgctctgtcacccaggctggagggcagtggcacgatctcagctcagggcaacctccatctcccgggttcaagcaattctcctgcctcggcctactgagtggctgggattataggcacccaccaccatgtgcagctttctttttctttttttttttttaagagtaaaaaagggggtttgccatgttggccaggctggtctcgaactcctgacctcaagtgatctgcccacctcagcctcccgggaacaagaaagtcttaaaaggagaaatggataggacagtgcaggcagggacatgaggctgactctggcccataccaagccacctaccctgtcctgccagagaatagcctatatttattgaggtttaacccttataacaatactctaaggcaggtcctcttattacagatgaagaaactgaggcagagtgaggttaaggtacttgtctaagcaaagtgtaggg

SEQ ID NO: 496 - DNA, 41073 bp, Homo sapiens
gcagccaacagacatatgaaaaaatgctcgtcatcactggtcatcagagaaatgcaaatcaaagccacaatgcaataccatctcatgccagttagaatggcgatcattaaaaagttaggaaacaacagatgctggagaggatgtggagaaataggaacgcttttacactgttggtgggagtgtaaattagttcaaccattgtggaagacagtgtggcgattcctcaaggatctagaactagaaataccatttgacccagcaatcccattactgggtatatacccaaaggattataaattatgccactataaagacacatgcacacgtatctttattgcagcactatttacaatagcaaagacttggaaccaacccaaatgcccatcagtgatagacgggattaagaaaatgtggcacatatacaccatggaatactatgcagccataaaaaagaatgagttcatgtctttgcagggacatggatgaagctggaaaccatcatcctcagcaaactaacacaagaacagaaaaccaaacactgtatgttcccactcacaagtggaagttgaacagtgagaacacatggacacagggaagggaacatcacacactggggcctgttgggcggagtggggggcaagcagagggagagcattaagacaaatacctaatgcatgcgaggcttaaaacctagatgaccggttgataggtgcaacaaaccaccatggcacatgtatacctatgtaacaaacctgcgcattcagtacctgtattccagaacttaaagtaaaattttaaaaagtaattaattttaaaaaaaagtaatggcactaacctaataggatatgtgcatattcagttttactctatcaggcgaaactgttttttccagagcagtgataacagtttacatttccttcagcagaggacgagtgtcttcaagcttcacaccccagccagcatttggtactgttccactttgtatttttccagtttgcttcgtatgtacatggtacctcataattttattttggtggtttgttttttgttttttgtttttgagacagggtctcactctgtagcccaggctggagtgcagtggtaggatcacagctcactgcagcgtcgacttcctgggctcaagcactccctacaacctcagcacctccccacccccatccagtagctgggactacaggcgcaagccaccatgcctggcctttataattttaattgcatttctctaattactaataaggttaagattaaacattttttcctatgtttatggaccacttgtgtttcctctcctattaaattcttgtttgtgtattttcttttttttttctattgggttttctgtctctttaatattgattttaggagacctcctaatagtctcgataccaatcctgcacgggggaaaaaaaaaaaagctctaggctcattctgtgacttttcatttcatgctatacatggcaaggtcttaaaaaatgtgtatccatcttttctttatggattttgccttctgcatcttgtttaaaaaattcttaggccaggcgtgctggctcatgcctgtaatcccagcactttgggaggcagaggtgggtggatcacctgaggtcaggagttcgagaccagcctagcaaacatagcaaaaccctgtctctactaaaagtacaaaaattagccgggcatggtggtacacccctgtaatcccagctactcaggaggctgaggcaggagaatagcttgaacctggggggcggaggttgcagtgagctgagatcacaccattgcactccagcctgggcgacaaaagtaagactccgtctcaaaaaaaaaaaaaaatcttcactgtcctatactcacctataaggtctaaggtctaatgttttaatttttctttcacagctaagcctttaatctacctggacttgtgtaagatatgggcagtgtgattgacagagtgcacagatgtctgcaattatttccttcgctgtatccatgtccctttgtaatgttacttttcagtttttaccatcaagagacagagcctactttcccaactcttgaaagtgctgctgtgctagtttcaagtctggacctcaaaaggcctatacaattacgcctgatgtcttagaacccttcctccaccacaagaataagcccagactaacctgcaggaagatgagaaaccatgtgaagccgaaacaagacgtcctgggtgaagccatctcaggccagtcagcccctagctgacccaacagctgaccacagatgcatgaatgaacccagtcagggccagaagaaccagccaggagctcaatcaaaattgttgacccatagaaagaagacctaaataaatgctcgttgttttaaatctctgccttttggagagatttgttatgcatcaaaatgctaacagatataggtagaaatccatttcatatttttccacatggataatcacctgtgcctgtatcatttatttatgaatccatccttcctcattaatctgcaatgccacttctctcaaatagcaaatatcaatatgtggaagggtctgtgggctttctcttctgttccattggtttgtaagtctatccttaggccaacgctacactgtgtggtttactatacttttataataaagtgtatttatttatttattctttttttaaagacagggtctcactctgtcacccagactggagcactgtggcatgatcatagatgactgtaaccttgatcctgggctcaagagatccttccacctcaacctcccaagtaactaggactacgggcacgcaccaccacctccacctatttttttttttcttattttatagagatggagtctcactatgttgcacaagctggtctcgaactcctggactcgagagatcctccagcctcagcatctcaaagtgctgggattacaggcatgagccaccatgcctggcttataataaaatttaatatctggtagaaacattccttccatcttgttcttcttcctcaatagttatctcttcctatccctttgcatttttatataaattttgaattaagcttctgaatattcatgaaatatcttattggaattttgattgaaaatgcattgaattgttaaatcaattttgagaaaaccgacatctttacaatattgaatctactattaaagaacatggcataccatttatttggtctttgatgcctctaaaatttctagaattttcttcatcaagatcttgcatacctttgctggacttacttctaattcattttcagtaatattgtaaatagtatctttttataaatttcactttcattgctgttgccctacagacctgctattatcttttaacaactttaaaattcacagaccataaaatttacccaaaatatacaatataatgattttagtattttcacagagttatgcaatcattaccataaccaattttggaagttttcatcactccaaaaagaaacttcatatccattgtcatttcctccccattttctcccaacagccaccctttctttcctgacaactactaatctacttctatctctacagatttggctattctggacatatcagttaaatgggatcatagaatatatgatgctggctgggcgtggtggctcatgcctgtaatcccagcactttgggaggccaaggagagtggatcactggaggccaggagtttaagatctgcctggccaacatggtgaaaccccatctctactaaaaatataaaaacttagcctggcatggtggtacacgcctggaatcccaggtactcaggaggctgaagcaggagaaccgcttgaatgtgggaagtggaggctgcagtgagctgagatcgcaccactgcactccagcctgagtgacagagactgtctcaaaaaaaaaaaaagaagtaataatcagttatcattcatactgatttgtcagccttcttttggtgaagtctctcgctttttattttcaagaatttcaagggtctgagtaaaactggcccctaaccctcaagaactagatggggatagataaaaaagttttttatatagtcaagctttgtgagtgttactggtcactgactctcctcttatgaggtccctctcttacataagcaatatgattaaaactgatgaaatatttgtgtacattatattcaaagaggaggagcagttgcagcatattttgtattttgtaggcttttattttattttgtattttttgttcctaatgcttagttttctcaagctttttactaaatgacattttgagttgatctgagagtttaatctttatttctagatgtcaggatttcagtggttcttttaaaaataatcagctctactgcttactctgattaattattttccctaggcctcaggatcattcagctcagcaaacaaataccgctggaagcaatgttactacatcatcaactcctgatagtaactccatatctggttctgctactggcaacccttttggtttaggtgtctttagtcattccaatagaaatgcaaaaaaatacccctttctgtttctgggtagtttcagataaaatgagaaaataaaactttatgtcactttaacaacaaaaatcttaaaaactaatttatatagtcctacaattgtagatattaaggaagtggttggggatatggatgtcctgggttaccttacatttaataagtggtcaataattggcacatttctttttaataatgaaaaagatgcagtgtatgtatacctgatctgactaccacataatttagcatgagtaagattagttaattgttcatcataagccagcacttctgagtaataattttctcatttgtaaaatgaagggatgggactgcattagttatttttgtaactatcctgaatacatggaagggctggggcctgggaagccagcccagcctaaaactgcttttacttttcttatagtcgtttttttgtttgttttttgttttgttttggtttggtttggtttttgttttttagttttttggttttctttaagagaggcaggatcttgctcagtcactgaggccagagtgcagtggtgccatgatagctcactgcaacctcaaactcctgacttatgggatcctgttgccttggcgtcccaacctacagcatctataatgctgaggttacagatgtgagccactgcgcttggcctatattagatttatatattgaggttctgtggaagattttgttgaggatgaaagcactctgaagcttaacagaagttgaagtagatagataaatggcttaatgcttcttttgattcttgtatgactagtatagcaccctgaaatggcatatttatgcacagtttttacatatcaatgatcatgccttttatctcttccataagattaattcagttgtgccatgccaaatgtatgttagaggcatttaaggtatggcatggcttgacataggttcacattcactgttagttttgttttaaatgtttcctgtccttattttccaaaaagatcttgtgttaagtcttttgattgaggaaggtgtgttttagttgtcaaaaattattcatatgaacaatctagagaaattaggatgaaatgatttaatgttcagacctatgaaaggtattgttgaggtaattctctcctgtcttccttcatgttataggcagagatcttgaatcagaaagaggcttttagttattttgtcagaggctacgcaacccccatatcccttcatttctagtctcattcccacatcctccttctatctctgcagcttttctccatcaattaattcatcaattaatctaacttcaaagatcatacttttcctactctgttaaaggccctgataatccattaaacaaatgattgacaagaagtgaatcaagtccaggcacagtggctcatgcctgtaatcccagtactttgggaggccgaggtgggcagatcatttgaggtcaggagtttgagaccagcctggccaacatggtgaaaccccagctctactgaaaatacaaaaattagccaggcgtggtggcgcatgcctgtaatcgcagctactcaggaggctgaggtggcaggatcacttgaacctgggaggcggaggttgcagtgaagagattgtgccactcactctggcgtgggtgacagagtgagaccctgtctgcctcagaaaaataatgataataatttaataaataaataaaatttatttttatacatgtgtaaatccagttgttgtagcaccatttgttgaaaagacagttctttcctcattgagttgtcttgtcacccttgttgaaaatcaatttcccataaacttatggatttattcctggactcccagttatattccattggtctgtacatctatccttatgtcagtaccaaattgactttatgagtatataagtgaagtaagttttttaaatgggagatgtgaatactccaacttttccctttttcaagatttttctatctccttcaaatttccatatgaacttcagaatcagcttctcagtttctgcaaaggagccagctgggattttcatgaggattgtgttgaatctgtataatttggagggtgttgccatctcaaaaatattgtcttccaaatcatgaaaacaggctgtctttccatttatttaggcctcctttaatttctttcaaaaatgttttgtcgttttcagactaccattttatacttctgttaaatttctaattattttgttctctttgatgctcttgtaaatgaaaatttttttaattttttccttgcagattgtttagaattacaattgattttatacactgatcttgtaacctgtcactttcctgatctcacttattaactctagtaggtttattgtggattccttaggttttctataaacaagatcatgtgatctggaaatagagatagttttacatattcttttccaatctggatgccttttatttctttttcttatccaattgccctggctagaacctctaacagaatgtagaatagaagcggtgagagaagacattcttgccttgttcctgatcatagggagaaacattcagtcttttcaccattaagtatgatgttacctggggtttcacagatactttttatctagttgggaattttgtattcctggtttgttgagtattttgatcacaaagggaagttgaattctgtgaagtgcttttgttttacatctattgagataacagataccattttgcctttctgcaaactttgttctggatctttagagtggccacttttaattatgaagatgtgaagcaagtatacagccattacttccagaagaaagtgtaacaagctacttggctaagacctgggatttgacttttaagctctttcatgcatctatttgaactctcagaattaaactgggatcaaggactctcctggaagggaaagggggaagatccaaactcttctcaattagacatatcagagctgtgaggctcctggtatgtgaatatctgtcccaacccagccatctttgtggatgatttgcctcccagggaagtgcctgtgcgcattaaggtgctcgtcactgagctctgtttaaccgctgtggaaatggtcagcttcatacaggagcgctgccatttctgtttgagacttacagtacatgctgtccagaatctgggggtgatctggacttgagtgactatagaaacgcatgcaagaagctgtgcctcgctagggactcggggtttccagagtaccatgtgcctcagtacaacagttcttgcagtagacaggacctaaaaccagaccaatattcagcatctgggttgccccatagtaacagctgggaagcaccgagacaaccaggaccagcaggtggcactctttggaaagcaaaaaaaaaaacgtggaattcagctcttaggggcacctttgaagttccgctgtcctggaagcaggcacagagtttcactgacactggcatgctgggtatctttcattggtacctccagatacaatctccacccttctcttccctgctctgagcccaggaaattggcatgcatgggcaccgccggactccctagctctccaccttccaattgggtttggctggtggggtttggccacgagcaggagatcacagggcaagaggaggggaggggaggttatttattctcctgattatttttctgctgggtcaacaaggaatgtctatctctctcttcctaaggctacagtcctgtcagacacttctttctatatggtctattctctctgtctctctccttccattctcttcccttcccatataaaggctccctctcatcagcccctttctatttaagagtgaaaacacttctcggttactcagatgtggactctgcccctagttgctttttctgaccctacccacacctgtgctaatagtccctttgttaaatcctgttcacctgccccaatttgagcatgctgtttcctgccaccaccctgagcagcacagcaagtttaagatccttggacatgtctggggaaagaaatccaaggagaagaatcagattttctgctaatcattctgatttgaacattgaaagaaatatgagcttttttttttcatactgagctagcgaagcagggcacgagttaagagtatttgcatacacatctattcctcttatcaagcttgagaatgcctagagggtaatcttttaaatgaatattaatatgatattaaccagcacatggtagatgttcaagaaatgtgtattgaccataactgaattgtaagacctctctccaagcctcaatttcttcacctgtacagcccccatccagattgaaatctcacctactcgggctaagtatatgaaaaacaaaggcagtgcaggggtaattgaactattcattagataaatgcttttatgtcacttttattgttttctaggacacagagtaatacctaccttggttaacaaaagaccaaaggaggtgatgccaaatgcggttagaagtgcttttaatcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaagaagtgcttttaatcaaatagttcaaacgacacataattaacattgttttaaagcaaatggacactttaaagtggtgctccttcctcttaaagccccaaccagtgctggatttaacagcagagccatacagccaagacatatgctgctacggtcaacactcaaccctaagtttgacaccaaaagatggccgccatttattattgtgacaaaaggccagattacaaaacgctgtgtacggcctgatcccagttttacaaaatactcatacccatctatctacgacggggcgcggggaaaggggagtcgttttaggaagtgctgcttattgctgcctggtgtgggaaattatgagtcttattttctgtttattctttttacaagaacatttttataaatgaatgaatgaatgctttccatgggtggatgaggatccggcctgccagggtgaggatcctctggaaccaagaggggccggggcagtagaacgacaggtggcggggctttgggcggctccctccagcccagggagacgcgagtgccaggccgggcgcgcgcttcacttccgggaagaggaaagagggaggggaggggagaggaaaagaaggggcaggagagagaggccgggaggttgggaaagggaggaggaaagcatggaaaaggggcgcgggaaaacggggagggcgcagaggggcacggccctcactgccccggccggggcgagagcggctccgcccctcgagcgccgggtaggccggggccggcggggcccggaaggcgacgggaaggagccgagcttgggttatggcggcgccgggcgcgctgctggtgatgggcgtgagcggctcggggaagtaggtccgggagagggcggggggcgcccgggacaagtgttgcgggcgcggcggaggccggacgcgtcgccgtccctgccggtggactggggtcttggggaccccccacccttccctttgcagatgaagaaaccgaggcccgcggctgccgcgccctctccccgccctccagcctgctcgcggggcgcccatcctgggaccgcatccgagctccgggttcccgctctaagacggggaggctgcggcgaccgcaggctcagggaggaagccgctcctgaacaggcggctgcggggccgcgcaggtggaggcctagcgagcggcgcggggctaggtttcggggcgccttgtcggggccaggcgggagggcgcacggcctctagcgagaggacgcaaaccacggcccaggctctcacagacctttggccatctggacacacagcggcctcctcctatgaggccctggacttctccgattcaattttggaaagtgaatcgttttccccttcctttcatcagcttaacctggaaggagacagcgttaatatggagggtggctcctgagggtttggaaagaaagaagagaattgtggaaaccacagaggtagcccagtgtgctaacctggagactgaggagttaacatttggcttcctgtttaaaccaaagtctaactgtgccctttatcagaaaagacagctgctgtaccattcgaccacaggcagcaaaggacagaacttgatcagctaaaacatcataaccttcaagggcctataggacccttctagaattttctgaatcaggaacggcccatgttgtggcctgtgtagtcaggtgtatattaaagatttactccaggtagatgggttttgctttccaaaattattgtagggttctcagccacaaagataaaaagaaatcttgaactgcaattgaaataaaacatggagcccccaaatccctagctgccatatgatttgaatcagttggagaatgtaaaatcattgccatggtgtgatgtaacaggagtgaagagccctaggtcttggttctgttgctgtctggctgtgtgagcctgggcagttcatgtaccccctctgagtcttgaatcagatgagggaggcctaatccctatgatgtatagcttgtgatattcatgtactcagtaattattgagctcaatccttactctatgtcattgtcatatagcgaacaggacagataaaatccctgccctcaaaggatttacattctggtatgggagacagagtaaatgaatatatgtagtgtgtgagttggtgatagatgctctggagtaaggggaacaaagagtgccaggcagagtggtcagggatgtctcctctgggggagtggcgtttcagcaaagacctgcaagacttgaggaacctgccatgtggatagctgaggaaagggcaggacaggcagagggaatggcaggtgcaatggttctgaggcttagcttcttttgttttttttttgttttgttttgtttgaggcggagcttcactcctgttgcccaggctggagtgcagtggtgcaatcttggctcaatgcaacctcctcctcccgggttcaagcaattctcctgcctcaggctcctaagtagctgggattataggcgcccaccaccatgcacagctaattttttgtatttttagtagagacggggtttcatcatgttggcgaggctggtctcaaactcctgacctcaggtgatccatgcgtctcagcctcccaaagtgcagggattacaggcgtgagccaccgcgcccagctaaggcttggcttctttaaggagcaggaaggaacccattgtggctgagtgaggggaagcatgatgggagatgaagtcagaaacaatgcaggtaaagagaatgtggtcatatgctggcaatattttgaaggtagagtcagaaagatgtgtttgtggactggatgttgggtgtaagaagacaagagagaagtcaaggatgattcaagattttaggcctgagtaattggaaggagggagtcgccacaaactgatttggggaagcagtagatagagcagatttggaagacaacctcagaagctcagtgtgggatatggtgacttggacgagccaattagtcatccagtggatggtggttggatgtccaagtctgaagttcagaggagagggactttagatctaactgtgggaatcactgttgtgtgggtgtacttaaagatctaaggtgttgagatcaccaaaggagtgcatgtagataaagaagctggccaagaactgaaccctggggactttcagtggcgcagggtcagggagatgtgtccaatgttattgactagctgagtaataaaaagactgggacttgattatattcatcattggatgtagcaacatcaagttctttagtgactttgtgaacccctattggagccctacaggattttttaattatactccatagcatttagaaaaatatttatcacagcctaatggctgaagagaacaatagtctcaaaacagaaagactccatttagaacactgttaaaacacagtgacctcaaggactaagtttgttactgtcttcccccacctgaatgtaaaggattattttcctttttatttactgatacatgtgtctagaacagttcctggcatttcgtagatactaaatacttgttgacttaatgaatggatggatggatggaagacggcaggcatctgagtgggtggcagagttaattttctttatattttcacaatcttaatgaagccacccttaacatctccttccaggtttccttctctttgctgatgaaacaagctcagaccttttgaatatctttctcattgattctgcatcccttccttctcccccattggtctgtgttgtctttttaagtcccttgcccctgatttagaccaacccactgggagacatatggaccccaaatcttgatttgtaatcctgggtctgaccagtatttttgggcccagcactgtgccttatttctgccagggtctttggtgcatattcaagagtccaggtgttctctggtttagacagacagtggtttttcttttcccatcttcttcctgacagtctacacccacatctctttacctctgctttcaaattatgagtgctggctggcatgttcattcatggctaatctaacttgtttttttgttttttgttttttgttttgagacagactctcactctgtcgcccaggctggagtacagtggcgtgatctcggctcactgcaacctctgcctcctgagttcaagcgattgtcatgcctcagcctccggagtaactggggttacaggcgtgcaccaccacacccagctaagttttgtatttttagttgagacggggttttgccatgttggccgagctagtcccgaactcctggcctcaagtgatccgcctgcctcagcctcccaaagtgctgggattataggcgtgagccaagggctcaacctaacttggtcttaagtgtgatttctgctatgcacacttctggcttcaccagccatggagtttggccgggatggtctactcatccgtaggctgcatgtctccctgcgcagccttcaatagaatgaactaatgggaaaggtttcactgctctcgcaacctttggttacatccaggagcagatctcagtttggtacaactgtgtctaacacctctctgatagctttttagtgaaagaaagaggacctttgttaggcaacagtatccagctagaatttaatcacattgttctgttttcattatatacagcttttcaggtaccttctattcaaggcaagtgatgatagcttcttgtgcaagggaatgaaagaaagtttccttctttaacacacttatttaatttttaaaagtgaagcaattaaataaaaacatcaaaatgttgaggtgatatgtaaaatttaagagggcatgataaaatagtatggggataggtaaaaattaggaagatagtgcttaaataattggcatttgggcaacactttaaacattgaaagcgagaaagcactttatgggtcattgtctgctggcctccacccctacctaccctatgtactagactgtttaggaaggctgaggccatgtgtcagtgagcttaccgttacatcctgggaactggtaggtgctcaataaagaaatgaaatgtaggtggatggatacatcatgtggctcagatcccttgttttgcaggtgagaaaactgaggtttaaaggaacaggtgacttggctgggagcactcagtcatttagtggcagtaggcaactgtggccccatctccagtactgagtcccgagcccctttcactagcacatgctgcctggtagagtatgaacagatagttaccaaatgctctacacagagaacatttaacccccagtcttaacaagtgccggtgattcatgagatattgacccatgtcctttattttacgagtgtgtctcttttaaactccaaaaatgtttttatgcttttatgagtgtcctgaactttacatgggtgctgctggagattaaatcctccatcagacccctccattcaatattttcagcagaattttatcactatgaattcaacatccccaccacaaaaaaaaaaaaaaaaaaaaaaaaattacacaacagggaccaaaaactgattactgaagaaaaaacttgggtttaatgagatcttatatattgcctttagagaaagaaatagtgttaactaattatttcttcattgacattcgtggggatcagctaaggccagtctccagactccacggtcacgggcatcactgctttaggattacacagtgattggtgtttaaattcctgctaaggcagccatccctttcccagacatccttgcacagaaggaagctccacacattgggcagggcagtaacgggaacatctgtgtcctctccacagatccaccgtgggcgccctgctggcatctgaggttagtaacctgtcctaatgccttccgagtgcttgtcccattgtgttctggtctccttgcatctctgccttttttctgctttgtacagacacttccacatggctttgaaccccactggagcaattttgtttttctccttggtgattacaaatagtgatgaataggcagggtgcggtggctcatgcctgtaatccccacactttgggaggtgggcagatcatgaggttaagagttcaagaccatcctggccaatatagtgaaaccccatctctactaaaaatacaaaaattagccgggcatggttgcacgcgcctactgtagtcccagctactcaggaggctgaggcaggggaatcacttgaacccgggaggtggaggttgcagtgagacaagattgcgccactgtactccagcctggtgacagagtgagactacatttcaaaaaaaaaaaaaaagtaatgaattaaaggaggctgtggtagcccagtcatgggggttgtgaaatggcatgacaaggtgcttccctcctgggggttgtccttggggttgatgggaaccaggcgggtggtattgtttctacacctgcctgttagtaatcccacaatgactatcacattggcccatctgcctgccacatacaccctttcactttgttcttaaagctgggatggaaattctatgatgctgatgattatcacccggaggaaaatcgaaggaagatgggaaaaggcataccgctcaatgaccaggtaacaattgctgtctgtgtccatcacacatattccacctgggtgacaggatgagctcgctacagcacttgctgtagtagagttcgtgagtcctaaggtcactgtacaggggctacaaagagccaggtgcccagtagatcctctacatatgttagctccagtcctgaacaactgtctgaacatggccccaggaacaatgccaccctctgccccagcctgaacaggctctgccaaaacaccttgttgtgggattttaacctgaagaatgtaattcctgagaggtcagaggctccctgtgcctcatacatggggaagtcctcatcttctcttcccaggtgctgtcagcctaccactatcaccgtactctagcattcaccctaaagccagagtgatctttgagaactcaaagctggccatgtttcttctgcctgtgaccctttagaggcttcccaccaacctcaggatcaagaccaaatacttacactgctaagcatgcatggcatggcctccacatggctccagcctctttaggagccatgcgcctccatatctccacaggagctccctggcctcttccagcccctcccactgcaatgcttctcccatggggcctttgtatccctgttcccttcttccctgagctagcccttctcatcctttgatctcagcacccatgctgcttcctcagggaagtgaaacctccatgatggactctcatggtgccatttcattgttgcacttgtccctgtggcagctcaacaactgatggtctgagaatttgattaatgtttgtctctgcaactagactttacccctaaaagggcagggactgtggctgtttctgttaaccattgtaccccccaggcctgacacacagtaaacatcagaaaatagttgtggcatgttttcgagtgaatgaatggatgaatagcactctcctgtgtgcaggccgtgaggccatcccctagagtgtctcacaccagagttacaaactcgctggcataactggccatagttcaggagagatgagggcaggtcaaaggctggggccacgcactaagtgtgtccaaagggcaagaacgaatggaactggccgcagaccaacactgttgttctcactttcagtggggctgggctcacccccaggtgtcctttccctagctcactgtctttttcttttttgtgccttgagccattaaaccattattaggtctattctagagcaccccaagagtgcacttctctttgttattgggggtacagcttgagtttgcagtgcttcaggccttgaatcatcacaggtttgcaacatttgattttagaagatagggcaatagaactataaaagagagtaataataatgagagtaataatagtataatagagtagtaataaaaaagagtagtaataatgttgatactaaactagagataataaacataggcaacctggttccaccaccaggcttgtatgagcttgacaaagggcttagtctctctgtgccccatttttctcctgtggggtaggaatggtaacaggatctatttgattggattcttggaagtattaaatgagataatacaaaaaatatgcacagaaaagtgcctgtagcattcaataaatatcacgttttaaaattattgctaaccatacgcatacaacataaatcatatatacatgccaataaccatttctaagggagtgtataaaatgtgactgtgccagtgttattttaggtttctctttggtgactgcaaataaaaggtaagttaaataacaaaataaagcaaccaaaattgatagattttaaaatggaatttctgtagtcttcctcttcttcacaagtgatgcttgttaagtggactctatggattggggggtagaattcagaagagaaatttatgtacaggagaaaagattactggaagagacacaagttacttactaaattttttcagaaaaaaaaactacaagctaggcagaccttagagataaccaaaacagagagataaggaggtagaacgacagatggtttacattctcaagaggtagaacgacagatgattttcattcttgataagaatccaacgagtctaagactgaagatatgggtcacagctgggctggcaccaatacagctcctggttgccccggtaaccggtccccaccctccccgcactgcccccatgctacagagctgaggaaagccccctgtgaatggattaaagcgtgtccgtgtccaagtcagaggccctggttctcccttgaggaagagtctagggaggacgtggggagagttttgtgttcggagggctcagagctgcagtctgtgtagaacatgttaagggctccctaaggctatttaaatgtaaattaggccaggctcagtggctcaagcctataatcccagcgccccaggagggagaggctgaagaccaggagcttgagacctgcctgggcaacatagcaagtccctgcctctacaaaaactgaaaaaaaaaaaaaaaaaaaggctggtggtgcatgcctgtagtcccagctactcgggaggctaaggtgggaggatggcctaagcccaggagttcgagggtacagtgagctgtgactgcactactgcactctagcctgggggacagagtgagaccctgtctgaaaaaaatatatacaaattaattaaaatagataaaatgtaaaatctagtccctgggttataccagccacatgtcaaaagctcagtagccatgagtggctactggctaccttactggacagcacagctatagaacatcattgcagaaagctgtgttggacagtgccagtctagaaacattctacccaagctgtgataaattattagcgttatgatgaaattaataataaagaatttcaaagccaccagtcagtgagtctcccctaggtgcccagcccacagtgtcctatctgagcctgcaggggcacctgaatagtcttcaacttcaaagtctattgtaaaaagagggctttttttgggaaaaaaaaaatcctgaaaaaaatctcctgattataattgtaatatttgccctgtatagaaaatttggaaagtactaaaaaattttttcacaaaatatatcacccttggtctcatcttccaaaaatatctatgaattgaattttggaattcttctttttcatggagggggtcagtatataacattctatatacttaacttttgcatcaggtaaaacacacccatctccccgccattcccactccccatcttccttcccgtctctctccacccatattctaccattatctgttctctctttacccatcatccccttccaaaagacatttaatttctcaagatgtttccataggccaagaaagctttctctagcctcatgacattctgatttcactcttcgtagagcattcattgtgctcacctccgagcactgggctgggagtcgggagtgcactgccttccccatctttgcgtgtagggactatctagagcaggggtgtccagtcgtttggcttccctgggccacactggaagaagaattgtcttgggccacacataaaatacactaacattaacgatagctgatgagcaaaaaaaaaaaaaaaaaaaaaaaaaatcacaaaaaaaatctcatgttttaaggaagtttacaaatttatgttgggccacattcaaagccgcagtagggtttgcgggctgtgtgttgtacaagcttgatctggagtgtgaaaaccttgaacatcagagccataggcagagatgctaatttggattgtctcatttctttcctctaaaacttctgtgtgtttgattttcataacttattatattgtccacagtaactgtctggaaggcatagagctcagtgaatttgctctaatatctccttcttccaatttcttcactgtagagagatctcaattcccccctttcttcattatgaacataaaatttggagctcatgtgtctaggtccttcctagcacctttacaataaggtccacactccttagcaggccagtcaaggtcttgaaattatctttatcttttaagatttactctttccaaggcctgatcaagattggcctgtcctccaggcgcagtggctcacgcctgtaatcccagcactttgggaggccgaggcgggcagatcacaaggtcaggagatcgagaccatcctggctaacacggtgaaatcccgtctctactaaaaatacacaaaattagccgggcgtggtggcaggcgcctgtagtcccagctactcgggaggctgaggcgggagaatggcgtgaacccaggaggtggagcttgcagtgagccaagatcacaccactgcactccagcctgggtgacagagcaagactacatctcaaaaataaaaaaataaaagaagattggcctgtcctcctgctgtgttatcatagcccttcttagtatatctcccacagccctcatcactgccctgcaggtgacttaatagattactcatttgcctcttctctttgaggacaggaaccacaccattcatatttatccccagtgctcactcagtatggtgctttgcaccacatttaatgtttgtggaattaaggcccagtgcctaccaaattcatgaatttaaactctttcaaaaattcagagttggaaataagtactgtttatttcaactgttaaatcaaccaaaaaatagtttattccttttcttatttaaatcccagagcagctcaatgaattatatacgatccccactttacaaatgaacaaagagaggtgcagagaaattaagtaacttgagcaaagccacacagcaaagggagtctttctaacttcaaagatcatacttctcctactgtgttaaaggccctgatcatccaaccattaaacaaatgattcacaagaagtgaatcaaggtttgttaaattgagagaaaagggttagacagagggtgagaatgacagcaggaatgagaggggcagttccccacaagcacatccatggtaggggttaggccttaaagatgtctgaggcactgacttaaagggtggtcatgacggcactgacatggtagcctggcttaaagcaggtcaggcactagaacttgaatttctacactggcgctgccttggaaaaaacctttctccttgtggctttatgggaatctccaaagaaaattcataatcatttaattatgattcactatttggaaatttcaggaataatgttcaaagtgctgctcttttatttccaaccctctctattgtttttatgactgatggacacagtccttactggtgcatggtcattaatctggtctgccataaattccgataaggtggatgtctaaaagcacctatttttgtttaaatagttttatatttatgtttattatggctttcatagttgagattctgaaaagctttattatgactagatgaagcagtgtgctttattattgactaaagcatccattaaggcactattaaaacaatgaaaaaacatgtattcaaagtaaagctctatttctttgtacacaagatagaaaacttattacccaaatatgttttctgtaatttttgtttgtttcattcttatgaaatatttcaggcacatagaaagtataatgaataagatagtcaacactcagcttaatgaaaagtatatttgtttcctaagccataaaataatacagagattgatctccatttccacagcacaagcaaatagaaatatttgtgcagatggaatggcggaatgtacaatctgagcaaaatagcaaaatgcaagtttgtgcctctgctaataagaaagaaattctggtatttaaacaaattgtcctctctctttggttcaccccaaactcattatgaacatttactcgtgccaaaaagaaattaatttttttctgtgtatttcatctctgagtcagtcctaattcatagttcgaattgccccttaactctaagtagatatgtgatcatgtaaattagcattcagccctcagaactttccaatcacttcctcttctaaagcattcttcttgctgaatggagattcgcagcccacggcactagtcttaaataaagccttaaaagtcccatccagagacttctacaatgacaaggggtgcaccttggaaaaggctggttgactacccagctgggactccagggctggctctctgtcttgcaggcccagcccccttgatattgtcaacacactgaacatggattcatctgtcatgtgagacccctaccaatcaggtttacaagttcctgcataaaccaaaatgccagttgatcaatgtaccaaaagaaatacaactgtcacgtggcctgtaacaatcacattagtacccacattttcagaaaccaacatacagaggtttcttagtgaacatgggagagttaggaccaaagaatctggtggcgcgagaccatgcattagtaggaaaaggcttgctaatgagaatacgatgttcaaaggccaatggccaaggcaccatgtccgctggacagtgcttcacatttcaatctacagtgccctgctctggccttcttgcctacccagcctgcctgggacagacatgcttcctctaggtatgtgaaaatattaagatggatcacagtgatgccttgctagcctgggagtcattctaactccttcgcatgaccttacacatcgctgccccttccttttaactgttgatctttaaatttaacccttagagaacaatcttatttccttcttttccaagtccttaggaaagcacctcgctgtggtcctcattttctcaaagataaatcctttgactcatagctttgtagaagttgacataatttctatgatttgaaggcagatgcctccattttcatgtaaaacatactctggggttagaaatcagtcccctaaatgcttattctacgcgggccagtacatgccacatttttataggactgaatcccagagtgggaagtagaacctcctgctaatgtgggaggcttcaaggcccagtgccttctttcattacaactgtctgttagaggagctgttttagaaaatatatccaagagggtttttttataaaaagctgacatatagcagtattatctttttcatctccattagcctgtgaatgtagtagaaaagcttggctaattacaaggggaataagagaaagaaaggaatttagaaagatgagttcaaatggtaccttaggaattactcaaacttagaatgatcatatctagggtattggaccaaaagcacctacaacagtggctgggtctccctacacacacaatcagcacttataaatggataaaggaaagtggaaatccaaatttgtgcttgaaagggcagcttctccccaggggcaattttccatcaaaaaatacttcagaggtcagtcaatccagctaattgtccctgtagcctataatccttgacatccttcttccccattccccaccataagcccagaaaacactgaattgcaatggtagtttcaagttgcataaatgtagactgcccaactttttttctcttcacagagtgtccagaacatctagttttttagtaggatgtcctagaaaaccttgccaataataagcattaaatatatacactcttctccaagagcacataaagtctcctcatatattctaacattaataactttattttgtgttttattaaccacaaaagaaagacattttctgacacacacaaagacagaagggcagactgtcaacttctcagtctaatggagaaatttcaaaaacctttcttgaaaatttatacagcaagcagacaaaagaaattatgagtaaggatacagaagatttgaataaatgcattaagtctgacataggcattaatgaaaagtaaataaccatattattttcaagtatatgtgggacatttataaaaattgaccatgtggtctgcaaatatggagctggtaagcctcatcatcttgttactgcatttacaaaaaaccacacttgtttcactacatacacctcccagacaagtgctaacataaacagatgtttcatttgttaagtacatttcagctctaagtacatacatgacagtaactgttgtgatttgagtaatgatttatgttaattatgtagctattgacatttagattataatttgtgtaaactgtgtgactgtcatcatttgatctgtacattttgtgatttttgtagctattacatttgaactcctaagtgatctctggttaaatagtgtgtgcatggaagtaaagtcttaagagttctatgattagtaaacttacgggaccctcaatcctacattagcacgcagtgctttaaaaataatcttgtatttgatatgaagaaaaagaaatattatttctaattctcctcttccttctatggagagtggatccaggtaactagagggtttttgacttgctgagcacaaagtgatagccttggtagaatgaccttgcacttactgaagataaattactgtgaataagaaatggcctgagcccaggggagatacccaggagctaaaggtggttacccagagctggagagcttaaaaggctcctcatggaaaagatcaaaggaaaataaaaatggccaaagtccaaagcaaaacgagaacatctcatgtgccaaaatcaaagtgtggcaaggctgaactaaaccagaataacccactcccccacattttttgactgtataaaagccaggagagcaggaggctgaggttttgatgagcctatagagatgggagataagattgtaagcctgtatgaagcatggagctggacctgagtatcttacataaagtcttgttgttgttgttagcattgatgtcaagttgtagaatataaagtcctcatataagggctgtctttgaatgaggactaaaaatattgccacccactgaactcaaaaggagcaaaaaatctagctgcctccctgggccacaggtgggaaaaaacaatcatccttgagaaacctgagctccggctacacccaaattcacactatatgacaaagaggcaccaagcttataaactgacataaaactgttctagaattggtgaaactgcccgtgaaagtgtttccaaaacttaggactcccacaaaggaaaaaaaaaaatcctttgctgaagatgaaactacaatcagaaactataaactatatgggaaaatggaccactatgagagagaatcagcaaaaacactaatggtaagatgttgttctccaagaactagacataatagaatcaaatggaagacaagaataggaaaatttgaaaaagaatgaaataaaaatattagaaataaaacaatcaatagatggattaaacaataaactagtacagctgaagagagaactagtgaattagaagaaaagcagattggaggatattacccaggatgaagaagagagctaaacagaaaatattcaagaaaaatgaatagatgtgtatgataaaatgtcaaacttcctggatagctacaaggaacccaagtaaatagaataggagaaaggctatattcaaataggtagtaacaacttttccagggtatgagtactcacactgaatatgcaaaataagtcctgagcagggcaagaataaaactgcaaagccgctcaaagacaaagaggctttttcctacataaagctaccagagataagatatattttctaaaggattgactaatacactaaaagagacttctcaacaataaaggcccaaacaaaatgaaataattattcaaactattgaaaaataatggtcaaccaagaattcttcaccaactaaaaaaatcttattcacaagtaagcacaaaataaagacattttctaacatacacaaagacagaagggtggactgtcaacttctcagtctaatggaatttcaaataacttgaaaaattgatacataaagtagacaaaagaaattattagtaagaatatagaagatttgaataaatgcatcaagcctgacataggcattaatgaaaaataatattctttttaagtacatgtgggacatttataaaaattgacatgtactagaccacaaagagtattgccacaaatttcaaagaatcagtatcataccactcacattttttactataatgaactgtaaatcaataataaaaatgcacacacatcaccaaaatggttgggaactctaaaaataaataagcaaattttttaaaaaattaacattcatataaataatttatgttaaaagtcacaatggaaattacagaatattaagtaatatacaacaaaagtactatcaattaaaatttgtgggatgcagttacaacattacttagagggaaactagcctctaaatacatttttgggaaataacaagaatgaaaagtaacgagctagttgctcagttcaagtagaaaaaaataaatgcaggaaataacagaaatgaatgctagtgaaaacaaactgggcacatgttctcaggatctcctgagggctgtgtcatgggaaaaaataaactatgaacaaaagctagttgtttgacaaaataaaaatagatctctggtgagactcatcaagaagaaagcagcacaattgagatgaataatgaaaagagggaggtggaaaacctgatgccagtaaatttgaagacttagacaaaactggataatttcagtgaaaaatatcaagactggggaaaatggggttggatggcagtgatctagtggcagatactgcttagggacacctgctttttccccagtgaaattgtgactattctggtgctgcatttggcttaagcagcagaaggtccagagagctgtataatttatagtaagggcatggattgtttatgttactcctttgaagtaatgacaaaggtgataaaaagtgactatcttgtacagcaagtgtaacctacagatacgaactgtgttcaaggttctggaggcctggaagctgggctgaaatgagctgaatctgctcctgctgtgtggctgcctggcttccaccaagttcctgattctttagccaagtaagaggatgcagtaagagatgggaagggcagggatggtggctcacctgtctaagtgtggtctcttcctgccatcataaatgttgtagctaccaaaagtgaatcaggaatagaaaacctgaatacaatacaatgctcattaaagaaattgaatctgtaatgaaagatctcccctcaaaaaaggccccaggcccagaaggtttttcagatgagttttatcaaacataatatattatatacaagctgtttgaaagaacaggacaaaagggaaaactatcctactcattttataaagctagtaaagccctgataccgacatttaatatggaccatatttttaaaatataggcccatctcaagtatataaaatcaaaaattctaaataaaacggtagtaatcaaatgcctaaaagcaaggacttttaaaaacacatcatgtttctggaatcagcttcaaaataacctaggatgggattatttgggatgtgggatgtggttgggggcatacgtataacaagactaatagtgggttgaaaatagctgaagccagccgggtgcggtggctcacacctgtaatcccagaactttgggaggccaaggcaggcggatcacctgaggtcaggagttcgagaccagcctgaccaacatggagaaaccccatctctactaaaaatacaaaattaattagtcgggcatggtggtgcatgcctgtaatcccagctactcaggaggctgaggcaggagaatcgcttgaacccagaaggcagaggttgcggtgagccgagatcgtgccattgcactccagcctgggcaacaagagtgaaactccatctcaaaagaaaattgctgaagctgggtattggtatacagaggtttgctttgtactattttgtctgcttttcagtgtgtttaaatttttcaataatagaaagttttttttgttttgttttccaatgcattatggccaataatcaggatttgcgccaggaaggagagaatttacttgtctcaggaggatttctttgtgaaacactgtagcacgtgctacgtaaatttcatctgtcttctctttggcaaaaatataaatttcttaaaataattttatctgaggggaattttgttctttggagggtttgaagaataggaccaggggacagctgacgtaagggtttatgtgaatatctctctacatttgagatcagagatacctaaagaatacaggcagtacaataaaagatttgtaaacgtatcagaaccagggaggacacgtgtaaaatggggagattaatatggggagatacatactggtactttagggcaatttttattattatgaaaagagccactgacaccagctgaaagaaaatgtttctgcccagcagctggcccctcagccttgtgcatggcccactcctcacaccactgagctctcgctggaccttaacatttgtgaacatgatataactgtttctctacaaacaaacaatacctggagaagtcacgttgtgtctgggtttttgtttttgtttttttcaggaccggattccatggctctgtaacttgcatgacattttactaaggtaagagaccaccaggccttggcataagccaaagccagcaggtaaagaaaaccctcagaaaagacagggaaaaaaaatacactcctgaaatcacaactgactgatggtaaaggattctagaaactggctgcacttctatcaggtaaccacaatgatttcaaccagccacaggcagcatggagtttagtcgggctctggagacaaaccttctagacagctccacacagttactagctagcagtcttgatcagctacttggtttccataagtctgtttcttcatcagtaaaatgggaattaatatagttcctactcacagatttttgtaaggaataagtgagttggtgagtgggcaacagaacaatatctgatacatagtaagtgctcaaaaagtgtccactgatgccacttctgttattgcctatctcagtcaatttttcttccctttacttcaagctgtgactaccaggaaggcctgaggtcatttgtgagtgaacaggtaattagccaccaggattagagtccacattgcccagctctgcagcatgcccctgagcgaacagggtccccccccaacagcacccatgaccccagtggaaatcctggtcgggacgtggagaaggataaggaaaaggcagggagtgggttacggatcttgctttctaagatgaagtcatattttatccatctaaaaccatctaggccatacgaagttataatatacttaaatgaacataaattcagtttgcttttttcacacccgttgacatggctggcagccctgtctttgcatgggctgagttttgatttaggggtttatggttctgggtttcaaggtttgaaaatttttgcctacctgggtttctaatataatatactcatgagagtctatttttacagtactatcatttcatagtcataaaaaggagtatggcttcatttttatatttgctagccatgtattggctgcaaaaaaaaaaaaaaagcaggggaggccccttccttcagaactttcattctgaagagaactttatactggatccccaagccagccccaagccagaatttatgcaccacctcttaactctagaatcctgtcctgaccccaggatgactgcctcccacactcagcagccaagtggaagctgtggctcactctcctgtgtggtctctggccgcactggtttccccttattgctgctgtgtctgcctctgtttctggctggagttttttccttagtgcatccctaggaacctctcatatgctgctcaccttgcccacagagaggctgatgctcccttctctcccgctttctccagctctgcattgcacctggcaactcccccagacactgtagagtaggaatggggagaatccagttgtagaatgcagatccctgaacatcctgcagaggacctgagcttggctgtttgcatggcacaggggcatgccggcagccctgtgtccacacactgcgacagagcaacgtctgacatccatcaaagcagaactaacacttactgagcatatctgtgtatcagagatctcaaacagtgttttccttttgacagatctatgggcaagtaccctaggtagccccacttaacagatgatgaactgacgctcagagaggtaaatgccttggcccaagattgttcactttactagcagaagatatttaactcgatgctaggactgcctgatgcttaaacaccattttctaatgccttccactggcaggaagtaggactagagtcctgcaactagaattgacagaggttactttaaatgtcctccttctttagcctccctcttttttttttctttttctaaacagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccctaaaaatgaaatgacaatgattttgtatcagtggtccaaacagaactaagcataaatcattgtgccatcccaaacctcgttccagccgccttgcccatactagattctaaatgtttctaaaggcaaaccccaatgtgtcaagacagacttgtttaggtgtaattttaggaattatgctggttcatcaggaagcagagggggagttttaaaagtcaagcttaaattgaagtttaaattcatctataaccaaatcaaatgatcagaggaaattctgtaatcaatgctggaaatcgttacattgtttagaacattcttgctcatgcctgtatttgcacaaataaatgaaacttcgctgtccttggcattccctggaaattgatgttgggagtataaacatgtacataatctacccaccacccagcacaccacacacctcctaatcctctctctgtcctggagctgtggttcagaatagtggctcttaagctaaggtctcaaaaggtagtcattgcagaacaagcaaactttgttcagttccttaaatggcataatgcaaacatacttaccagtagcaataccaagcttcttgccttttgcctaaaattatgtcaactcaaactgtctctgctgatcaccagctctgtgctgagtggttgtgtgttatgtatctgtgtgtaatttaaacgtagaaacttaactgctacttaaaaagcagagtttgggcccagcgtggtagctcacgcctgtaatcccagcactttgggaggctgaggcgggtggatcacttgaggtcagtagttcaagaccagcctgcccaacattgcgaaaccccctctctactaaaaataaaaaaaaaaattagccgggcgtggtagcagatgcctgtaatcccatttactccagaggctgaggtaggaaaattgcttgaactcaggaggcagaggttgcagtgagccaagattgtgccactgcactccagcctgggtgacacagtgagactccatttcaatttttaaaatattagagtttggtcgacaaaatttgattttttttttcttttttagagacgaggtcttgctctgtcacccaggctggagtgcagtggcatgatcatagcccactgcagctttgaactcctgggctcaagtgatcctcccacctcagcctcccaagtagctaggactacaggcatgtaccaccacgcccagctaattaaaaaaaaaaatttaagatatagtgtgttgctatgttgcctaggctggtctcaaactcctgacctcaagtgatcctcccacctcagcctcccaagttgctgtgatttgaagcatgagacacagtacccagctcaacaaaatttgatacgataacaaaaagcatcattttggtggaataaagattgaaaacaattattttagcggaaaaaaaaacattgcttttcaagtaggggagctgtcctcatagatcatttgagaaggccctactccaccctgtgaatttgcagatatcagaactggagacagatctcagcagttagtcctaagtgtgtggcagcgctgctgggaatatacaaggcatgtgatttcagatgtcagtgatttcaggtgtggctttaaataatacgacacgtgatcagaagggatcccccttatatttctgtcgctctgcctgtctgtgacatggggagtgtctgtttcgtatgagtatcttcacccctttccagcacttgtcaagcttccttttcaacaaagagagcagccgcaggctcagacccctggcagacacacggtctccccacaatttaatcacttttatctggttcttgtttctgtttttactgtccttctgtgtaaggtaagcatccattttccattgaaagtagtgacattacagtttttgaaagcagaacatttttatataaattgggtcatttcaagataaataaaaagtacatgatccattacaaaattgccaaggtggaactcaggcgaatgaagtgagagactcgctgacccagtatatccctcattctacaaagaggaaccagaggtctctaaaagacctccgtgagcctaagctgatgtccacctgcttgctgtcctgtgtaaaagtcatcagcaatggaccctaggcaggtgaagaaaaagcactagagctgctatggccaagacatgaaatgaaactttccagtgggcagtgatgtgtcactagcaccgcggcagcagcgctgggggatgcagagcaggaggggagaagtaccagtgccctcctggcatgcagcttacctgggcaccagctgtgcaggccaaaatctgaccaacatgggccaggtttgagcccttccccgtactccaggaagatgctttatccttctgtcccaaccagggccacaggacctggccaccctgtgggcccactggttagctctggccagagattgagttttagaaccaatttacctgtttctattcaccagcatatgtcatacttgactcaagaactacagccaggtgcagtggcttgtgcctgtaaccccagtgaccctggaggccaagagagaggatcacttgagcccaggagtttgaggccaggttgggcaacatagcgagatcccgtctgtgaaaaaaataaactagccaggcatggtggaatgcacatgtagtcccagctactcagggggcactgaggttggaggattgcttgagccaagaagtttgctatgactgcatcactgtactcctgcgtgggcaatggagagatcccatcacgaaagaaaagaaagaagggaagggaagggggaagagggaaaggaagaggggaggggaggagggagggaagggggaagaagggaaagaagaggggaggggagagggaagggggaaagggaagggaagagggagggagggagggagggagggaaggaaggaaggaaggaaggaaggaaggaaggaaggaaggaaggaaggaaggaaggaaggaaatcacatgccagtggaataaaagggctgtattggtggatggtccttgcctaagaaaacgtggagcccttgatttttctctttgccaagatatttggagtagcttctggctggctttggtttacatcaaccctcatatttgggggccaggcacttgaagttgtcaaattaacacatcccagctgggtaagtccccctgccgtgtggagggagaaatcaaccaatccattgtacttagtagtgagtccagactgtatgtgacaggcaccatggagggtttgaggcttgtgacacaaagccctggctgtcaggtggttccagttggggtgaaagataaggcatcgcgtattctctggcaccagctagagtcctgggacagaaaggacgcaacaaggcccttgaccatggggacttagaactgctgagaagcatccattctggctggatcgtgcccctgtcccagctctctccccataatgaatgccaaagcacattccttgactaaagacccccacagctgctccacagctggactagcctttggcctcccctttgtcatggtgacaggaaacaggaaaaattgaggaaggcagtgattctcaacctcgactgcttgttaagagtcacctggggaactgaaaagcacagacctgttcctgcttcctccaagcccactgaagcagtgtctgtcatgaggggccctggtctcacctctgaaagctccacaactgactctggtgagcagccaggggtgggagcctcagggtaaggtctgacaaccaggaccccatttggatcccctgctcatgctgagcccacttagatggcagcagctgggggaatcttgacgaaggtgaagtttaggactggattagttctcgccaaagacccactggacaactcacgaaaggccagggatgaagtgcagtctctaaagtggtgctttgggctggtgataggctggggagcacctaacccccaagtgtgtaaagcggctgatttggcagggatcgcaggtagcaggtagaagggaccaaagagatgggtgtgcctctcaagtgtttctcttggtgtaacagcagggaatagtcaatgaggcattcagacgaagtgaacacacagagagataagggaaaaggtgtccagaatagaagaatccacagagacagacggatgggttgcctgggatggggaaggcgggacttgggactggctaacaggtacacagtttcttttgcgggtgatggacatattctggagttacacaatagtagtgatgtttgcatagcacagtaaaatacactaaatccactgatgcgcactttcaaatgaattttatggtgtacaaatttttatctgccattttttgatactggcaattttttatctcaataaaaaaaaatcaatgcagttaatgcaccactgtgaggagggccgcaaccccagcacaggcgcctccccaccatcacacttggagaaagtctatgagctggagagtaggtctgcgtccagctcccatgcacttgacacctaacaatgagtgctgggtttgaagagagttttcttttttccttttttgagacagagtctcactctgttgcccaggctggagtacagtggcccaatctcatctcactgcaacctccgcctcccaggttcaagcgattctcctgcctcagcctcccgagtagctggtacatgccgccacgcccggctagtttttgtatttttagtagcaatggggtttccccatgttggccaggctggtctcaaactcccgacctcaagtgatctgcccgcctcagcctcccaaagtgctgggattacaggcgtgagccattgtgcctggcccccattttattttttaactttaccaagaattgtttaccattttagaaaatcacgatgtgtttgtcaccgacacaacatacccacatgcacttgcattctttcaggggtgaccccacaatgggcacaagcacataatgactccatcgttttcatttagtgtagtcgtgctcaagcagtacacactgaaagtttattcgtactttttttttttttttgagacagagtctcgctctgtcacccaggctggagtgcagtggctcgatctcggctcactgcaagctccgcctcccaggttcacgccattctcctgcctcagcctctccgagtagctgggactacaggcgcccgccaccatgcccggctaattttttgtatttttagtagagacggggtttcaccgtggtctcgatctcctgacctcgtgatccgcccgcctcggcctcccaaagtgctgggattacaagcgtgagccaccaggcccggcccttattcgtactttcatgtgtcctttacattagagctaaggcattatgtttattaattgcttaggtacgttttgttagcaatctcattttgtgatagtaaaggggcattggaaaatagttgttaaaaagcaggtgttgaaaaggagtctggtgggttgagagcactgttctaatcttcccaaacatggtcccggggagaccgaggtgtggaccggtactgccctctggtggccggggtgggagagacccagcaagcacaaagaacccagggaagaagggccagatggtttgcagtggctcaaaatggatggagataaaagattcaccttctcctctgggaggattctccacccgcccccaccccaccccacccccgcccaagtctccattcccaccaccagaaaaatttcagattaaacatttttctctcctgtaaaatgagggtatcacctgcctcgtaagaatgaagtcttttggctctgatagcttagctccccaccgagtctctgtctttccacacccctttccccagcccttgggcaggttacatcaggcagagcctaggatgaggtccctgaagcatgggatgacccagcaatcagctgagcagccggctctggaatcaggacccagaaaaacatgggctcaaggcatagcactggcgtaaactagctgggtgacacagataaggcagccctaggggatgtcactagatgctgccaaggtccagtgctcacatcctgtgcctctctagagtctgctctgataagcaaactatttttcagtggacagagtacaagaaccaggaggaaactataacaagctgactttaatcaaagacaccatccaccagggattttaattttctgaaactgtaatatgcaagtttattatcccttcactgaacagcacatctgttcagaatatatctgatcaaagatatattcaagatcagggtattaactgtatcatgggccagcaattaccacggaattaggatctgattaggcattcagccaataagctgtgttgagcatcagtgtgtggagttgtttcagcccagcttcacagaatctcatgtgtgaaatgtgagctggtgctgatttcctgatgatcatcattccctccagcagagtttccccccagcaacctaccctggatgctgtgcaaattgaagtccactttgtgggaggttgaagtcactggtcatcacttaggaggaccccagacctgatgttgagtatctaacacataccttaatcagggacccaatcagatggtgcctaaggaaatgccctcaacccatgacagtccatggcaagacttgcaaatttgatggccaaagaatgtgaccaacactagtgggatatgggagactgaagactgtgacaaaattaaaaatgcacacactatctgaatagggcaacaactatgcagctccagaccagataacacaggaacacaatctgccctgaacaagttgggttgactgctcactgtataaggaagaacacacacctccaaaaactgcgcgaaagactcagtaagatgtcagaaaggatttaaggtttggttgcatgataggtagtcctgagtagggttcaaggaagcagggctctctaaatggatgctgtcagaaagtgggggataactggttatcttaagaaaatatgccgggtgcggtggttcacgcctgtaatcccagcactttgggaggccaaggcgggcggatcacaaggttgagagatagagaccatcctggccaacatgctgaaaccccatctctactaaaaatacaaaaattagctgggcatggtgacgggtgcctgtaatcccaggtgctcgcgaggctgaggcaggagaattgcttgaacctgggaggcggaggttgcagtgagccaagattgtgccactgcactccagcctggtgacagagagagactccgtctcaaaaaaaaaaaaaaaaaaaagtaaagtgtgaagaaggaagtgaagctaaagctataactggttaagaagcacattaacaaggacagggagatgtctggtcatttttgcatcttggaaaatgctcatgtttttcggtgttgacatgactaaagaaatgttcctttgtcttgacccaccacggctgaaaagcagtcttgttctgatgtaggtgtcctgtgaaattgtgtatgcttagcaggacatgaaggcctagcttttaacaccaggccagcatctggatgacaggaactacatttttcttactgtcagatatcattgtcactgtcactaagatcttttaggcctcaatttgaaagtttgggacacattatctttagaatcaccaggagttcagatgggaggatttaacttcccttctcaaaaaaattagaatttggtaggtttcccacccaagggccaggttgtagtagctgacctctaccccgaggccagatggttgagtgacatggactagtggactaatgtcccagtacatataccacttccccttccatcacttggcctcttgtggttaacctatgtggaactgaagaccttgagaagttatcccatctcacccaactccagccaacatatttgtccaagaagtacccaagggcctatgtaaaaatgtctgtccctgctttagggtgtattagtacttcattcctttttgttgctgaataatattccactgcatggatataccacattttaagaaatggattcaccagttcatggatatttgggttgtttccacatttttgatattaagaataatgctgccataaacattcattcgtgtacacgttttttgtggggacatattgttttcacttttcttgggtatatacataccagtgaaattgctgggtcaaatgctaactatgcagttaaatcttttgagaaactgctgaattgttttccaagtagctgccccattttacattcccaccagcaatgtaagaagcttccaatttctccacattcaccaacacttgttattggtctgtcttcatgattacagccatcccagtgagtgtgaagtggtatcttcttaagattttgatttgcatttccctagtgatgaagagcatcttttcacatgcttattggtgatctgttcatcttccctggagacatgtctattcaaattctttttatttttaaaagtgtctcttcactgttgagttgtaaaagttctttatcagatatattacttgcaaatgttatcttacgttctgtgaattggattgtctttgtactttcttcatcatttcctttgaagcaaaaaaccctaaagtttgatgaagtccaatttacctatttctcattggttggttgtgcttttggtgtcctacctaaaaaaccactgccttacccaaggtcacaaagatttacacctatgttttcttctaagagttttttgctttaactcatgtcttggctccattctgagttacttttcgaataagaatatgcattttaacaaggtcccaggtgatctgtatgcacaactgaagctgaaaaccactgcctaagtcacaccctggcagcacattacaatcactttaagagcttttaaaatgtatgcatgagcctcacccagatacaattccacttagtctgaggtggccttattttttaatcattttagctgattctaatgtgaagcaagggttgagaattaccacctctttgctgattaacattttttgtagccctcaactaattcttcaatttcatgaggatgtacacaaagttatcacttgcctcactgtctaatcaatattttccatctttaacttatttaacaaatgatgtctttaacatcatttatacattctttccatatggatttcacccacatgcttttattaggctggtttgtacccactgcttatatgtgatactgagacttctaacagtgctacattaaaattgggatcagcattcacagtgcacacggtacaagagtatgaaggaggcttagtgtctgcggatatgatacaaatcacaccttcattaagactagagaatggaagtcatactgggtgatagtgtatgagggtggagaagacatagaaatgagaagaggaagtaaagaacttcaacaatttcctgggaaaaccaaagatctcagttggtcaagagcatgctctacaatcagcaacattttagtatctagtatcatgttatctttaagccataatttgtccttggtctttctaggttttgtttttattattttcttgaaggagaagggtgggaatgggtaaaacattctggtcttccttttgcaaatctagaaccacaaaaccaattacaaattgcgactcttgctataaacaaaaataactccaatttatcagtgacctaaatagaagagctaaaaccaaaaaactcttagaagaaaatatagggggaagcaatgtattctttgtttttttgggtgggggagcgggggacagagtttcgctattgtcacccaggctggagtgcagtggtgcgatcttgactcactgcaacctctgcctcccgggttcaaacaattctcctgcctcagcctcccaagtagctgggattacaggcatgcaccaccaggcccagctaattttgtatttttagtagaaacaggatttcactatgttagccaggctggtctcaaactctgacctcaggtgatccacccgcctcagcctccaattttgtatttttagtagaaacagggtttcattatgtgggccaggctggtctcaaactctgacctcaggtgatccacccacctcagcctcccaaagtgctgggattacaggtgtgagccacagcgcccagcctagcaatgtattcttagctgcaacaccaaaagcacaagcaacaaaagaaaaatagaaaaagacttcatttctccaaaggtatgcaaatggccaacaacatatgaaagatgctcatcatcattaagtcattatgggaatgcaaatcaaaaccacaatgaggcctggtgctgctcacacctataatcccagcactttcggaggccaagggaggcagatcacc

SEQ ID NO: 497 - DNA, 79296 bp, Homo sapiens
acactaggctccctttgttctggccaccagggaaccctgggaggacatggaggaaaagagagaggaggtgtttcttctcttggctccctcctaggccacatcccacctggctatgtctctgtacctaggatcactgatcctgtcagggtgacccttttcatacctttatctccttctcgattccagaagccatgcctcccccttgtccccctttgggctcagtagtactaaccacttggttgttaccagcctgtgggaatgcctttatctgaggctgtcacaagcaatcttttgtaaacatacccttccgagttctgctgttttgagtatgcttgttactgttgtgactccgatttatttatttattttttatgttatttcattttttgagaccgagtctcactctgtcacccaggctggagtgtggtggtgccatcttggctcactgcaacttctgcctcccaggttcaagcgattctgcctacctcagcctcctgagtagctgggattacaggtgtgcatcaccatgcccggttatttttttttttttttttgagacggagttttgctcttgttgcccaggctggaatgcaatggcgctatctgatcttggctcactgcaacttccacctcctgggttcaagccattctcctgccttagcctcccgaatagctgggattagaggcatgcgccaccaagcccagctaattttgtatttttagtagagatggggtttctccatgttggtcaggctggtcttgaactaccgacctcaggtgatcctcccacctcggcctcccaaagttctgggattacaggcatgagccaccgcaccttgcctattttttttttttgtatttttagtagagatggggtttcaccatgttggccagactggtttcgagctcctgacctcaagtgatccacctgccctggcctcccaaagtgctaggattacaggcgtgagccacctcgcccagctgtgaccctgatttatgatacacagtgccccttccttgtctccaggcttgtaagtagtaaagggcctagggccctgtatccctttcccattctccagaagcctgctatagccactccaggctatctcagccatcactcctttccagtattccctggccaaatgtgtaggccagtaaccagctgcctcctgtactacttccctgaccagaggaggcctcctactaatttctaaggacctggactgtgaagctggctgtggaatggaccatgggctttcttagcattaaggaatctgaatgtgaaggtagttgtcagcaaaactcaaggcttacttcctgggttctagaggctctttgcctgtagctacccaccccggctaggcccttaccctttgtccatctagaaggggcagtgagcaatatggttcagtttggcactcactcttttccaccctgtctgtaggggaaagatctgacatctcagagaagaaaggtaaagcctgtcccagggataggtgtcagtacagccatggaagggctgggatgatgcttttgggttctgggagaggcaagaactggtctagtcacccccgctgccttcaggtctgccttgtacctgacatcgctgcaggaacactgctggaggctggggcttggctgcaaggtggtattctctagcactttcactcttgaattggcttctgtagtgcccatagaagccattgttgtgctataacaagacaggaatgaggataaaactcactcaaatctccaccatggatcctagacctcagggccccaactgagggttccaggaaagccagaccagaagcccctcatggaagttcctgacagaatagaaagaatctaaggagttaggacactcctggagatgggccagtatagaagtgtcttcatccatcattgggacagttgacctcagctgtaatgacccacctgggctatgcatgtgtagggaaggagtgccattcatttagagcagagatttgtgggcagggccactgatcaggggtgtggtccttccctaaagagcctgagaagaaatcccctttgttgttctctccacaattttttttttttttttgagacagagtcttgctctttcacccaggctggagtacagtggcacaacctcagctcactgcaacctccgcctcccgggttcaagtcattctcctgcctcagcctcccaagtacctgagactacaggcgcccactatcatgccaggctgaattttttttttttttttttttttttgagacggagtcttgctctgtctgcaggctggagtgcagtggtgcgatcttggttcactgcaacctctgcctcccgggttcaatcaattctcctgcttcagcctcccgagtatctgggattacaggcgcccgccaccacacccggctaatttttgtatttttagtagaaacagggtttcaccatgttggccaggctggtctcgaactcctgacctcgtgatctgcccaccttggcctcccaaagtgctgggattacaggcgtgagccactgcgcctggcctggagagaatttcagagagaggaactgtcaggagacagaaataagcaactatcagaggtccaagaaaggggctgtactgtgctgatgtcattacgtgtacactctgtggatgatcatgtctgggaactcctatggcccaacctctttgtcctgagttctccctggagacgatgggtgtgtctggccctccacaattataacactgagcagaagaacccatcctaagcctgccctctggccatcacaatgggctatttaacaggactagaaagcctcatatctttccatcccactgaagacgtggatcactttgtctgtctatccttctctgtcaggaacccctcactctctattcaggttagctcaacagtatttatcagacctttattgtcttccaggcgtggggctgagcatgggaaatacagatggacaaaaacacaatctttgccctcaaaatgttcccagactagagagcagccaaactccaaaagcttgggaggctcaaacaattaactaggaataaatggggtggctagaggactaggaatttccactggctttcaggagaccatgatgcatggaagggggcaaagtgttaggaagactaggcagcctccaggggtgacctcaagatggtggagaggaagtgggcggctcagggtcctattccaggttggatgccaaatgaaaaccttttcacttcaccggcatgactcagtcagatttcaggtacaaccagagggccaggggccaggattaacataaagtgcactcttacccaggagcctactaaagcactttgcatctttccaagaagggagcagaaaaggcaaactttcctcttgtcttttggagggtatcttcaggaaagagaatctctggaggtcaattttttgttgcttagtgacaagggaaggttgtgactgcacaatgctgctgctgtttgttgagacagtacatgacctgttgcccctttgtccttgctgccctagttcttctctgtgagaaaaacctgccccttggcattaacagcctgaagagcccttatatatagaaacacacagggctccatggtagagtctaatggattcgcagccaatgaaatattcaaagaacattttaaatgcaggcaaatcctgcatttaaaaacctatgcatccatactgccaggaatataaatttagaaagcatttcatggagtcagaagaaatgttaaagaggttggtggcttttaggataaaattactgcttcagaataggctctaacaatttatctcttaggagtttgtggtgaccaggaatgctaatcatgacaggtgaaatgttacaagggccaagtaaaggaatagggcataacagaacagaagaaggaacatgcaaagatttgacattatggttccattctgagctaccctttgacaaatttttgactgaattctctcttatttgtaaaagagggacttgaacagttcaccccctttaacaaccaaaagaaattgacaatcagcctctaaacatgtgccagtaaaacacccaagaccctgctagtgtcaatggcacaagccctaatatccagaatgtctgccccagtgtagtcaccctggagagcccctctcatgcgaactcacaggtattaaaaggttcattggcctgggcttggtggttcacaactgtaatcctagcagtttgggaggccgaggtgggcaaatcgcttgagcccaggagttccagaccagtctgggcaaaatggctaacctggtctctacaaaaaatacaaaaatcagctgggtgtggtggcatatacctgtagttccagctatttgggggactgaagtgggaggattgcctgagcctgaggagattgaggctgaagtgagctataatcacatcactgcactccagcctgggtgacagaatgagaccccatctcaataaatgaatgaatgaatgaatgaatgaatattcactgtagcatctatacaaaggaaaaactgtaagcaacccaagtgttgaccaacgggacaataagaaaattgggctatagtcacacaatgaaattactagcgttactataaatgggctacagatattagaatccacagaggtaaatcttaaaaatgttggccaggtgcggtcactcacgtctgtaatcccagcactttgggaggttgaagtgggcagaatgtttgagctcaggagtttgagaccagcctaggcaacatggtgaaactctgtctctaccaaatatacaaaaaattaactgggtgtggtggcacacgcctgcggtcccagctacttgggaggctgaggagggaggatcacttgagcccgggaagtggagactgcagtaaatggagattgcaccactgtactccagcctgggtgacagaatgagacccccatctcaaaaacaaaagaaaacaaaacaaaaaccgtaaagatgttgagttggccgggagcggtagctcacgcctgtaatcccagcactttgggaggctgaggcgggcggatcacaaggtcaagagatcaagaccagcctggccaacatggtgaaaccccatttctactaaaaatacaaaaattagctgggtgtggtggcgcctgtagtcccagctacgctacttgggaggccaaggaggaagagatcacaccattgcactccagcctggcgacaaagcgagactctaccaaaaaaaaaaaaaaaaaaaaaaaaaaggccaggtgcagtggctcacgcctgtaatcccagcattctgggaggccaaggtgggtggatcacgaggttagcagttcgagaccagcctggccaacatggtgaaaccccgtctctacttaaaatacaaaaattagccaggcatggtggcgcatgcctgtagtcccagctactcaggagcctgaggcagaagaatcgcttgaacccgggaggcagaggttgcagtgagccgagattgtgccactgtactccagcctgggtgacggagtgagaatccatctcaaaaaaaaaaaaaagaagttgagtcagactgggtgccgtggctcacgtctgtagccccagcactttgggaggctgaggcaggcagatcatgaggtcaggaattcaagaccagcctggccaacatggtgaaaccccatctctactaaaaatggaaaaattagccaggtgcggtggcaggcacctgtaatcccagctactcaggaggctgaggcaggagaattgcttcaacccaggaggcagaggttgcagtgagtcgagatcgtgccattacactccagtctaggcaatgagagggaaactctatctcaaaaaaaaaaaaaagtacaaagtgtatatatatatatatatatatatatatttgagacggaggcttgctctgttgcccaggctggagtgcagtggtgtgatctcggctcactgcaagctccgcctcccgggctcacaccattctcctgcctcagcctcctgagtagctgggactacaggtgcccaccaccccgcctggctaattttttttatttttagtagagagggggtttcactgtggtctcgatctcctgacctcgtgatccacccacctcggcctcccaaagtgctgagattacaggcgtgagccaccgtgcccagcccaaagtataccatttataaaatcggcatggcatggtggctcatgcctgtaatcccagcactttgggaggccgaggtgggcgaattgcttcagcccaggagttacagaccagcctgggcaacatggcgaaaccccatcactacaaaaaatacaaaaattagccagacatggtgacgtgcacctgtggtctcaactattcgagaggctgaggtgggaggattgcttgaccccgggagggcgaggcagcagtgagccatgattgtgctactgcactccagcctgagagacagaatgagaccccgtctcaaataaataaataaataaaataatacaaatatacaaaacaatgctatgatttatggatacaaacatatgaactggctgggtgtgatgggtcactcctgtaatcccagcacttggggaggccaaggcaggcaggttgcttgagtccaggagttcaagaccagcctggtcaatatgagaccctgtctctatttttacataaataaataattttaaaaatgtaataattaaaaataaaaagcatgggctggctgcagtggctcttgcctgtaatcccagcactttgggaggccgaagcgggcagatcacctgaggtcaggagttcaagagtagcctggccaacatggtgaaaccccgtctctactaaaaatacaaaaaaattagctgggcgtggtgacatgcgtctgtaatcccagctacttgggaggctgaggcaggggaatcgcttgaacctggaaggcagaggttgcagtgagttgagatcacgccattccactccagcctgagcgacagagcaagactccatctcaaaaaaaaaaaagaggccagtcgtggtggctcacaccagtaatcccagcactttgggaggccaaggcgggcagatcatgaggtcaggagatagagaccatcctggctaacacggtgaaaccccgtctctacttgacaaaaaaattagctgggtgtggtggcagtcgcctgtagtcccagctactcaggaggctaaggcaggagaatggtgtgaacccaggagaccgagcttgcagtgagctgagatcacgccactgcactccagcctgggccacagagtgagactccatctcaaaacaacaacaacaacaaaaataataaataaataataaataaatatataaataaagtgtgcataggaatgatgggaaacaaataacaggatagaaatcacctgggggccaggcgcggtggctaacgcctgtaatcacagcactttgggaggccaaggtgggcggatcacgaggtcaggagatgagaccatcctggctaacacagtgaaaccccatctctactaaaaaaaaaaaaatacaggccaggtgtgggggctcatgcctgtaatcccagtactttgggaggtcgaggcgggcggatcacaaggtcagcagatcgagaatatcctggctaacacggtaaaacctcatctctactaaaaacacaaaaagaaattagttgggcttggtggcaggtgcctgtagtcccagctactcaggaggctgagaatggcatgaacccgagaggcagagcttgcagtgagccaagatcgcaccactgcactccagcctgggcgacagtaagactccgtcacaaaaaaaaaaaaaaaaaatcacctggggaggggagcaaggggaatggtatcagggaggaccgaatggagcttcaactctatctgtaacgtttttacttttttttttttttttgagacagtctcactgttgcccaggctggagtgcagtggcgcgatctcggctcactgcaacctccacctcccgggttcacgccattctcctgcctcagcctcccaagtagctgagactataggcgcccaccaccacgcccggctattttttttctttttttgaggtgaagtcttgctctgtcgcccaggctggagtgcaatggcatgacctcggctcactgcaacctctgcctcctgggttcaagtgattcttgtggcttagcctccccagtagctgggattacaggcgtgcgccaccacacctggctaatgctttgtatttttattgattgattgattgattttttttgagaccgagtctcgctctgtcacccaggctggagtgcagtggtgcgatctcagctcactgcaacctctgcctcctgggttcacgccattctcctgcctcagcctcccaagtagctgagactacaggcgcccaccaccacgcctggctaattttttgtatttttagtagagacggggtttcgctgtgttagccaggatggtctccatcccctgacctcgtgatctgcccgcctcggcctcccagggtgctgggattacaggagtgagccactgcgccaggccacgtttttactttttttttttttttttttgagatggagtctcgctctgttgcccaggctggagtgccgtggcgccatctcggctcactgcaacctccgcctcccaggttcaaacgattctcctgcctcagcctcccgagtagctggggctacaggctcgtgccaccacagccggctaattttttttttttttttgtattttttgtagagacggggtttcaccgtgttagccaggatgttctcaatctcctgacctcgtgatctgcccaccttggcctcccaaagtgctgggattacaggcatgagccaccatgcccaggccatttttacttaaaaaaaatgtgttttagacagtctcgctctgttgctcaggcttcagtgcagtggcatgatcatggctcactctaacctcaaactcctggactcaagggatcctcccaccttggcctcccaaagttctgggattacaggcatgagctatggtgtccagccatgttttaatttttatagctttatttaggtaaaattaatacatgataaactgcacatattgaaaatgtacaatttgatgcatttcgatatatgtatacacctctgaaacactgccatcaagagagtaaatatggccaggcgtggtggctcacacctgtaatcccagcactttgggaggctgaggtgggtggatcacctgaggtctggagtttgagaccagcctgaccaacatggagaaaccctgtctctactaaaaatacaaaattaactgggtgtggtggcaggcacctgtaatcccagctacttgggaggctgaggtaggagaatcgcttgaacctcagaggtggaggttgtggtgagccgagattgtgccattgcactccagcctgggtgaaactcctgagagtgaaactccatctcaaaaaaaaaaaaaaagaagaagaagatagtaaatatgttcatcaccccaagtttccttctgcctagtcgtaatctttccttatggcactcatttgcctcaggcaatgccacacctctgctttctgtcactatagattaatttgcattttctcgaattttatataaatgggatcatacagtatgtattcttttgtgtttggctttcactcagcgtaattattttgaaatttattcatgttgttgtatccattgttcattcctttttattgcttagtagttgtccattgtatggatatgccaaatctctcctcttgattttttgaatccatacacaaatcaggttttcatcctcactacatcactgtaactgctcctaccaaggtcactcaaagttaattctaactaatcttccctgaacacatccgcagcatttgtcatagctgatctctgcctcctctttgaagcagttccaagtgccttccagaatgcctcattctcctggtgtctttccccgtctcctgaccaggcttgctccaactccttggctgcttttccttcatctccaaagtcctctaaactggtgtgtcctggggctgaatccaatctcctttccatttatactccattggtgattgcatcctgtttttgtttgttttttgagacagggtctcattctgtcgcccaggctggagtgtagtgacgcgatctcggctcactgcaacctctacctcccaggttcaaacgatcctcccgcctcagcctccgagtagctgggaccacaggcatgtgttaccacgccggactaattttttgtagagctggggtttcgccatgctgcccaggctggtctcaagcatgttttttgctttctaagtcatctataagcaccagaggcagagttacatagatccttcctgcctacccgcactgtccctgccctcaggccactccagcatccagcaggccagaaacctcagaagatttcttgcctcctttctctttcctccaggggcccggttcgatgtccccatctgcccacggcgcctctcgtgccagctgctccgcctgtcctgcccttgctcagaccacccaagtatcatctgtgctctggcccctggccaccagttccaccccacatgctgtcctcacaggtggcgccttgccattcctggggaccagggcctccttgttctggtcatacacagtggagtgtaggtcgagcgacaagtgagtagatctgcatgccaggtgggccgagggtggccattccggcgtgagtgtgggggtgtgagggaacgttgcatggggtgcacgtgggctgggtgtggcgtgcagcggtgtggcgccaggcaggcagcttggcggggcccacaatcagcgcggttgagaccattagtacggttaaaaccgttagctgcctgtcgcggcgagggcggggccctggggactggacggaatcccagttggtcagaggagaccctgggggcggggccgcgcgagttgccgttaggacagttaaaaccgttagctgcctgtcgtggcggggcggggccctgggacaggacggaatccctattggtcagaagaggacctgggggcggggccgcgcgtgccgttgcagaggcagcgggacgcggccacctcgaagccacgtcagggcagccccaggtcgggcgcgtgccagcagccagaggtggggacaggagggctttgggcagggtgggttggggaaaggcggggggaggggctgaggagccggatggggccgtgggtctgggttcaggataccagcggtcctcccgggctttcccgggacgttggtcttgtagtccctcccctgccctttctttccctatggcgatggccgctctggctcttgaaggaggcttcacttccgcgcttatccttggagagcagttttcatccgattcgcaggggtccgcgacctcctatcccagatccccgcctggagttgaggagtgagaccgggtacgccccgggagccagagtgagcggagacccagagaagcccgctgggatttctctttgattatgagtagggaaaaccctgtgaggcctctggaaagacatcagaaggatttagtctaggagctcagagcgtgtctccaggtggagaagaggcggaaaatgagagaggcggccggccattagtgtttgaggcgggccggtggccacagggggcctgaagtctgagtaagagacctgattttttctgctagaactttctgcagtggaggaacgggaggggcacctggagggcctcacatcgcagcctcaagaatctcgcagtaggccggctgcggtggctcacgccacactttgggaggctgaggcaggcggatctcctgaggtcaggagctcgagaccagcctggccaacatagcgaaaacccgtctctactaaaaatacaaaaattagcagggcgtggtggcgcatgcctgtaatcccagctacttgggaggctgaggcaggagaatcactagaacctgggaggcggaggtggcagtgagctgagatcgcgccactgcactccagcctgggcgacagagtgagactcggtctcaaaaaaaaaaaaaagaaagaaagaaagaaagaaagaaagaaagaaagaaagaaaagaaaaaagattgtcgcagtagagttgacgacggtggtcagatgaggtagtccatgccaatcggggcggtcctctccccctcacgtgttcctcccttgtgtacccaccctgccagggcccttcccttgtatatagttccattccttgcatgcactcaactttttctccccttttatgcttcctttaataggaaagagagtgagaggtgaaagtttttaatctgtgcatttcagttttcatttaccttggaatgaccgtgttccaccttagaacgaatacctcttccttactagtgctgtactagcatcttcaaggagagctttagagagatgggatttccatcctctgggaatttaaaagcctatacaggtagcatggagataaatacatgtacaaaagagagatgaacctgagtttgagtacatcaagccccagctggttcttagacatattgagaataagggtgtacttaccacagttttttgttttttttgagacggagtctcgctttgttgcccaggctggagtgcagtggcacgatctctgctcactgcaagctccgcctcccaggttcacgccattctcctgcctcagcctcccaagtagctgggaccacaggcacccgccaccacacccggctaattttttgcatttttagtagaaacggggtttcaccgtgttagccaggatggtctcgatctcctgacctcgtgatccgcctttctcagcctcccaaagtgctgggattacaggcatgaaccaccgcacccggccatttaccacaatttttaaaaattgggccgagttggctgtgcgcggtggctcatgcctataatcccagcactttgggaggccaaggcgggtggatcacctgaggtcagaagttcaagacccagaagttcaagaccagtctggccaacatggtgaaaccctgtctctactaaaaatacaaaaattagccaggtgtggtagcacacgcctgtaatcccagctactcgggaggctgaggcaggagaatcacttgaacctgggagatggaggttgcagtgagccaagatcgcgccactccactccaggctggtcgacaaagcgagactgcatcccaaaaaaaattgggctgggtgtggtggctcacgcctgtaaatcacagcactttgggaagccgaggcgggtgaatcacttgagctcaggagcgtgagacctgcctgagcaacatggtaaacctctgtctctaccaaaaatacaaaaaattagccaggtatgatggcgtgcacctgtggtccaagctactcaggagtctgagttgggaagattgcttgagcctgataggtggaggttgtagtgagccaagatcgcaacattgcactccaacctggttaatagagtgaagccccagctcaaaaggaaagaaaaccatatattttaaatttgtgactatttggcatgttttgctccacaaaatctagttgtaatttagttcctaagtttttaactcattaaacaagaaatgttttcagagctcctattatgttccaggaatgatttttaggttctagggctgtagtagtaaataaagaaaaaattattgtcctcaaaagagcttaatattacattctagtaaacatggatatctgtagagacagaaaagacaagttaatagtgtattagaatgatgtagtgttacattagaatgatgtagtattacactattagaatagtgtaatagtgtattagaatgatgatgtgttgcagagaaaaaagcaggggagagccatagtgattgtcaagaggttacttctttttaatttttttttttttttttttttgagaagagtcttgctctgtcgcccaggctagagtgcagtggcgcgatctctgctcactgcaagctccacctcctgggttcgcgccattctcctgcctcagcctcctgagtagctgggaccacaggtgcctgacaccatgcccggctaattttgtgtgtgtgtgtgtgtgtgtgtgtgtgtgtgtgtgtgtgtgtgtgtgtgtttcatatttttagtagagatggggtttcaccgtgttagccaggatggtctcgatctcctgacctcgtgatctgcccacctcggcctcccaaagtgctgggattacaggcgtgaaccaccgcacccagccaattatttttatttttttcagatagagtctcgctctctcacccaggctggagtacgatggcgcagtcttggctcactgcaacctccgcctcctgggttcaagcgattctcctgcctcagcctcccaagtagctggaactacaggtgtggactaccacgtccagctaattttttgtattttttttttttttttttttttgagacggagtctcgctctgtcgcccaggccggactgcggaccgcagtggcgcaatctcggctcactgcaagctccgcttcccgggttcacgccattctcctgcctcagcctcccgagtagctgggactacaggcgcccgccaccgcgcccggccaattttttgtattttttttagtagagatggggtttcaccatgttgcccaggtgggtcttgaactccagagctcagacaatcctcctgcctcagcctcgcgaagtgctaggattacaggtgtgagctaccactcctggcctagaggttacaagtttgaataagtaatttgaaggagatagagttgtctgtcatgctgatatctgagggaggagtgcaccaaaatgagggtgcagcacgcaaaagcgacatgaaactgcttgtgcccagcaagggaaaacaacagtgaggagccccataagaggcatgcaacagggtatagatgggaatggtggagggctatggggagattacagatgcccctgtaggtaatcatagataattctggcttttattttgtgtagggtaagagcagtggaggatttgagcagaaggactatgtgatctgacttaaggttactgtaactctggctgctttgtagggaagagactggagtgggacaagggtgaaatcagggagagtggttaggaggccattgcaataatccaggctggtggcagtggagtagggttgccgcatttagcaaataaaaatacaggacacccagttaaatttgaatttaaggtaaacaatattttttgtatgtctcatgtaacattgggaaattcaaattttacttggtattctattttatctggcaacctccagttgccagaaaggagggagtgaggagtggtcaaattctagatatattttgaaggaattagtatagtatttgctgacagattggatgtgagactaagaaaagggaattgaggaggacttagattttggcctgagcacctggaagatggaagtgtccttaaataaaatgggaagaccacaggaggagagtgcttaggggaagttatgaggatcttggctttgaacattgtcttagtccgttttgtgttgctataactgaatatcacagctaggtgatttaaataaatttatttctcacagtttttgaggctagaaagttcaatatcaaggtaccagtatctggagctcacttttataacaacccactctagtgataatgaactcacttctgaatgcactccggtttacccacttacattaatctattcatgaggctggagtcctcatggcctaatcacctcttaacagtcctacctcttaatactatcacaatggtaattaaatttcaacataagtttttggaggggacatttaaaacatagcattcagctacgtgggttcagcatgtgaaagctgcatatatggagggccagtttttcatatatactagttctgcagggctggcttctggacttgagtgtatgtggattttggtatattgttggggtcgggctgtgtcctggaaccaatcctccacatatgcagagggacaactgtagttcccttaactgaggttaatgattactagttatgtgaagggatccccccaaaattttatactttccttctgaaagaattttggtgatgaggagctgtaatctgaaaggggctttttctgagagcttatggaggaaagtaaggcagatgaaatgatgctttgttggggaagatgttaccagaaaggggtcccagtccagactccaagaaggggttcttggatgtctcacaagaaaatttggagcaagtctacagagtagagtgaaagcaagtttattaagaaagtaaagaactgggccgggcgtggtggctcacgcctgtaatcccagcactttgggaggctgatgtgggcagatcacaaggtcaggagttgaagatcagcctggccaatatggtgaaaccccatctctactaaaaaaaaatacaaaaaattagtcgggcgtggtggcaggtgcctgtagtcccagctacttaggaggctgaggcaggagaatcacttgaacccggaaggcggaggttgcagtgagccgagatcgtgccactgcactccagcctgggcaacagagcaagactccatctcaaaaaaaaaaaaagaacgaaaggaatgactactccatagagcagtcccaaaagcggctggttggctatttttatggttatttcttgatcatatgctaaacaaggggtggattattcatcaattttctgggaaaggggtggagatttccaagaacaggtttcctcttccttttagatcatatagggtaacttctggatattgccatggcatttgtaaactgtcatagcgctggttggagtgtctttttagcatgctaatgcgttataattagctatgatatgcggtgagggcgaccagaggtcactttttttttttttttgagacactgtcacccaggctggagtgccgtggtacaatctctgctcactgcaacctctgccttctggtttcaagcgattctcctacctcagcctcctgaggagctgagattacaggcgcgtaccaacacgcctggtgaatttttgtatatttttagtagagatggggttccaccatgttgaccaggctggtctcgaattgctgacctcgagtgctgcgattacagcgtgaaccactatgcctggccgtaattttttttttttttttgagacagagtttgctctgttacccaggctggagtgtggagtacagtggcacaatctcagctcattgcagcctccacctcctggttcaagcttttcttctgcgtcagcctcctgagtagctgggattacaggagtgagccactgcgcctgggcaatttttttttttttttttttgtgagatggggtcttgctctgtcgcccaggctggagtgcagtggcgcaatctcggctcactgccacctccacctcctgggttcaagcaattctcttgcctcagcctcctgagtagttgggactacaggcacgtgccaccacgtccagctaatttttgtatttttttttcttttctttctttcttttttttctttttgagacggagtctcgctctgtctcccaggctggagtgcagtggcgcgatctcggctcactgcaagctccacttcctgggttcgcgccattctcctgcctcagcctcccgagtaggtgggactacaggcgcccaccaccatgcctggctaatttttttgtatttttagtagagacggggtttcaccatgttagccaggatggtctcgatctcctgacctcatgatccacccgcctcggcctcccaaagtgctgggattacaggcatgagcccctgcgcccagcaatttttgtatttttagtagagatgggatttcaccatattggtgaggctggtcttgaactcttgacctcgtgatccgcccacctcggcctcccaaagttctgggattacaggcgtgagccaccgctcccggccatttttgtatttttaatagagatggggtttcaccatgttggccaggctggtctcgaactcctgacctcaagtgatccacccacctcggcctcccaaagtgctgggattacaggcatgaccactgcacccggcccagaggtcactttaattgccatcttggatttggcgggttttgaacagctactttcttgcattttttgtgatgagcagggcctttgtgacctgtatcgttgctgacctatctcatcctgtgactaagaatgcctaatctcctgagaatgcagctcaggtcccagcttcattttacctagcccctactcaagatagagttgctctggttcaaatgcctctgacaggctggatgcagtggcacacacctgtcatctcagcactttgggaggccaaggcaggtggatcacctgaggtcagaagttcaagacccagaagttcaagaccagcctggccaacatggtgaaaccctgtgtctactaaaaatacaaaaattagctaggtgtggtggcagatgcctgtaatcccaactacttgggaggctgaggcaggagaattgcttgaacccaggaggcaaatgttgcagtgagccgagatcgtgccattgcactccagcctgggtgacagagcaagactctgtctcaaaaaaaaaaaaaaaaaaaagcctctgacaaaaaatgtgtggaatacaggtggacagatgagagtgggtaggaaaagccaagctcatctgctttagtttgttacttgatgaccggttatattattaccttgtttcatgttgaaactagatcatgcatcagccagccctgtgttctcggagcatttttttctttctggtgaggtttttttttttttttgagacggagtctcactctgtctctaggtgggagtgcagtggtgtgatctcggctcactgcaaactctgcctcccaggttcaagggattctcctgcctcagcctcccgagtagctgggactacaggtgcatgccaccacgcctagctaatttttgtatttttagtagagacaggatttcaccatgttggcctggagggtctcaatcttttgaccttgtgatctgcccacctcggcctcccaaagtgctgggattacaggtgtgatctggtgagttttagtccttgtaactcatgctgcatattttagaagctgccgatttaatactggaatattaaccaggtattctgcaatataatttgtagcataccttagtctgccattattcaaaattgtgattgtttctaaagaaatgtctgtttttcagcccttgtaaacgtttaaaaatttctagccttttccttaaataaaaatagtcctcatgattcctttattaatttctacatataatatttcttttttttttttttgagatggagtctcgctctgtcacccatggtggagtgcagtggtgcgatcgcggttcactgcaagctccgcttcgtgggttcatgccattctcctgcctcagcctcctgagtagctgggactacaggcgcctgccaccacgcctggctaatttttgtatttttagtagagacggggtttcaccacgttagccaggatggtctcgatctcctgaccttttgatccgcccgcctcggcctcccaaactgccgggattacaggcgtgagccactgtgcccggccaaatttctacatataatatttctaaatcagtttgggtttagcaataacttgtatctcttaagggaaacatgcttttctgtgtgttcttgctctgcacacagttatttctttctgccactgtggaataagcagacctccattacaatgcaatttagttccctagaacaggggtctccaacacccaggccccggaccagtaccagtcagtccatggcttgttaggaaccaggccacacagcaggaggtgagcagtgggccagcctgagctctatctcctgtcaggtcagtggcagcattagattctcataggagtgtgcatgaaccttattgtgaactgcacatgcaagggatctaggttgtgcactccttatgagactctaatgcctgatgatctgaggtggaacaatttcattttgaaaccatccccaaccccacccgcaaccaatgtccatggaaaaattgtcttccacaaaacttgtccctggtgccaaaaaggttgggaactgctgccctaggactcaaggtcagagacctaatgcctgagggaagagagtttgctttccatcctgagaaatcacccttagccatattttgctaatttgacccataatcacctctatgtgttttttttatctttattcagctaacaaagaacttgcttactttgctcctattctgttttccccacttatgctgtccagagttgcaacctttgtaaatctaaacatcgacatctcaaaatccactaccaacagagagggtacatggggcttgatccactcaagagcaaggaacagtgtactttttatgtaaaccattggaaaactccatacttcatagaaagtataaaattggatgatctaaagacctcttgtgtggtaggggttgaacagtcatgactgaatataattgacagcttcctgacctttgtaggacatctttcttctggttgaattctgggaagatggacatctcaggcttgggtaaaccatgtggtaaacacagacatgctgcacaagtaaaggcaggataactaatcaaaaggaagaaatgttacttcatcttctaccacacatatattgaatctctcctgtttaatccagttaactggagttgctggtttcattctcaacattaaggggggagtttggtcatgtagactgagagagactaccttttttaccttctagtcatacaggacctccttagactcacccctttgatgctggcacactgtcagatacctggaactataagggccttttaaatgcttgcatttctggctgggcacagtggcttacgcctgtaatcccagcactttgggaggccaaggcaggtggatcacttgaggtcaggagttcggcccaacctggtcaacatggtgagaccctgtctctacttaaaaaaaaaaaaaattagccaggagtgacagcacatgcctgtaattgcggctactcaggaggctgaggcaggagaatagcttgagcccgggaggcagcggttgcagttagctaagataacaccactgcattccagcctgcgtgacagagtgggacttcatctaaaaaaaaaaaaggcttgtatttctaattccatgagtataaggtattttgaggtttatatgtatttgcaaaaagcaaatgacatgtctttttttttttgagaaggagtcttgcactgtcgcccaggctggagtgcagtggtgtgatctcggctcactgcaagctctgcctcccgggttcatgccattctcctgcctcagcctcccaagtagctgggactacaggagcccaccaccatgcccggctaattttttatattgttttagtagagacagggtttcaccgtgttaaccaggatagtctcgatctcctgacctcgtaatccacttgccttggcctcccaaagtgctgggattacaggcatgagccaccgcacccagcctctttctttctttctttttttttttttttaagagacagggtcttgctttgttgcctgggctggaatgcagtggtgggatcacagtttacagaagccttgaattcctgggctcaagtgatcctgccgcctcagcctcccaagtagctgagactacaggtgtatgttgccatgcctagcttgtttatttatttaaattttttatttttaattttttgacatagtttgagagataattttttgagattttttttttcttcgtcgcccaagctggagtatagtggcacaatcttagctcactacagccttgacctcttgggctcaagtgatcctcccatctcagcctcccaagtaggtgggactataggcttgtgccaccacaccctgctaattttttttttttgaggcagagtctcactcgatcgcccaggctggagtgcagtggcacgatcttggctcactgcaacctctgcctccccggttccagtgattctcctcctcaacctcctgagtagctgggattacaggcacccgccaccacacccagctaatttttttgtatttttagtagagacagggtttcttcatgttggccaggctgttctcaaactcctgacctcaaatgatccacctgcctctgcttcccaaagtgcagggattacaggcgtgagccactgcgcccggctttttttttttttttttgagatggggtctcactctgtcgccccaggctggagtgcagtcgtgtgaccttggctcactgcaacctctgcctcctgggttcaagcaattctcctgcctcagcctcccaaatagctgggactacaggcacgtcccaccacacccaggtaatttttgtatttttagtagagacagggtttcaccatgttagccaggatggtctggatctcctgacctagtgatccacccgcctcggtctcccaaagtgctgggattacacatgtgagccactgctcctggcctctccatttagtttttttttttttttttttgagctggggtctcgctctgtcgcccaggctggagtgcagtggcgcgatctcggctcactgcaagctccacctcttgtgttcatgccattctcctgccccggcctcctgagtaggtgggactacaggcacccaccaccacgcctggctaattttttgtattttttagtagagacggggtttcaccctgttagccacgatggtcttgatctcctgacctagtgatccgccctcctcggcctcccaaagtgctgggattacaggcgtgagccactgcgcccggcttccatttagttctaatttgatttctgtcatcagagttttgtagttttcctcatatagatattgtatatattttgtcacagttatacctaagtatttcttttttgggggtgcaaatataaatggttttgtgtttctatttatttacttattttttttgagacagtggcatgatacaaaaattagccaggtgtggtggcgggtgcttgtaatcccagctactcagaagaattgcttgaacctaggaggcaaaggttgcagtgagccaagatcgagccacggcactccagactgggtgacaagagcaaaactccgtctcaaaaaaaaaaaacagaaattttcactaattggatgggaatatagctgctggaatgtcttcgtgtacatataatagtcactagtaatctttggaaaaaattatactgttaactttcttaatattcacctattctttctaataggtataactataagaaatgaattttaatgtctggaatatcaaagagatgctcagtattccttcaggctctgggtaagttttctggttatattgtctgatccttaagaggattttctggccgggcatgatggctcacacctgtaatcccagcactttgggaggccaaggtgggcagatcacaagatcaggagatcaggaccatcctggctaacacggtgaaaccccgtctctactaaaaatacaaaaaaatttagccgggcatggtggcgggtgcctatagtcccagctactcaggaggctgaggtaggagaatggcgtgaacctgggaggtggagcttgcagtgagccgagattgcgccactgcactccagcctgggcgacagagcgagactccgtctcaaaaaaaaaaaaaaaaaaaaggattttccagtttcattgatttcatagaaaatgggttcctggtcaggcatggtagctcacgcctataatcccagcactttgagaggcccaggtgggtggatcacctgaggtgatcaggagttcacgactagcttggccaacgtggcaaaaccccatctccactaaaaaaaaaaatacaaagagtagccaggcaaggtggtgtgcacctgtaatctcagctactggggaggctgaggcaggagaactgcttgaacctgggaggcggagcttgtggtgggctgagattgcgccactgcactctagcctgggcaacagagtgagactcaatctcaaaaaaaaaaaaaaaaagagggttcccttcccatcaggttataataatggaagtgtgtccagaattggtgggttcttggtttcactgacttcaagaatgaggccaaagacccttgcggtgagtgttacagttcttaaaagcggcatgtccagagtttgttccttctgatgtttggatgtgtttggagtttcttccttctggtgggtttggggtcttgctggctcaggagtgaagctgcagacctttgcggtgagtgttaacagctcataaaggcagtgcggacccaaagattgagcaggagcaagatttattgcaaagagtgaaagaacaaatcttccgcagtgtggaagaggatcggagctggttgccactgctggctcgggcatcctccttttattcccttatctggccccacccacatcctgctgattggtccattttacagagagctgatcggtctgttttacagagagctgattggtccgttttgacagggtgctgattggtgtgttcacaatccctgagctagacacaaaagttctccaagtccccacagagcactgattggtgcatttacaaaccttgagctagacacagggtgctgattggcgtgtttgcaaaccttgagctagacagagtgctgattgttgtatttacaatcccttagctagacataaaggttctccaagtccccactagattagctagacacagagcactgattggtgcatttacaaaccttgagctaggcacagagtgctgattgttgtatttacaattccttagctagacataaaggttctccaagtccccaccagattagctgatacagagtgctgattggtgcatttacaaaccttgagctagacacagagtgctgattggtgtatctacaatcctttagctagacataaagtttctccaagtccccactagactcaggagcccagctggcttcacctagtggatcctgcactggggccgcaggcggagctgcctgccagtcccacaccatgtgcccacactcctcagcccttgggtggtcgatgggaccgggcaccacggagcagggggcagtgctagtcagggaggctggggccacgtaggagcccatggtgggccggcactgctggaggacccggtgcaccctccacagctgctggcccaggtgctaggcccctcactgcctggggccagcggcgcaggctggctgctctgagtgcagggcctgccaagcccatgcccacctggaactcgagctggcccgcaagtgcatgcgcagccctggtttctgcccgtgcctctccatcacacctccctgcaagcagagggagctggctctgacctcggctagcccagagaggggctcccatagtgcagcgacaggctgaagggctcctcaagcatggccagagtggacgccaaggccaaggaagctccgagagcaagcgagggctgccagcatgctgtcacctctcagaggtacctcatacagactcttcttctcttcatctcttctgtatctgctgtatcttcttgtgctttttttattctgtccattacaaaagtggtatgaatccagctctgtgtgttaactgaggaatgactttgtatctagcattgggcctgttagtgtcagagaaggtccaacatctggacactcagtccagttgcggcaactgctactgaaatagcaaggagcaaaatcgagatgatgttcagatatatgttcagttgtacagtgcagtttatgggtactgtggagattaagaggcactctaggtattgacaaggctcattgaggtattgtcctctcaactactccactaaggtacttacactggtgtctaccatcctgcaataagcttgccactgctaacttagtgagtatgcctgagaagtagtgtatatttaagggatttgtaattgcttattatatgctcttatcactggatagtttctttcctctttaacaccttcctgaagttatcaatcgatcagaaacctagagcactgttttttttaatttctcaaaaaaaaaaatgcttacagttgatagggagtagtgaaaaactatctttatttctagatcatatatatatatatatatatatatattttttttttttttttttttttttgagacggagtttcactcttgttgcccaggctggagtgcaatggcgtggtctcagctcactgcaaccttcacctcctgggttcaagcaattatctcacctcagcttcccaagtagctgggattacaggtgcctgccaccacacccagctaatatttgtatttttagtagagacagggtttcaccatgttggaaagtctgatctcaaacaactgacctcaggtgatctgcccgcctcagcctcccaaagtgctgggattacaggcatgagacaccacgcccagcaaatcttcattaagtccaattcctctgttggacttttttgtttttgttgctgcttgttccttcagtatcatatccaagattgccaaatccaatgtcatgaagcttttgccttctctctttttttttttttgagatggagtctcactctgttgcccaggctggagtttagtggcacgatctcggctcactgcaacctctgcctcccaggttcaagcaatcctcctgccttagcgcccccagtagctgggattacaggcatgcaccaccatgcccagctaatttttgtttttttgtaaagacgaggtttcgctatgttggccaggctggtcttgggactcctgacctcaggtaatccaaccgcctcagcctcccaaaatgctggcattacaggcatgactccatgcctggccttcatagttttaagatataaatcctacataatttcagtaggctcacaaaactgttcccagcctaccaagcctagctaattattctctttggcccaagaggaaaatcatagagaactattttgagcaatgatggtgttacccatattatatgtttgtaacccattacttagtttatctcagggaatgtttctgttaccaaaacaccaggggttcagtctaggtcctgctgctcgccacacagaaagccaatcactgagatgaggagtattaccaaggaagaaggctttaattgggtgctacagccaaggagatgggagcttagcctcaaatccatctccctgactaaaattaagggtttatttagcagggaggaaatgtaacaatttgtaagaaaacaagaactagggaggggcaaggaggcatctagtgcagtgatctggtgagtttcagttatttgatacttttttgagaggcctgaaggtccttttctgaggaagaaactcagataaacaaatgcaagtttcaagctttaacaggagaagggtcaatttctacatttatccaaaaacaactgtctatgggactagggctagtttcatttctgagtaaaaataatcacccttctctatcctgaactattagagtctctttctgttttaataataatgtttatatcaaaatagaaacaagtagtattaatattataaaggcttctttggctcacaatatgtacttatatgttatctaattgctttgaatttaacatttgataaaggaatgatttgtgtatgtgttttaatgcagcagtccctaacctttttggtaacagggaccagtttgtggaagacaatttttccacagaccaggatacggagaaattgtttcagaatgattcaagtgcattagatttatcatgcactttgtttctattattacattgtaatatataatagaataattatggtcaggcacagtggctcacacctgtaatcccagcactttgggaggccgaggcaggcatattgcttgaggtcaggagtttgagaccagcctggccaacatggcgaaaccttgtctttaccaaaaaatacaaaaattagccgggtgtggtggtgggctcctgtaatcccagctacccgggaggctgagggacgagaattgcttaaatgtaaggcctaacaccataaaaaccctagaaggaaacctaggcaataccattcaggacataggcatgggcaaagacttcatgactaaaacaccaaaagcaatggcaacaaaagccaaaatagacaaatgggatctaactaaactaaagagctatgcacagcaaaagaaattatcatcagagtgaacaggcaccctacggaatgggagaaaatttttgcaatctacacatctgataaagggctaatatccagaatctacaaagaaattaaacaaattcacaagaaaaaaaaccccatcaaaaagtgggcaaagaatatgaacagacacttctcaaaataagacatttatgcaaccaacagacatatgcagaaatgctcatcatcacttgtcgtcagagaaatgcaagtcaaaaaccacaatgagataccatctcaagccagttagaatggcgatcattaaaaagtcaggaaacaacagatgctggagaggatgtggagaaataggaacacttttacactgttggtgggagtgtacattagttcaaccattgtggaagacagtgtggcaattcctcaaggatctggaatagaaataccatttgactcagcaatcccattactgggcatatacctaaaggattataaatcattaactgataaagacacatgcacatgtatatttattgtggcactgttaacaatagcaaagacttggaactaacccaaatgtttatcaatgagagactggattaagaaaatgtggcacatatacaccatggaatactatgcagccataaaaaagaatgagttcatgtccttttcagggacatggataaagctggaaaccatcattctaagcaaactatcacaaggacagaaaaccaaacaccacatgttctcactcaagtgggagttgaacaatgagaacacatggacacaggatagggaacatcacacaccaggctggttggggggtggggggctggggggctgggggagggatagcattaggagaaatacctaatgtaaatgaggagttgatgggtgcagcaaaccaacatggcacatgtatacctaagtaataaacctgcacgttgtgcacatgtaccctagaacttaaagtataataaaaaaaaaaaaaaagaaaaaattatacagctcactgtgatgtagaattagtgggagccctgagtttgctttcctgcaactagacggtcccatttgtgggtgatgggagacagtgacagatcatcaggcatcagattctcataaggagcgcacaacctagatcccttgcatgtgcagttcacaatagggtttgtgctcctgttagaatctaatactggtactgatctgacagaaggcagagctcagatggtaatagagaccagcctgggcaacatgactgtcagttcccgggtctgggtccagcccatgctgaagtccaaggggagtgggtggataagcagaaagaacatttgggggtctgtaggcagatgaatatggttttattctgcagctttctcattagcagcttactctcacactggctttcttattagcagcttactctcacactctccgccctgctgtcttggctgcttgagctggctgcccccatgagcagctgcgcagctggctctcccttcccttcagggtcagcagcttaactctttctctgggcacaagcaagctgaggtgtatcctggttcccacctctccgtctgcaaagaaggacagctccggctctctctctctctttctctgggtgccagcatgcccaccatgtcaagccatgttgagctgagccaagccaagcccccaagagacccctgtacagtgtcagcaggacagttaataccttttttttttttttttttttttttgagatagtcttgctctgttgcccaggctggagtgcagtggatgcaatcttggctcactgcagcctctgccttctgggttctagtgattctcttgcctcagactcccaagtagcagggattacaagcacatgccaccacacccggctaatttttgtatttttagtagagatgggatttcaccatgttggccaggctgatttcaaactcctgaccttatgatccgcccaccttggcctctcaaagtgctgggattatagacgtgagccactgctcttggctgcagttatacctttttcagacaatagtggcatagagccaagtatgaacttacacaaacaggttatataacaagtggagttatgtgcttgcatgccaaacttgctgagtcatgcaggcctggatatctgcctcggcctattccttgactaaagcacatccgtgtaccttacaatgacaaaaccctgtctctacaaaaaataaaaaaattagctgggcgtggtgatgcatgcctactagggaggctgagttgggaggatcacctgagcagaggttgcagtgagatgggatcatgccattgcattccagcctgggtgacagagcaagatcctgtctcaaaaaatgaataaataaaaaataagaggctcatgcttgtaatcccagcactttggaaggctgaggcggatgcatcacttgaggtcaggagtttgagaccagcctggccaacatggtgaaaccccattgttgggaacaggcccccaagtctggccataaacgggcctcaaaactggccaaaaacaaaatctccacagcagtgtgacatgttcatgatggccttgacgcccacgctgaaggtggtgggtttaccggaatgagggcaaggaacacctcacccacccagggcagaaaactgcttaaaggcaatcctaaaccacaaccaatagcatgaatgatttgtgccttaaggacatgttcctgctgcagataactagccagagtccatccctttgttttggcccatccctttgtttcccgtaaggaatacttttagttaatatataatctatagaaataatgcttatcactggcttgctgtcaataaatatgtgggtcaaactctgttcggggctgtcagctctgaaggctgtgagtcccctgatttccctttccacactctatatttctgtgtgtgtgtctttaattcttctagtgccgctgggttagggtctccacaaccgagctggtctcagcaagtggtgcccatacgtggggctcgaaccctggccgaagggtcaccagagcaatggttggaaaacgtagagctaagctggaggacacctgagtactcttaagcaatccctgtggtgagtaagaaggggagctcggaagcatcagggtaacaatgggacaagtgtgggctctggttcgttccaccttggaacctttcatactaatgatgaggaggaaggaaagtataacaaagtaatagaagaggtaatggagcaggtttgcttgccagctaaagctaaagtggcaaaggaggaagagtttcatccctacccttctgcaccccctccttattttgaagaaaaagagtggcctgagcctccagatctttcttttccggaggacactgggtgaaaagtggttgccccagtgactgagcagcaccttgagcaactgctctcagttctattcaggcaggaattcagcaagctagacaagagggtgatatagaggcttggcagttctctgttaggatacaccccacagatcaacagggaaatattatagctacatttgagccttttccttttaaattcgggaaatgccatgagggtcccgtcccgggccctgttccaaactggggcatttccggctcaggcaattccctcatctgtgtacaatgcctgtcccccaccacagctggtagtgccgcagtagatttgtgtccagaatttattccttccagcaggttcttggtctcgctgacttcaggaatgaagccgcagaccttagtggtgagtgttacagctcttaaagatggtgtgtccggagtttgttccttcagatgttaagatgtgtctggagtttcttccttccagtggatttgtggtcttgctgactttaggagtgaagccatggatctttgtggcgagtgtcacagctcttaaaggtggtgcagacccagccagccatggtggctcatgactgtaatcccagcactttgggaggctgaggtgggcggatcatgaggtcaggagatcaagactatactggctgacacagtgaaaccccatctctactaaaaatataaaaaattagccgggcgtggtggtgggcacctgtagttccagctactcaggaggctgaggcaggagaatggcatgaacctgggaggcagagcttgcagtgagctgagatagcgccactgtactccagcctgggcgacagttcaagactccatcaaaaaataaaaaataaaaggtggcgtggacccaaagagtgagcagcagcaaaagaacaaatcttccacaatgtggaaggggacccgaacgggttgccgctgctggctccagtggccagcatttattccataatttggccctgcccacattctgctgattggtccactttacagtgagctgattggcccattttacagagtgctgattgggccattttacagagtgctgattggtgcatttacaatcctttagctagacacagagtgctgactggtgtgtttttacagagtgctgattggtgcatttttacagagtgctgattggtgcatttacaatcctttagctagacacagagcgctgattggtgtatttttacagagtgctgattggtgcgtttacaatcctttagctagacacagagcactgattggtgcatttttacagagtgctgattagtgcgtttacaatcctttagctatacacatagtgctgattggtgcgttttttacagagtgctgatggtgcatttacaatcctttagctagacacagagcgctgattggtgcagttacaatcctctagctaggcagaaaagttctccaagtccccactcgacccaggaagtccagctggattcacctctcaatcccccctctaaacaggacaccccaactgctgttgggaattgggtgatgaccgctatagctacttcctgctggttaggggcgaagaaggggccctgctgtggtagtgtcctccagaggggaactctctaggccagccaaagggccagtgggtcaatccaggggtccttggtagaagttgttagttgagctcatttggggttccatttgtaagaccatctatagactgatggcctcgatactagaggaaacaaatttgacaaggatgttaaaacacagggcccgaaggcgagtaatagcaagatggctgtcaggaggcctagaaaggggagaagccttgtcgcccaactccagaggctggtataagagtttgaaaggcactgtctgatttcagaagccttttcctataaacgccgggtggcatcttgtactatcgctgactggttagtgtaaaaacagcactcttaccctaagaaggtgcagagtcctcctttctcagcagtgaggaggtctaggtctcagcagttttggagagttagtgatgccaaagagtctatttgggattgtagagtaaggatagatttcgtcatttcttgcaaactgtctgagaaatcctttgagagtctgtggtagtagcataatgaagtagataaactggctattctggtttctgtagccatagctgttcctaaccctataagtaggggtattagttgtatggctctgcgctgacggatagagagctacaaagccaacagtcatttgccagggaaggattggactggtttaacagagagtgggttaagttgagagtcttgtacaggtaattaggagctaggggaaggggaggggcaattgtatgaggtgtccaaggaagcaggagggatagataggcaaagagtaaataggaaggtaaggagggtgctctggaacacgagatcattttatccagtctgagttaaaggtgggagtaaattgctgtcagaaggaaggaagatagaaaaaaggttgatgtgattaggatttgcatcccagcaggagctatagtatgtagtcctatcgtaaagagtatggttagtatgctgcttaataatattatgaaatagtaaaaggattccattaaaggggcaaggagaggtattaaagattatgtaggttttcacttatcttttttaaggaggaaagggtttttcctcaggatcagtggtaggagcctttttagtctgggatatttcctttcaaaataggagatgcaagtcctccaatggttcgcaagtttattgaggctggtctgggtgatcttgggactcctgaactgacggtcctgcaggttccgcagggggtgtccaaaatttaactcaattgtagtgaatccaagattccactcctgccaccttaactgcagtggggttagaaaggattaccgagtatggtccttcctacaaataatccatagatggagaggtagatgggagagatttgaccaacactagatctcctggttgaaacaactctgttcccttttctctgtgacatccttcaggtaggtttttaaggtttcattgatattttgccaaagaagttatgtatttgaccaagttggccgtttcctgatcaagtaggaggtcatttgtgataaaaggttgtccatacagcatttcatatggactgagccccatattgtgaggagaatttcagattcttaacaaggccatgggcaaaagactaggccatgggagatgagtttcttgtgttagtttccttaagtgctttttgagtgtttcatttgctttctcgaccttccctgaggattgtggcctccaggcacagtgaaggtgatattgtatccctagtgccctcgaaattccctgagttatcatggctttaaaagcctgaccattggccaggtgtgtggcttatgcctgtaatcccagcactttgggagaccgaggcgggcggatcacgaggtcaggagattgagaccatcctggctaacacggtgaaaccccgtctctactaaaaataaaaaaaattagctgggtgtggtcgtgggcacctatagtcccagctactcgggaggctgaggcaggagaatggcgcgaacccgggaggcagagcttgcagtgagccgagatcacgccactgcactccagcctgggagagagagtgagactccgtctcaaaaaaaaaaaagccggaccattgttggtctgtaagctttggggaagcccaaatctagaaattatttcatgtattaggactttaattgcttcctgagccttctctgtcttgcagggaaaagcatctatccaatttgtaaaggtatcaacacagaccaacaagtattgaaatccgtttgacttagggatatgggtgaagtctaactgccagtcctctccaggatagtgacctattctttgttcccccaaagggaccttacgatggaccaaaggattcttcctttggcacacctcacaggctttgactacctgttggatggcccggaagagatttggccctgtagatagggatttggccatttgatgagtgttttcaatacccatatgaaaagtttggtggagcgttttaagtattttctggtgtctggctttaggcataagtacctttccttcttctgttgttaaccaccccgaggggagaaaactatgcccccatgaaagtccccattctgtttcagtcggggaatactggggcttaatctcgtggagggagttgttccataccaaggatccttccgtaggtatttctaatgggaggttccacctggcagcaattttggcctcagcatctgcctgacggtttccttctgccttttctccctcacctttctgatggctttggcagtgtaagactgccacctccttgggtttttgcactgtgtgcaataactccataatttccttgtggtatttaatgggggttcttcccagaggttaggaactccctttctttctatattgcagcatgggcatgtaggattagataaccatacttgctatctgtatacacatttattctttttctttttcccagttctaaggctctggtaagtgccactagttctgctaactgggcgctggtccctgggggaagaggcttactttcaagtatggttacatcactaactatggcataacctgcccttcgtatcccattctccacaaatgaacttccatcggtatataggttaaggtcaggattagctaaggggacttctaagatatcatcttgagcggcataagtctggactataatttgttggcagtcacacttgattggttccccatcctctgggagaaaagtggcagggttgagggctacgcatgtatgtatttgaagggccattccctcaaggagtagcacctggtatctaagtaggcagttgtctgatagcgataaacttcctttgacacctagtatgccatttacatgagtagtccagacagtgagattctttccttgtattattttgatagcctctgtcactaagacggccactgccgcaactacccgtaaacagtgaggccagccttttgctactacatcagtttctttatttaggtatgccactggttatggggttgtcctgcgggtctgagtaaggactccaagagctatccctgctctctctgtgatgtataaagagaagttttggctgggcgcagtggctcacgcctgtaatcccagcactttgggaggctgaggcgggcagatcatcaggtcaggagttcaagaccagcctgaccaacatggtgaaaccccgtctctactaaaaataaaaaattagctgggcatggtggtgggtgcctgtaatcccagccactcaggaggctgaggcaggagaatcacttgaacccaggaggcagaggttgcagtgagcagagattgcgccatcgcatcccagcctgggtgacagagtgagactccgtctcaaaaaaaaaaaaagaaaagttttgtcctgtgggaaggcttaaggctggagcttgagtttgttccttccaatgcccaaacttcagggttgattccctccaccggtaggggacaacaaatgggtaacttattcccccatattcatgtagataatagctccagctttggctaatatatccctccctaataagggtgtgggactttcaggcacaacaagaaagacatgtgaaaagagcaaagtctcccaattacaactgagaaggtgggagaaatacctggttacaggctgtcccagtactccttggatggtaacagaccttgaggacagtcgcccgggacaggagattaacactgagaaggccgtgccggtgttcaggaggaagtcaatttcctggccctcgatggttatacatacccagggctcagtgagggtgatgacatgagctggcgcttgccccgggcaccctcagtcctgttgttggatcatctggttgggggcttgtggcccagaggacctttgtcctctggggtagtgcaccttccagtgattgccttggcataatggacataagtgaaggggcagctcgtttctcattggacactcttttaaagtgtccttgcaaaccacactggtaacaagccctaccaggtaattggcatgctccattttctgtcctctctgaaccaccaaggttggtttgtctgagtgccatgactaaggctgcagcctttctctgatctcacttttccttttgggcctgttcctcttggtccctacaccgaggtagccaggtttaataatgcctccagattttgttcagggcccagggctcacttttggaactttctcctgatatctgcaactgattgggtaataaacttatcttttaggatcaattgaccctcgagtgagtcaggtgacaggggagtatattttcttaaggcttcccgtaaccgcgcgaggaaggcagaaggattttcttcctttccctgagttatggtggacatcattgaataattcatgggctttttcctaattctccttagtccttctagaacacaggtcaacagatgtttgtgattccagtccccatgatctgagtcaaggtcccagtggggatccatactggggatagcttgctgaccggtagggaatttgtccctttcttcagctgtcattctgtcatttacttcactaagataccaggtatctccaaactcttgggctgcagctaaagccgcattcttttcattaaaggccagggtttgatctaacaatagcatgacatctctccaagagagatcgagggtctgccctaaaccctgtaggacatctatatacctatcaggatcatctgaaatcttccccagatctaccttgatctgctttaaatcagagagggagaagtggacatgtacctgggttgggccaaattcccctccccctacagcttgaaggggacgtaaccgataacctgggggtttttgtggtcctttggagatttctttgcttgttttcttctgggcaggggagattaaaggaggcttctcattaataggaaggggagctatagggaggctaggatatggaggtaagctgagaggccctcctgtgggatgtaaattgcaagctttgcatagttgtgtattctccttcaatgaaaagaaagcttggacataagatatttcactccatttgccttcactcttacagaaaaggttaagctgcaggatagtattgtaatttatacttccctcagatggccatttttccccatcagagaatatcggggccaggccatagtgcagaaaaaaatgagccaccactttttcagggtttgcaggtcaaattggtcccaatggcttaggatgcatttcagggctgagcctgttgatgcctgagtgtttcccatctgaaagacaaaaccgcccatggttttggtttgtttgtttctacccccagtccaagaacccccaatggtccctggaccctgctgattggaatattgcactcaccgacgcagcagcagaaacagtagttttcctcctagaccacaaggaggactgaggaagatcagatttagtggcccttactgacacattctcgaaaacctgcacccttgcctgtcttcctagatcacaaagcggactgagaaaaatcagatttagtggcccttaccaatgcattcttgaaaacctgttagagtcctaagcattctcctgttagtactgggactttgccccgtcctataaagatgttatgcccccaaaatgaaatggagggccataccctgagggaggggagggatttccagggttggtagagtgacaccttttatcctcacttgaataggaaggatatcatttctgaagctccccatatcctagcttcaggaatagcttttgttaggcctgctagtctgaggagggatcctaaaattccagatagtcccccctacgacggagctttgggcaaaaattatgtctttcttattggtgagcccaggtgcctaaagaagggaatagagtcctggagtttatactagaaatcattattacaagagaaactagaaaagcaccagacaaggagtggtttttagaagcaggactagcctcggagaagagaggtgagagaaagtttatctgacaagcattaggacccaggaggcaagtgtcaggatagataggatagatgggtgagtctcccttgggtgacatgactttgagagttctactcacagccgcagggtcaaccaacttgttgtcgggaccccagaactgaatggctttcctctctgtcaacctttatctcagcccggaagtacaggaaaagcagaagctggttccaggcaaaccaatgctctccactccgaagagtcaggggttgttagagagccctttcctagaaagcctgacagccatgtctttagtccagcggccacgctagtcacttttaactggccgacaggtgcccggtatttagcccctgaattctaaggaaaaatagaacagaatagcaagcgaaaggggtctgatggtactcactgcttggtgaaggccccacattgggcgccaaaatgtgtccagaatgtattccttccagtgggttcttggtctcgcagacttcaggaatgaagctgtggaccttcgcgatgagtgttacagctcttaaagatggtatgtccggagtttgttccttcagacgtttagatgtctctggagtttcttccttccagtgggtttgtggtcttgctgacttcaggagtgaagccatggatctttgtggcgagtgtcacagctcttaaaggtggtgtggacccaaagagtgagcagcagcaagatttattgtgaagagcaaaagaacaaagtttccacagtgtggaaggagacctgagcgggttgcctttgctggctggggtggccagcttttactcccttatttggccctacccacatcctgctgattggtccattttacagagagatgactggtccattttacagagtgctgattgggccattttacagagtgctgattggtgcatttacaatcctatagctagacacagagtgctgattggtgcgtttttacagagtgctgattggtgcgtttacaatcctttagctagacacatagcgctgattggtgcgtttttacagagtgctgattgctgcatttacagtcctttagctagacacagagcactgattggtgcatttacaatcctctagctagacagaaaagttctcccaagtccccactagacccaggaagtccagctggcttcacctctcagttttatgctgcacaaaagctgtgagccttctgcctggggaaaccccgcaaaagttccaacgggtctgtggacccttgccagcggtgatgataggattacttccaggtagatctactttaaatttaaaaggagtgcaagtacaaacaggagtcattgattcagattacaatggggaaattcaaattgttatatctacttctgttccctggaaagcagagccaggagagcgcatagcacaacttctgattgtgccgtatgtagaaatggggaaagtgaaattaaatgaacaggattatttggaagcacagataaggcaaagcagcttattgggtgaatcaaattactgataaacatcatacctgtgaaataactattcagggaaagaaatttaaaggtttagtagatacaggaatggacatttcaatcatttctcttcagcatggccgtcaacatggccaattcaacccacttaatttaacatagttggagttggtaaagcccctgaagtatatcaaagtagttatattttgcattgtgaagggcctgatggacaacctgggactattcaaccaattataacttctgtacctataaatttatggggaagagatttattacaacgatggggagcacaagttctaattcctgagcagttttacagccctcaaagtcaacatatgatgcatgaaatagggtatgtccctggtatgggactaggagaaaatttgcaaggtttgaaggaaccgcttcaagtggaaagacaaagttcctgccaaggtttaggatatcatttttgatggcggacattgttaagcctcaagaacctatacctttaaaatggttaacagataagccaattttgatagaacaatggctgctaagtaaagagaaactggaggctttagagtacttacttactgaacaattagaaaaaggacacatagctccaacattttccctttggaattctccagtctttgttattaagaaaaaatcaggtaaatggagaatgttaactgattaattcagttacacgacctatggggacattacagccaggattgccttctcctgctatgattccgaaaaactggcctttaatagtcatagatttaaaagactgtttctttactaccccttagctgagcaagactgtgaatggtttgcatttacaattcctgcagtaaacaacctgcagcctgctaagcattttcactggaaagtgttgtcacaagtcatgttaaacagtccaacaatttgccggacttatgtagggcaagcaattgaacctacttgtaaaaaattttcacagtgttacattattcattatatggatgatatattttgtactgcccccactcaagaaatattgctccaatgttatgaccacttgcaaaattcgatttctcacactggtttatttatagcttctgacaaaattcagactaatactccttactcctacttggcgaccttggtaaatgacactactattgtgccacagaaagtaaccatatgtagggatcaattgaaaacataaaatgactttcaaaaattactaggggacattaattggatacaacctgttctaggcattcctacctatgccatgagtaatctattttctatctttagaggaggtcctagtctcactagccctcaacaattaacaaaggaggctgaggcagagttacagctgattgaaaagcaagtccataaggctcaaataaatagaatagatacagagaagactctagatttgctaatttttccagctcatcattcacctactgatgttattgcccaacagcaggacttagtagaatggctttttcttccaaatactaattcacagactctaacttcttatttggatcaaatcgctactatgataggaaatgggagaacttggattgttaaattacatggatatgatcttggaaaaattattgtccctctcacgaaggcacaaatacagcaagcttttataaatagtcttacttggcaaacccatttagctgactttgtgagtattctcgataatcattttcctaaaacaaaactgtttccatttttgaaattaactaattggattctccctaaaataacgaaatttaaaccaattgaaggtgctgagaatgtttttacagatgggtctacaaatggtaaagcttcttattctggcttgaaaggtaaagtttttcagatgccttatacttcagctcaaaaagtggagcttgtagctgtaattgaggtattgactgtttttgatatgcctattaatgtgattttggattcttcatggttcattccacacaattaattgaaaatgtgcagttaatgatttcatacagatgaacaactgatgacttcatttgcccaattgcaaacagcagttaggagtagaatgcaccctttttacattactcatattagggctcatatgcctcttccaggacctttaactgaaggaaatcaaatggctgattgcctagttgctactgcaatatctaatgccaaacattttcacaatttaacccttgttaatgcctctggtctcaaacgcagatacagcattacctggaaagaagctaaagctatcatccagcgatgcccaacttgccaaatggtgcattcctcatcttttacaggaggaattaatcctcaaggattggaacctaattctctttggcaaatggatgtcacacatgttccgtcgtttgggagactagcttatgtacatgtatgcgtggacaccttttcttactttgggctacatgccaatcaggagagtcttctgcctgtgttaaatgtcaccttttgcagtgttttgcagtgatggatattccagcttctattaaaacagataatgccccaggctgtactagccaagctctagctacatttttctctctatggaatattaaacacattactgacattccatataattctcaaggacaagccatagtagaaaggatgaatctctccctgaaacagtagtggcaaaagcaaaaggggagaaacagggactacaggacaccccatatacaattgaatctagcatgattgactttaaatttttggagcctgcctaaaggccagatgctatcagcagctgaacagcatctacagaaaccagctacaaagacagaagcagaacaactggtttggtggagagatctgataacaaaaagttggtaaataggtaaaataataacttggggtagtggttatgcttgtgtttctccaagacggaatcaacagccaatttgggtgccatcaagacatttaaagccttaactatgagccagatacccaggaaaaggttttgggaggatcccaaagacccaccagttgcagccatgttgagactgatgctgaggagaaccccaactgtcacaagcaacacccatcgaacacagccacctacctggggacagatcaagaagctgtcacagatggtggaagaaaaccttaggaaagcaggacaaccagtcacaattgtaatttaatgatagttatgatagcggtgatcaccattgccatgagtattccttcaacaagggctgacacagagaacaattatatttattgggcgtatttatcaatcttggctggcaataacgcctggatgtaatgactctatgacacatttacacatgctttctggtctcagtatttaccataataaatctgctcctataattgaggcatacagccctcaaaaacctatttgtaaacagaattggacctggtcagaaataatgaatgtacttgtttgggaagattgcattgcagaataggcacaggtgctgcgtaacgattcctgtggaatcgttattgattggtcccctaagggaccaagcttgaattgcacctctcagtcagcgtgccacggccacactatgttcagctggtttaaacaaaacggtcagatggtagaaattgtaagaaatatggcaagagttcctgttatctggaaacatggcagtatagtggcacttcaccctcaaatgttatggcctgctgtaggagctaaacataaggatttgtggaaactattaatggctcttaaataagattgaaatttggaaaagaataaaaaagcatctagaaggacactctacaaacttgtctttggatgttgcaaaattaaaagaacaaatatttaaagcatcccaggcacacctgaccttaatgccaggaactggagggtttgaaggagcatcagacagattagcagctattaacccattgaaatagataaagacacttggaggccctgtgatttcaatgatgattgtgcttttaatctgtgttgtttgtctttgtatagtctgcagatgcagatcccaactcctgcgagaagtagctcaccatgacaaagctacctttgcttttatcgttttgcaaaacaaaaaagggggacatgttgggaacaggcccccaaatctggccataaacaggccccaaaactggccataaacaaaatctctgcagcactgtgacatgttcattatggccatgatgcccatgctgaaggttgtgggtttaccagaatgagggcaaggaacacttggcccaccgagggcggaaaaccacttccaggcattcctaaaccacaaacaatagcatgagcaatccgtaccttaaggacatgttcctgctgcagataactagccagagcccatccatttgtttcggcccatccctttgtttcccataaggaatacttttagttaatctataatctatagaaataatgcttatcactggcttgttgtcaataaatatgtgggtcaaactctgttcggggctgagaaaaaaaaggaaaagcatgctttctcaggttatgcaacagttaagtaacacaaattgttacacagatgtcttttgttgttgttttttttttttttttttttttggtttttttgacggagtcactctctcaccaggctggagtgcagtgtggcacaatcttatctcactgcaacctccagctccctggttcaagtgattctcctgcctcagcctcctgattaggtgggactgtacaggcacacaccgccatgcccagctaattttttttttttaattttagtagagatgagatttcacagtgttgcccaggctggtctcgaactcctgagctcaggtagtctgcccacctcggcctcccaaagtgctaggattacaggcatgagccaccacgcccaggctctggtgtccctttttataaggacaccaatcctatcataagaaccctaccttcatgacttcatctaaccctcattacctccttaaggacccatctccaaatactatcacatcagggttgttacaatgataccatcatagcaacatatgaatttgtgggggacacatccagtccataacaaggcctatctgtgattgttttattatgcctccttctctcccttcagccctgctctgttccttccctgtaggcacacacactaaaattaatgtgtaccctccaattactttctatacactcagttacataattgtttggtgtgtataatgtaggtttaaaaatttacataaatgaactgtaatagagttaattctttttttttttttgagactgagtctcactgtatcacccaggctggagtgcagtggcacaatctcggctcactgcaacctctgcctcccgggttccagtgattcttctgcctcagcctcccaagtagctgggattacaggtgtctgccaccatacccagctaatttttgtatttttagtagagacagggtttcaccatgttggtcaggctggtctcgaactcctaaccttgtgatctgcccacctcgcctcccaaagtgctagctaggattacaggcgtgagccaccgtgcctggccaagttcatccaatttttaccttttcttgtactcaaaactatgtttttgagaagtctcaaaatcccatgtgattatatataaatcttttttttttttttttgaggagtcttactctgttgcccaggctggagtgcagtggtgcaaatttggctgactacaagctccgcctcctgggttcatgccattctcctgtctcagcctcccaagtagctgggattacaggcacccaccatcaggcctggctaatttttttgtattttttagtagagatggggtttcaccatgttagccaggatggtctcgatctcctgacctcatgatccaccctcctcggcctcccaaagtgctgggattacaggcgtgagccaccgcacccggccgattatatataaatctaacttaatgcttctggctgctgaatcagctaatgcatgtaccttattttatttatctattttaatgatgaacagattgatcttttaaaaagataacattcttggctgggtgcaatggctcatgactgtcatcccagcactttgggagcctgaggtgagcagattacctgaggtcaggagttcgagagaccagcctggccaacatggtgaaaccccatctctattaaaaatacaaaaattgaccacatgtggtggcagatgcctgtaatcccagctactcaggaggctgaggcaggagaatggcttgaacccgggaggtggaggttgcagtgggccaagattgcaccactgcatgccagcctgggcaacagagtgagactctgtctcaaaaaaaaaaaaaaaaagataacattcttggccctgcacggtggctcacacctgtaatcccagcaatttgggaggctgagatgggcgaatcacctgaggtcaggagttcaagaccagcctggtcaacatggtgaaaccccatctcaactataaatacaaaaattagcctggtgtggtagcacatacctgtagtcctagctacccaggaggctgaggctgcagtgagccgagatcatgccactgcactccagcctgggcgacagagtaggatcctgtctcaaaacaataaaataaaatgataacattcttttaatctctacaattttatgaactgtaatttccaatatggtgttgtagcccagaatgctgttatacaaagaatgatgatgtcaatcctttctgtttgagtttccatctggttgttcccagatagtaataaaaatgtgtggtattcagaatttccttgtgtttcattgtactgacaatatacaggggacttgaaggtcagaacaagctatcattctgcccaaaatgttctgaaatggacagctgtgaactatgatttcatttgttcaggatatttgtctatttgatacacttttttttgctaaatttcaggaacaagaagtcatccaactggaataataatcaaaatgattattccagtctcagtgattcccagttcctctttggatctcagttctgtccagaaaattcagaaaccctatcagcacccttggactttggtgcccacttgagacattcaaaacagtcacaacagaactatctggaggtgagtctggtttccagaattgatctgcacacatttcacagtcattatggagataaactataaagaatacttattctggccaggtgcaatggctgacacctgtaatccctgcacttggggaggctgaggcaagtggatcccttgagcccaggagtttgagaccagcctgggcaacatggcaaaaccccatctctacaaaaagtacaaaaattagctgagtgtggtggctgaggcaggaggattgcttgagcccaggaagtcaaggctgcagtgacccatgattctgccagtgtactccagcctgggtgacagagtgagaacctgtctcaaaaaaaaaacaaacaaggccaggtgttgtggctcatgcctgtaatgccagcaatttgggaggccgaggcaggtggatcacaaggtcaggagttcaagaccagcctggccaagatggtggaaccccgcctctactaaaaatacaaaaattagccgggtgtggtggcaggcgcctgtaatcccagctactcgggaggctgaggcagagaatcgcttgaactcaggaggtagaggttgcagtgagccgagatcaaaccactgaactctatcctgggagatagagcatgactctgtctcaaaacaaacaaacaaaacaaaaaaacccgacaaccaatacttagtttctagccttaaaaaaattacttattctgttggaatatgttttagaattgtacatctgtaaggattactctcctaaagggatttgtgcttgattagtgactcatttgacttaatagtctgaaatggcaacatttatatttgcggtttcttctattacaaagcaacgtaaaatagtgtcaattccttgaccaatcctagggagaggcaaatatatatacatatatatttgcctaaggctagtcatactattgtttgtgagaatttataagtaaaaatagttttcataaaatagaaataaaataacaaattttattttagacagacttttttaaataataaacttcatgtaatctgtatactttagtcaactatactacattatgtccttgaagaagaaggagatgaggattctgaggcctaggttagtgagtaaaggccagaatgaggaacagagtctcttgaatccttgatgttttgagattaacctgtcttttcctttttttttttttttttttttttttttttttgagacagagtcttgctctgtcacctgggccgaggtccagtggcatgatctcagttcactgactgcaaacttcgccttccaggttcaagtaattctcctgtctcagcctccctagtagctgggattataggtgtgtgccaccacacacggctgatttttgcgtttttagtagagacagtgtttctccatgttggcgggctagtcttgagctcctaacctcagatgatctgctcacctcagctgcccaaagtgctgggattacaggtgtgagccaccatgcccagcctgattctttgagatcaatctgtgttttcttgtgagtcaaaaacattttgattttggaggcacctataactaaatgtagttttgttttgttttgttttgttttgtttttgagacagagtttttccctctgtcacccaggctgtagtgcagtggtgctgtggcaggaatcagaggaccagagagaccaaatggataaaacaggaggattttattaaggtgtgcaccggctcagcggattcgcatccaaaaggctgagacctgaacagaaacagggcttgacttttatacacatttctgaaaggggattggccagtttgaatggcgtggagggaatttggtggcatgaagtgtatagtgcaggcaagtgggcatacagaagcagaacaaaggcagttaatcaaacagtgacaggtttcatcatcctagcatagctcgtgacctcgcagctgcattggaaggaaaacaggaacttatcaaactaaagcaggctttgcatctggtacatatcttactcaagctcgtcttgtgaccttgtcatgttgcacagaagagaaacaggaattgtaaaactctgtgaagtaaccttgagtatcactaaggaaggattatcaaaggggagggggaagttgggaaaagagaaaaacctgctttcccaccctcgcctgggaatgggaggagaggggactctggagcacattccttgagggctctggttttgcacatagtgttatcaaagccctgccagagctctgctgcctattgctaggtcttggagtgagtcagcccagcaagagaaaacttgtttttctctttacatctcctgcttcagtgtgatctcagctcactgcaacctctgcctcctgggtgcaagcaattatcatgcctcagcctcctgagtggctgggattataggcgcctgcccccatgcccagctaatttttgtatttttagtagagacagggtttcactgtgttggctaggctggtctcaaactcctgacctcaagtgatccacctgcattggcctcccaaagtgctgggattacaggtgtgagctaccatgcctggccacaccaagctaatttttttctttttttttttgagagggagcctcactgttgccagactggagtgcagtggcatgatctcagctcactacaacctctgcctcccgggttcaagcgattctcctgcctcagtctcctgagtagatgggactatgggcgtgcaccaccacgcccagctaatttttgtatttttagtagagacaggatttcaccatgtcagccaggatggtctcaatctcctgacctcatgacccacctgcctcagcctcccaaagttctgggattacaggcgtgagcccccgtgcccagctgcaccagctaatttttatattttttgtagggatggggtttagccatgttgcccaggctggtcttgaactcctgggctcaagggattttttttttttttttgagacggagttttgctctggttgcccagactggagtgcaatggtacgatctcggctcaccacaacctctgccttccaggtttaagcaattctcctgcctcagtctcctgagtagctgggattacaggcatgcgcaccacgcctggctaattttgtatttttagtagagacggggtttctccatgttggtcaggctgttcttgaactccccacctcaggtgatctgcccacttcggcctcccaaagtgctgggattataggcgtaagccactgtgcccagcctgggctcaagttttatatataaacttacatgcatcaaatagggacttaacaaataagattaagttggtgcttttttttcttttcttttcttttcttttcttttgagacagagtcgcactctgtcacccgggctagagtgcagtggcacgatcttggctcactgcaacctcctcttcccaggttcaagagattctcctgcctcagcctcccgagtagctgtgattacaggtgtgtgccaccacgcccagctaatttttgtttttgtttttgtttctgttttgagacggagtttcactcttgtcgcccaggctggaatgcagtggtgcaatcttggctcactgcaacctcctccttctgtgttaaagcaattctcctgcctcagcctcctgagtagttgggattacaggcgcctgccagcatgcccggctaattttttgtattttagtagagacagggtttcgccaagttgagcaggctggtctcaaactcctgacctcaggtgatccgcccgcctcggcctcccaaagtgctgggattacaggcatgagccaccacacccgaccaatttttgtatttctagtagtgacggggtttcatcacattggtcaggttggtctcaaactcctgaccttgtgatccacccacctcggcctcccaaacaaagtgttgggagtacaggggtgagccaccatgcccagccagtcggtgctttaagttagtaaagtatgctctgaaataagtatttcagtacaaaaattggtatctagtgatatgaaggaataaatgacctccctgaatgtttcagaattttgccaaagaatgcagaaagtggctcaccatttgtcagcatgcccactgtccagtccacatcaaacttaccaatatgagttcagttcactagcagctgagcaacagcaatttgagttaaaattatgattatgaaaactttaacacatcatgtcagaaatagcataaatggttctctgttcttgcctttaaatttatgcaattgattctaagctattttggttgacatttaaaatatctctgggctggtaaggcaaaaatctatattaataaaaacagttgctttattttaaatataattttctggtgtatacaaagataaaatggaaatactacttgctatgttacgttacagcaatatggtttgcacttaaatgtgactctgcattgtacagaaaatagtgaatgctataaatatttttatgtgtgaaatgctatatatttttttcatttaacagggtgaacctagcattttcacaaagtaccagacaaagccccagctgttcggaggagatataaaagatggaggtttatttcctcctcctttgtcagttggaaaatcaaaaggcctcttggaacagtttgaggagaaaaagaaaagggcaaaagacaaatgtgacaggtatgtaaacctttcaaatggatgaaagaactcaccttttctgagtaaaacaagacatagagtgtcagtaattaaataattcaattttagcataatagcatgtattagagttctccagagaaaccaaaccataggacttacacacacatacacacacacacacacacacacagacacacaaacagacacacagagaaagagggagaaagagaaagagggagagagagaattatagattgattttttttttttgacggagtcttgctctgtcgccaggctggagtgcagtggcacaatcttggctcactgcaacctctgcctcccaggttcaagcgattctcctgcctcagcctcctgagtagctgggactacaggcgcctgccaccatgcctggctaatttttgtatttttagtagagacagggttttaccatgttggccaggctggtcacaaactcctgacctcagttgatccacccatctcagcctcccaaaatgctggaattataggcgtgagccactgtgcctggccattattattattattatttattttattattatttttttctgagatggagtttcactcttgttgtccagactggagtgcaatggcacaatctcggctcactgaaacatccgcctcctgggttcaagtgattctcctgccacagcctcccgagtagctgggatcacaagcgcatgccagcatgcccagctcatttttgtattttcagtagagacggggttcgccatgttggccaggctggtcacgaactcctgacctcaggtgatctgcccacttcggcctcccaaagtgctggcattacaagcatgagccaccgcagtcttcccaccttagcttcccaagtagcttcgatcagaggcacacacagctgtggccacctaatttttttttttcagagatagtgtctcactatgttgtccaggctggtcttgaactcctgggctcaagcagtcgtcccacctcgacctctcaaagtgctgggattacaggcatgagccaccatacccagcctcctagttattcttaattgccttcttgtcaatatgatttgtggtagatttacataccacaatttttttctctctgaaaaataaaaactagaggatttctaagagaaatgtaatattcaagtaatgttacacttatttttcctaaacatctgccccctgatttttcttttcagatcatcaggattaggaagttggacaacattatttattttagagtctagaatagaatgtggccaggcacggtggcgggtgcctgtaatcccagctactcaggaggctgagacaggagaatcacttgaacccaggaggcggaggttgcagggagcctagattgcaccattgcactacagcctgggagacaagagtgaaactccatctcaaacaaacaagcaaaaaaacaacaacaacaacaaaaaagaatagaatgcatgaaatcgtttaaattttacattcaaaaacttttttgaatttttttaaacttttattttaggttcaggggtatatgtgcaggtttgttacataggtagactcttgtcacagatgtttgttgtacagattatttcatcacccaggtactaagcatagtacccaatagctatttttttttctgatcctttccctcctccacccttcacctcaactaggccccagtgtctgttgatcttctgttcatgtccatgagttttcatcatacaatgcatgaattctttggcttttgttttgttttgtttattgagatggagtctcactctgttgcccaggctggagtatagtggcaagatcttggctcactgtaacctctgccgcctgggttcaagcgattcaagtgccccagcctcccaagtagctgggaccacaggcgcgtgacaccatgcccagctaatatttttgtatttttagtagagacggggtttcagcatgttggccaggctggtctcaaactcctgacctcaggtgatccaccggcctcagcctcccaaagtgatgggattacaggtgtaagccaccatgcccagcccatgtgtgagtctttttttaagaactggatgtggccaggcgcggtggctcacggctgtaatcccagcactttgggagaccgaggcaggcggatcacgaggtcaggagattgagaccatccttgctaacacgatgaaaccccgtctctactaaaaattcaaaaaattagccgggcgtggtggcgggagcctgtagtcccagctacttgggaggctgaggcaggagaatggtgtgaatccaggaggcagagcttgcagtgagccgagatcgtgccactgcactccagcctgggtgacggagcgagactctgtctcaaaaaaaaaaaaaaaaaaaaagagtagtatgtatagttgaggaataactgtgatagcttctttttcattagaaatgaatattttcatattaatatttacatataaatatgtatatgaatatggattttaaaaagaaaaatgcgatttgccttagcagtggtcataggaagtctgtgttctctcttttttttttttttaactttttattttattttgaggtggagtctcgctctgtctcccaggctggagtgcagtggcatgatcttggctcactgcaacctccgcctcccaggttcaaggaattctcctgtctcagcctccccagtagctggaattacaggtgcccaccaccacgcctggctaatttttgtatttttagtagagacggggtttcactgtcttggccaggctggtcttgaactcctgaccttgtgatccacctgccttagcctcccaagatgctgggactctctttttttttccctgctgggcactaaggtttctcagggtcaagtcttcagatctaatcaagcaatgttttgatgctatgctaggtagagatctgccatatttatggaatcatttatgttacttatcacttcaatatttcataaagatttgttttcttttttccctcctattctagtgagactctatacaactttgtttctaatgttagagaaagcattctcagggtaagtacagatacttttcaaggagttagaacatcttatattttaagaagtttaatatttatattgtattggctttagttaatgtagaatagcaatattttaactatccctatttatcatgaaatgacaattctctaagatagtagaataaggcaatagcctgtgaattatttcataattttgggtttcttagttgcagacgtctgtggaaaagtctgaggaccatctcagttcaagaagccaatctattttggattctttggagactgtggccaagacatgtgagtgcctcatgtttgaggtatcagcagagggcactggtgaatgatgaacatgaactttctgaccccagcctggtttccagtggtgaggttcctcacagggtttcagatgagaggatgggtatatagggttagtcctgaagagatgtggagcacactgagctgggtagtgaggcccacctctatgtgacaatgctctggtcccatgatgccttttgtgaggcactaatcccccacctggtaaccatgttgcctcagggcaggtagctctgctaggtttctcatctcactgcctgaagtgagtcagcaacatccttgagtctcaaattgctgcctgtgctgtctatagacactgactgcccccttaggagttagaaatactgtagtacctgctgctcttcttgctgccttggtttcagtgagagctgtgttgtgaatcacagcatcattctcaattttttttttttttttgagacagagtctcgctctgtcacccaggctggagtgcagtggcgcaatctcggctcactgcaagctccgcctcccgggttcacgccattctcctgcctcagcctcctaagtagctgggactacaggcgtctgccaccacggctggctaatttttaaaatttttagtagagacggggtttcactgtgttagccaggatggtctccatctcctgacctcgtgatctgcccgcctcagcctcccaaagtgctgggattacaggcatgagccaccacgcccagccccattctcaattttacttatagtttgtggtttataaaatcctgtgctccaccaattagtggtttacatttagatgaaaccatggcccttgccctataaacagaagagagtaaatatacagttctccttgggtgaatacttctctagaaccacctgtttcctagcaaaacgatgagctgatgactatgcatctgtacttgtttgcatttgtctgtgtgtttattttataaacaagttgaaatcaacttacacaaatgccatggggtggactgctcataatttacaaaaattaatgcctttttgtggcctaaaaattaatccccaactgtctgcatagaagcactgtactgtctgctggatttcaacctgggcatcccacacacagggcatatgcatctgtttagaaacttgttctggggccgggcacagtggctcccacttgtaatcctagcactttgggaggccgaggcgggcagatcacaaggtcaggagttcaagtctggcctgtctaatatggtgaaaccccatctctactaaaaatacaaaaattagctgggtgtggtggtgggcgcctgtagtcccagctactcgggaggctgaggcagaagaactgcttgaatctgggaggcggaggtggcagtgagctgagatggcgccactgcactccagcctggacgacagagcgagactccgtcaaaaaaaaaaaaaaaaaaaaaaacttgttctggaagccttgaaactgttaaccccacaagaagtagcaagacagacggcagaagcaaatcagggatgcttcctttgtataacatgatagagtaagtcatttataagtacccaaggaaagtactctgtttttgttttacatttaaaactgggtgggccgggcacagtggctcatgcctataatcccagcactttgggaggctaaggcgggaggatcacttgaggccaggagttcgagaccagcctggccaaaatgacgaaagcccgtctctactaaaaatgcaaaaaaaattagccaggcgtggtggcagacacctgtaatcccagctacttgggaggctgaggcaggagaatcgcttgaacccaggaggcagaggttgcagtgagctgagatcgtgccactgtactccagcctgaacaacagagtgaaactccctgtatcaaataataataataataataaaactgggtgaagtacaaaaaaggaggattgcagcaaaagtatggcgtttaaatcccagaaaagggaaaggaagtgcctgaggccccaacacaagatcaaggcagagaaagaactaaaactgcatctggcttagagtaggcaaagggatccattccttaattttcttttgcttttctttttttcttttctttttttttttttgagacgaactctcactcttgtcccccaggctggagtgcgatggcgcgaacttgtgcaacctctgcctcccaggttcaagcgattctcctgcctcagtctcctgagtagctgggattacaggtgcctgccaccatgcctggctaatttttgtatttttagtagagacggggtttcaccatgttggccaggctggtctcgaactcctaatatcaggtgatctgcccacctcggcctcccaaagtgctgggattacaggcgtgagctaccgcgcctggcaggttccttaattttcaaagggtaagactcagaagagaggccgggcgtggtggctcctgcctataatcccagcactttgtgtttttgtttttgtttttttgagatggagtctcgctctgtcacccaggctggagtgcagtagcacgatctcggttcactgcaacctcttcctcccgggttcaagccagtctcctgcatgagtctctcctgcaccagtctcatgcaggtgcatgccaccacacctggctatttttttgtatttttactagagacaaggtttcatcatgttggccaggctggttttgaactcctgacctcaggtgatcagcctgtttcggcctcccaaagtgctgggattataggcgtgagacaccacgcccagcctaatcccagcactttgggaggccaaggtgggtggattgcttgagtccaggagtttgagaccagcctgggaaacataaggagactttgtgtctacaaaaaataaacaaaaccagcagggcatgggacatatgcctgtagtcccaggtactagggagggtgaggtgggaggatcgcttgagtctgggacgtcgaagctgctgtgagccaagatggtgccactgcactccagcctgggagctagagcaagaccctgtctctaaacactaaaactaaaactaaataaataaaatgaaaaaaaaaaatagattcaagggtgggcgtggtggttcatgtctgtaattccagcactttgggaggccaaggcaggtgaatcacttgaggtcaagagtttgagaccagtctgtccaacatggtgaaaacccgtctctactaaaaatacataaattagccatgcgtgatggctggagcctgtaattccagctacttgggaggctgagacaggagaatcgtttgaacctgggaggtggaggttgtagtgagccgagatggcgccactgcactccagcctggacgatagagtgagactccatctcaaaaaaaaaaaaaaaaggccaggtgtggtggctcacgcctgtaatcccagcactttgggaggccaaggcgggcagatcacggggtcaggagatcaagaccatcttggctaacacggtgaaaccccatgtctactaaaaatacaaaaaattagctgggcgtggtggcgggcacctgtagtcccagctactcaggaggctgaggcagaatgacgtgaacccaggatggggaggttgcagtgagccgagatcctgccactgcactccagcctgggcgatagaaccagactctctcaaaaacaaaacaaaacaaaacaaaacaaaagcccaggcacagtgactcacacttgtaatcccagcactttgggaggccgaggtgggtggatcacttgaggtcaggagtttgagaccagcctgaccaatatggtgaaaacccatctctactaaaaaaaaaatacaaaattagccaggcgtgctggtgcaggcctttaatcctagctacttgggaggcaggagaatcacttgaacctgggaggcagaggtttcagtgagctgagattgcgccatagcactccagcctgggcaacaagagcgaaactctgtctcaaaaaagaaaaagaaagaaaaaagactcagtaacagacacagcagtatcacatgaattaggacaggtcattcttgaaaatgagcacaagtagcctatccagaataattctctttcttggtaggaaatgatgatgagcagaaaattaatcattgagagaggaaccagacaaatcctctagcatatggccaggtccagtccagctattctagagcattgaactccacctcagtgcattctgcaagctttcagtctctactcatgtgctcatcagggaatagggaagtaaagatactgtgtgaaagtgctgtctgtgttgttatgtaattggtgccttcacagatgaggtcattaaatattttcccagtcagcctgcccagccagaagggtcactgtggccatctaatctaactcttcctgttcttcagctgaggacactaaggaccacagtaataaagttaattaccaaagcctcttgtatactactttacctcatatgttaagtctggtgataaattataaaaagaactagaagaaaacatggacaacatttttttttttttgagatggagtttcgctctgtcacccaggctgaagtgcagtggcgtgatcttggctcactgcagcctctgcctcccgggttcaagcgattctcctgcctcagcctcccaagtagctgggactataggcacacaccaccacgcccagctaaattttatatttttagtagagacaaggtttcaccatgttagccaggatggtctcaaactcttgacctcatatccacctacctcagcctcccaaagtgctgagattataggtgtaagccaccacgcccggccatggacaacatttttataattttagaatgggaaaagcctttctaagcaaaatagatataattgttaagaagagtgagatccatctatatgaatatggtagaatggaaatatctgttcattgttaaattaaaacaacaaaaaggtgctcttcgcgtgctccaggatacatcttgttggaaagtgtgaccagccagtgaaaactgggaagagtatccctaaaaaagttggaggtggtctcatcttatacaaggaggctgccagatcttttgttaggctctcatcagcacctgagggagaataaaactacagagtaaaaggaaaatcactggccatccggggaaaagcttgcatcacaatctgatctcatctcaattgaggccttaccaagttgctaaaataaaaacaaattgtttaaaaatcatcttaacaggaaaacagatattgtccagaatatggaaatggattttaaatggcatttttacataaaagctaaaaatatctaatgtttatagtcaaagcaaaaatgaaataaatactcttctagacacacatacacaaacaaacacaggacctataatgtatatacagatatgcacacgtattaatgtaaaattccagaaaccgatgataatgttaaatccaggaagagagaccaaggtttgcagaggagagattcaatcatttttcaatgtatgcctttttatactattatggttttcagttattttcataactaaatttttttaaaagaaaaaatatggatagactttgaatgtaatgagtttgatacaaaagctcctataaaagagaagacgccaaacatatgttgccctggggacaagaactgaatgtatgggacctcagatggatgctttctgagcacttaatccagaatcaaacactttgcttgcctttctcatgctctgcttttgtgagggtcagtaatgcccactgttgctaagaaacattactatttaggaacttctctatggaaggataattacatttgctctctactataaatatctacatggatgtctgaagaatatttgactaattgggtttaggagcaggaatccaatacctaagtaaatagcctctttctaattgattgacacatggaattgaacttgtacctgtggtgagaaatatgggaaaatttgctttctaaaaaattctttgggccagacacagcagctcacgcctgtaatcccagcactttgggaggccgaggcgggcagatcacaagatcagaagtaggagaccagcctgaccaacatggtaaaaccccgtctctactacaaatacaaaaattagccgggcgtggtggcgcatgcctccagctactcaggaggctgaggcaggagaatcgcttgaaccctggaggcagaggttgcggtgagccaagatcgcgccactgcactccagcctgggcgacagagtaagactccatctcaaaaaaataaaaaaactatgctagattaaattgtttcatgttagtttagcggttccattttcacgtctcaatatattttacttagtttttgtttgttggttggttggtttgttttgagacagagtctctctctgtcacacaggctggagtgcagtggtgcgatctcagctcactgcaacctccccttcctaggttcaagcagttctcctgtctcagcctcctgagtagctgggactacaggcacatgccaccatgcctggctaatttttttttttttttttgaggtggagtctctctctgtcgccaggctggagtgtagtggcacaatctcagctcactgcaacctctgcctcctgggttcaagtgtttctcctgcctcagcctcctgagtagctgggactacaggcgtgcatcaccatgcccagctaatttttgtatttttagtagagacggggttcaccatgttggccaggaaggtcttgatctccagaccttgtgatccgccagctttggcctccccaaagtgctgggattactggtgtgagctgctgcgctcagactttacttagttgttggtttttttgtctttttttttgagatggagttttgcttttgttgcccaggctggagtgcaatggcgcgatctcggctcaccgcaacctctgcctcccgggttcaagcgattctcctgcctcagcctcccgagtagctgggactacaggcatgcgacaccacgcactgctaatttttgtatttttagtagagacggggtttctccatgttggtcaggctgttctcaaactcctgatctcagctgatctgcccgcgtcggccacccgaagtgctgggattacgggcggagctaccgtgcctggcctacttagtttttatatcacgagattatatcaagagattctcctgcctcagcctcccgagtagctgggattacaggcatctgccgccacacccggctaattttgtatttttagtagaggccgggtttctccatgttggtcaggctggtctcgaactcccgacctcaggtgatccacccgcctcggcctcccaaagtgctgagattacaggcgtgagccaccacgccctgccaccaaattcatcttgtttgttcaattttttcccaactgcagggagactacagtaaacatttcccaaaacttcctgtgcaaaattgctgattcctactgttttcatgccattttctgttgttatccattagtgtttgtgaatttacacactgagggagtgaggcatatgcagtttccagaaggcagccagcattgccagtggggtggcacagccctggacccactttttaaaaattgtggtaaaaatacacataacataaaatgtaccatttcttactgcttttttcttttctttttttttatttttgagataggttctccctctgtcatcaaaactggagtgcagtggcacaatcacagctgactgtagctttgacctcctgggatcaagcaattctcccacctcagcctcccgagtagctaggaccacaggcacataccaccccacccagctaatttttatttttcattttgtagagacaggatctcactatgttgcccaggctggtctagaactcctgggcccaagcaatcctcccgcctcagtggcttcccaaagtgctgggattataggtgtgagccactgtgcccagcctgtttattattttttccctcttctagactgtagaattcggccgggcatggtggctcactcctgtaattccagcactttgggaggccgaggtgggcgaatcatgaagtcaagagatcgagatcatcctggccaacatggtggaccctgtctctactaaaaatacaaaaattagctgggcatggtgttgcgtgcctaaagtcccagctacttgggaggctgaggcaggagaattgcttgaacccagaggcagaggttgcagtgagctgagattgcactactgcactccagcctggcaatagaatgagactcagtctcaaaaaaaaaaaaaatcatgtaggtagacagttttgttcaaaattgttttccattctcctagcacagtgtctgacaataaactttcagataaaggtgtatatttcggccaggcatggtggcttatgcctgtaatcccagcactttgggaggctgaggcgggtggatcacctgaggtcaagagtttgagaccagcctggccaacatggcaaaaccccatctctattaaaatacaattaatagctgggcatggtggtgcatgcctgtaatcctagctactccggaggctgaggctggagaactgcttgaactcaggcggcagaggttgcagtgagctgagatcgtgccactgcactccagctaggcgacagaatgagattctgtctcaaaaaaagaaagaaagaaagaaaaaagaattcaagtccaccaatcttgccatggctcattcacccctctgtgtaactgtgacctgcctcccctcagctgtggcctgctcctgggccccttgctcaccatgtttcagccatgctgatctcaattcctctgtttggaacgtgctctttcttctgttggtaatattctttcccttacagttttatgacaattcagctaaatatcagtttcttagggaaatcttacccctgagagtgactaagtctacagttacatggtctcaagcacagtacgcttttcctttagagcagttattacatttatagttatttgtataattagtcattaactacctcctgttttccctaagattgcaatttcaagagggctttatttgtctttttttttttttttttttttttgagatgaagtctcgctctgtcacccaggctggagtgcaatggtgggatctcaactcactgcaacctctacctcccaggttcaagcaattctcatgcctcagccaaccaagtagctgggactacaggcacccgccgccacgcctggctcatttttgtatttttagtagagacagaatttcatcatgttggctaggctggtttcgaactcctgacctcaggtgatctgcccgcctcagcctgccaaagtgctgggattacaggcgtgagtctccacgcccagctagctttatctgtcttgataactgctatatccatagtgcctggcacatagtatatgctcattaaacattcgttgaataaatataaaagcatcttcatatgacctgtagtctagcaagaggatggcaataaattgcaacacaatgtgtcattaaataaatgtgtgtgtgtgtgtgtgcatgcagaatctcactgtgcaaaagaggaaaatcaatcagtcctgatgtagttagcacctaggtccccaagtctatttgggtccaagtgtaagtatgggataaataagtggagggcaataaatgatggtagggcacatacacggtgctacctgcagagagaagcaacaccctagccgagtggaaatggtattttctgaggaggtgactgctgaaagtagaaggaagaataggaattagctggactaaggtggtgattggttgcggggggcggggggaatgacagggacagaaacagggtacttgaagctaagggaagactttgcacaaaggccagtggtgagagagaaaacaagagtccagagacatggaggaggacaaatgggtaaagggaagtgagcccagatcttgttagccaatttaaagatttagattttgttcagtggccagtggggtgccatcgaaagtttcaacgggctgggcatggtggctcacgcctgtaatcccagcactttgggaggccgaggcgggcagatcaccggaggtcagaagttcaagaccagcctggccaacatagtgaaaccccatctctactaaaaatacaaaaattagcagggcatggtggcatgcgcatgtaatcccagctacttaggagctgaggcaggagaatcgctcaaacctaggagggggaagttgcagtgaaccaagatcgcatcactgcactccagtctgggtgacagagctagtctccgtctcaaaaaaaaaaaaagaaaaaaagtttcaatgaaggtttcagagggtgcattctactaagatcactctgatgagagggccaagaaggaaggccacagaagcttttgtgctgttgtctgggcaactgattctcagagtccccagcaggtgctgaggttgggtctgccctagccaggatcttgtcaaggagggagggaaggagagcctggaggaaccactccggtctgcatccagctcctcccttttcactgctgtggttctgtggtttgggcagatgggacataccatacatagtcttcaggaggtgaactgtcactgttttgtatttagtacaagagactatacaggcccagaatgacctggtgtttgaggcagtccaggacaaaggcaacatggagcaggccatccttgagatgaagaaaagatttgaagctgtaagtgtaaaccccaacctctttctaagtgtgttttgggctttgaactagacccagagagaaactttttttttttttttttttttgagacagagtctcgctttgtcgtgcggtggtgcaatctcagttcactgcaacctccgcctcccatgttcaagcaattctcctgcctcagcctcctgagtagctaggacttacaggtgtgcaccaccacgcccagctaatttttgtatttttagtagagagggggtttttcaccatgttggccaggatggtctcaatctcttgaccttgtgatccacctgccttagcctcccaaagtgctggggattacaggtgtgagtcactgcgcccggccgagaaacctttaaagttgcaaattttcagctaagacaagaggccagcacaggccacttggaaaggggccagcatatagactagcttccttccccaaggttccttgacatgatgtgggccccaggggttcaactcccgagtgtaattgtgcttaccctgagaggttccctacaaggagcaagccttggttctgctgtcacatccattggtctgttctcatgttttattgtgctttctgacttgcactgtccatcactgtctttctcactgcctctctccccagagacaaggagagtttatagaaatgaagtccaacctgaagcaccttgaagttttagttgctcagcagagtcaggaattccagcagctgtgtgagcagctaggccagctgaatgtgcccagtgtcctagcagagctgaagagattgatctcagtgcctccagtgaaagacagtgcttctcagacgtcgccacctttggcccagagcctcaatctcaccaggcaggaaaaatacacctctgagaaaccagttttatggcaggcccaggccctccctgctgcatggaatcctggtatgggctccctacagcctggagaatttgatgtctggggtgaaggagcaaagaatgatgatctccaagaagaggctgcactgccagcatttgggtcccatgaaagaaataggcatgtaaaggacaaggtggtgcagactaactgcaagaactgggctgttactaaaacaggtgccaagaaccatggttccagcgtcccaggccataagattcccagtgacagggacctggtttcccaaggagcctcacagctcacatcattggagataaacttttcaaccagcattaagaatgcctgccaaaaatatcaagcccaaagtatgtttttgtgtgacccacgtgaacatttggtgattaaacagaaagatgggactgtagaaatgcgggggaaagacaagaagcagcagcccaggaaggcccacagggcccacagaggcaggctcatagccagcaagcaaaaacaaatcccaatccagacctgtaaattcaattccaaatatcagagtcctcagcctgcaatttctgtccctcaaagccccttcctggggcagcaggaaccccgtgctcagcctctgcatctgcagtgtcccaggagccccagaaaaccagtctgccctattctgggaggaacagtcatgcccaataagacagtaagggcagtgcagggaagactcttgcagctcagcaggtgctcttcccaagacaactggctactttccagcagttcccagggggaccaccagatgagctggttcagtgacctcaatctcggatgttcagagacccctctatgcaaggaggcaggaaagaatttgctctatgacctgggttttgatagcagtgatgatgatggcttctgaccagtccacagttgatttattggtctcagctagaaagagaaattgcaggacatttgggctggccaacagcagaaagtccctgaagcctgccaagtacccagggtcagaggccctgctgaggtggggcaatgagcacgagggcagggaaggtccagcattctgggtaccaggtgctgcccctgacaaggattaagtgcatccttatttattggaatgaaatgtgaaaatggtgctgatgaaaactgaggcagcagcctggttgtggggcatctggagcagggtgcctgtactttggcgaaaggcaggcaggcctccttatggaatactgtgtagcagaagggctctcataaaactgttgcggtggcagcatgactccaaacaacatttttgggtctttaaaatattccctacacatgaccaatacattttcaggcctcaggatttttttctttcttatttttagccacttatgctaccagaatgtttgcattttttgatcagtagacatattacaggacaccctaaatcttcttgtgaacagagaaaataaaatgataagcctgccagtgaaagaggtgacattcactagcaaatgtccagagcatatcactgctcacaagccatttttcttcctggttgctttttcccttgtcctgtttttcaagcactttcttaaaactaataatattgtagaccttgtatttctgaagagcagtgggcttatatgggactttggctttccatttttatcttgctgaagtttttgagtttttgcaacacaagtattttttgttatcagaaataagataaaacatttaaaagcatatattttttttctttctttccacccccacccccaaccgagatggagtattgctctgtcacccaggctagagtgcagtggtgtgatctcagttcactgcaacctctgcctcctgggttcaagcaattctgcctcagcctcccaagtagctgggattacaggcgcccaccaccacacccagctaatttttgtatttttagtagagatgggagtgtcactatgttggccaggctggtctcgaactcctgacctcatgatctgcctgcctcagcctcacaaaatgctgggattacaggcatgagccactgcgcctggcctattttttctttcaagtttatcaaactgatgtcccggtttaattttttaagtttacttaggaaatgaaatagaagccaggcacacttgtaatcctagcacttggggaggctgaggcaggaggattgcttgaggccaggagctcaagactaacctgggcaacatggtgagaccccatctcttttttttttttttttttttttttttttttttattgagacagagtctcgctctgtcacccaggctggagtgcagtggctcgatctcggctcactgcaatgcaagctcctcctcccgggttcacaccattctcctgcctcagcctcccaagtagctgggattacaggtgcctgccaccacgcctggctaattttttgtatttttagtacagacagggtttcactgtgttagccaggatggtctcgatctcctgacctcgtgatccgcccgcctcggcctcccaaagtgctgggattacaggcgtgagccaccgcacccagcccttttgttttttgaggagtttcactcttgttgcccatgctggagtgcaatggcgtgatctcagctcactgcaacctccacctcccgggttcaagcgattctcctgcctcagcctcccaagtagctgggattacaggcatacgccaccacacctggctaattttgtatatttagtagagatggctttctccatattggtcaggctggtctcgaactcccgaccccaggtgatctgcccgcttcagcatcccaaagtgctgggattacagatgtgagccaccacgcccggcctgtgagaccctatctctaccaaaaaaaaaaaaaaaaaaaaattagctggacatggtggcgtgcacctgtggtctcagctacttggaaggctgagatgggaggatcacttgagcccaggagtttgaggttacagtgagctatgattgtgccactgcactccagcctgagtgacagaccaagaccttgtctcttaaaaattaaaatgagaggccgggcgcagtggctcatgcctgtaatcccagcactttgggaggccgaggtgggcggatcactaggtcaggagattgagaccatcctggctaacacagtgaaaccctgtctctactaaaaatacaaaaaaaaaaaattagccgggcgtggtggcaggtgcctgtagtcccagctacttgggaggctgaggcaggagaatggcgagaacccgggaggtggagcttgcagtgggccgagatcgtgccactgcactccatcctgagcgacagagtgaggcagagcttgcagtgggccgagatcgcaccactgcactccatcctgggcgacagagcgagactccatctcaaagaaaaaaaaaaaaaaggccgggcgcggtggctcacgcctgtaatcccagcactttgggaggccgaggcgggcggatcacgagatcaggagatcgagaacatcctggctaacatggtgaaaccctgtctctactaaaaacagaaaaagttagccaggcatggtcgcgggcgcctgttgtcccagctactcgggaggctgaggcaggagaatggcatgaacccgggaggcagagcttgcagtgagccaagatcgcaccactgcactccagcctgggtgacagagaaaaactccgtctcaaaaaaaaaaaaaaaaaaaaaatcagggccgggcgcagtggctaacgcctgtaatcccagcacttgggaggcccaggcgggtggatcaaaggtcaggagttcgagaccagcctggccaatatgcaatatggtgacaccccgtctctactaaaaatacaaaaattaggtgggtctggtggcacgtgcctgtagtcccagctgtcctggaggctgaggcagaagaatcacttgaacccgggagttaaaggttgcagtgagccgagatcatgccactgcactccagcctgggcgacagagtgagactctttctcaaaaataaaaaaaaaaaagaagatatgaaaatcagatacataccatctttttagttcctaaggctctcacaagattattttgaataaacaccacccattcaaactggtttttccctttcctgtattatatgaaggggaaaatcctcatgggatggatagtttccagaatttgcccatttccaagccagtacagtaaatgacactggggccgctgagtggaccactgtagaaagcaatggttcttgtttcttattttttacattattttcagggatgtgtgtcccatcaaagtctcattatggaggagttgaattttcccgggacacctgtggcagggctgccagacaccagcctaaactgctctcactctcatttccagaccaagggcctctggtggcctgtagggagccatgggcaatcacagcaaccctctctgaggccaaggaagttcaggtatgagctgtacctgaggctgccctggcctctcctctcccgtcagtcctcactgggtgtcttctcaccctgccctctgccagctccactgctttccctgctgggtttcattgcttgtgcaaggaagatacggaagccacacaatgggttggttctttctagcccttcccagactgactataggccagcggggtctgtatctagaaatcttttattactctaagttgaacagtttaatgattagtcattttaatttagagttgagattccattagtatttgactgtggccttcttattgagaactctgttcaactttgaaatgccaaagcaggagcctttgttctttgatcctgccgtgagttaagaaattctgtatttcttcagaagtgtttcattttgtgtaatgaagtcaagggttagagtgactcagtgttccatgagttaagtgtctttgtagaatgaacagtaaacttatctcctaataattctgcgttaattacaattacactgcctgtctctggggatcatcagaaaaagatactgtttcttaatttattcctaaggcttaaaaaaaaaagttaggccgggtgcagtgactcatgcctgtaatcccagcactttgggaggctgaggcaggtggatcatgagatcaggagatcaggatcatcctggctaacagggtgaaaccccatctctactaaaaatacaaaaaactagccgggcatggtgacaggagcctgtaatcccagctactcgggaggctgaggcaggagaatggcgtgaacccaagaggcggagtgacccgagatcacgccgctgcactccagcgtggacgacaaagcaagactccatctcaaaaaaaaaaaaaaaaattaactactgtgttcctgccaggtttggtgagggtgacacagcccaagcatccaagcatgtccctggaacaatcaacatctttggctcctcagatgttcctggaactgtatgtggctacccaggggcagatgtggtgggaggcctatgggcctgaggcccaaaaagccacacagggccaggcgtggtggctcacgcctgtaatcccagcactttgggaggctgagccgggcgaatcaacgaggtcaggagttcgagaccagcctggccaacatggtgaaaccccgtctctactaaaaatacaacaaattagctgggcatggtggcaggtgcctataatcccagctacttgggagactgggacaggagaatcacttgaacctgggaggcagaggttgcagtgagctgggatcgcgccacggcgctccagcctgggcaatagtgcaggactgtctcaaaaaaacaaaacaaacaaacaagccacccaagggcttctccctctgatacaactctggctacagcccaaggatggaaatgaagctgattgcagtacctaattttcttgacattcacaggtatctatctatctatttatttatttattattatttgagatggtgttttgctcttgtggcccaggctggagtgcaatggtgcaatcttagctcactgcaatttccgcctcccgggttcaagcaattctcctgcctcagcctccagagaaggtgggattacggcgcccgccaccacaccagctaatttttgtatttttagtagagatggggtttcaccacgttggccaggctagtctcgaactcctgacctcaggtgatctgcccaccttggcttccaaaatgctgggattataggcatgagccatcatgcccagccaatttctctttttcgtgtttttgcctcagaagctccaaagggctcctgttgaggggcctcctacaagatgctttctttcccaggtcagttcccagcaactcctctcacccaaagtgcccagaaaacagcctgtctactctcaaaaaagatagttgcagcctggcgcggtggctcatacctgtaatcccagcatttagggaggcagaagagggagaatctcttgagtccaagagtttgagaccagcctcagcaacacagtgagactctgcctctttttttttttttttttttttgagacggagtttcactcttgttgcccaggctggagtgcaatggtgcaatcttggctcactgcaacctctgcctcccaggttcaaacgattctcttgcctcagcctcccaagtagctgggattacaggcacccacaaccacacccagctaattttggtatttttggtagagatggggtttcactatgttggccaggctggcctcgaactcctgaccttgtgatctgcccacctcagcctcccaaagtgctgggattacaggcgtgagccaccacgccaggtctgactctgcctctattttaaaaaatggtagttgcttcctagaagttagttttgactttttttttgttttttttgagacagagtctcactttgttacccaggctggagtgcagtggtgcgatctcagctcactgcagcttcgacctcctggactcaagccatcttcttagcctccagagtagctgggattacaggcgcccgtcaccacacccagctaacttttgcatttttagaagaggcagggtttggccatgtgggccaggctggtctcaaactcctgacctccagtgatctgcttggctcagccttacaaagtactgggattacaggcgtgagccattaggcccagccacactgggctaatttttatattttttgtagggatggggtttcaccatgttgcccaggctggtcttgaacccctgggctcaagtgatcggccttactcagcctctcaaagtgctgggattacaggcatgagccaagcttatgccaggcctgaggccaaaactctttgtcaaatcaggcattttccagacagcctagaacacagagtccttccccactatggctgggatccactgtcaaatagatttcctgagtaaacctttgttccctctagatatttagttggaacctaaaatattaatattctcccacacattccaaggataatgcaaatagcctgagcctcatcttgtttctggatgacagagccttttttgtttaattttttttttttttttttttttgagacggagcctcgctctgtctcccaggctggagtgcagtggcgcaatctcagctcaccgcaacctctgcctcccgggttgaagaaattctctgcctcagcctcccgggttcaagaaattctctgcctcagcctcccaagtagctgggattacaggtgcctgtcaccgcgcccggctagtttttttttattttttagtagagatggagtttcaccttcttggccaggctggtcttgaacttctgatctcatgatccacccgccatggcctcccaaagtgctaggattacaggcatgagctaccgtgcccagcttttaattttttttataaaaatttttttaaaaagggccaggcacggtggctcacgcctataatcccagcattttgggaggttgaggtaggcggattgtttgaggtcgggagtttgagacaagcctgaccaacatggagaaaccccgtccctactaaaaatacaaaattagccgggcgtggtggtgcctgcctgtaataccagctactcgggaggctgaggcaggagaatcgcttgaatctgggaggcggaggttgcagtgagcagagatcgcactattgcactccagcctgggcaacaagagcaaaactccgtctcaaaaaaacaaaaacaaaaattaaatatagtccgggcgtggtcgctcacgcctgtaatcccagcactttgggaggccgaggcaggtggatcgcttgaagtcaggagttccagaccaacctggccaacatggcaaaacttcatctctacaaaaaatacaaaaattaaacaagtgtggtggcaggcccctgtaatctcagctacttgggaggctgaggcaggaaatcacttcaaccctggaggcggaggttgcagtgagccgacatcacaccactgcacttcagcctgggtgacagagtgagaccctgccatacacacacaaaatttaaaaatagagatggtgtctccctgtttcccagactgatctcgaactgctgggctcaagtgattctcctgctttgggctcccaaagtgctgggattataggcttgagccactgcacctggcccagagccttttcaataatcatctataatcaggtgtattggcttcccaagtcctcccatggtttgcatgactcattggtctttgctaccacattaaaacatcttgtggctcaatcagaagtaccactctgaggctgggcgcagtggcccatgcctgtaataccagcacttcgggaggccaagcaagactccgtctcaaaaaaaaaaaaaaagtaccactctgggccgggcacagtggctcatgcctgtaatcccagcactttgggaggccaaggcgggcagatcacttgatgtcaggagttcgaaaccaggctggccaacatggtgaaaccctatctctgtcgcccaggctggagtgcagtggcgtgatctccgctcactgcaacctccacctcctgggttcatgccattctcctgcgtcagcctccagagtagctgggactacaggcgcctgccaccacgcccagctaattttttcgtattttcaatagagacagggtttcaccgtgttagccaggatggtcttgatctcctgacctcttgatctcctgacctcgtgatctgcctgcctcggcctcccaaaatgctgcgattacaggcgtgagccaccactcccggccaagactctgtcttaaaaaaaaaaaaaaaaaagaaagaaaagaaacagcactctaataccaggtgagcccctggtctagccatttcaggagggagattggcctgagctaggccccttttgcaaatcttcttcactgacctttgaacattgacaactcacaatttcaccagttggcagaatggtgttactttatcactgcattcctgagtgaaaaggtgagggacacaggcctccaggttgtctgtctccttccttctggtctgtggatgctgttggaatcatctctgggattgaaagagacggtggtggggtgggcccaggagaatgccaaggaatcagggcaggtgtgccaggagttggctcccctatcctaagagtgaggggagcagcagatagatgggtaaggggaaccctgagtcctagagatgagaaggtaggtcccagtgcccaactgtggtggcttgagcctcacagaggcagaggtgtgctaatgtaagtgctcccagagctcaactggcaagagttcacaatgtagaaccagatccacgtgactacacaggcgtgatgcctgtgagtgtggggaacacaggaatcagaatgaactgagggccgggtcatttccagcctgcagccagccctttttaatttcccttttgaaagaattgctggccaggcacggtggctcacgcctgtaatcctagcactttggaaagccgaggcgggtggatcacgaggtcaggggttcgagaccagcctgaccaacatggtgaaacccagtctctactaaaaatacaaaaattagccaggcgtggtggcacaggcctgtaatcccagctactcaggaggctgaggcaggagaatcccttgaacctgggaggcggaggttgcattgagccgagattgtgccactgcactccagcctgggcaatagaccaagactctgtctcaaaaaaaaaagaattgctgcttttctcccaggcctcagctgtgactctgtgttccctgctggaacttcactccaccattcacttatctctctccttgttcctgccctttcttctcagccttcccttccagctcttaaatctctctttctagaagcttctaaagaccagctcctcccttaagtattgttacgaagtttatcatcagttggcttacaaccctggtttctactggctttggcatgaacactggtgggatgcagccatggatcctggaaatctcttgtcatagggttggatgggtccatcttctcatatgccttgtgctatggcttgaatttgcagtttgcaactagcaagttccaaagctatttatttttgaagctgtcttgtttctattttgattctggtaatccaaattgcagtttggtgtttccacggaaacaattcagtgattgtttggcttgccaagatgaactgtgggggagagaactgaatgatgtaaaatatttaaagtttctcagtcatgatcaaagtcaactatcaagtctccctgagaaggatttggtcctagctccttaaaaacctgaggaagttttattaaaattctgggcttttgttccccctccaactaaatccctggagaacagctccccaaaccctgttctgagcaaatgagcgtgtatctgctcactgtatagactcagatgacgaaggcgggaagttcttcttgggcacctcagggagccagagatgcagagacgggagtagatcgtgtcaccagggaaatgaggaggcctatgtgcccactccctgctaatctgggactggcatggagaggctcaggactcacctgcttgactgtacagctgcatttctagtgaggaaaagttccacattcaaggattccaggatgaattgcctgtttggaaaatctgaatttttaaataaaggctttgcttaagcaaagacatacctgtctctctggccagggagagcctgtattctccctcattcctcacccccaccctgtgctgggccctcattcccgtctctactccaggtaggaaaaataaataaatttcaaagtcttctagagtaagggatagatagatccccatttatttatttatttatttatttatttatttattttgagacagagtctcact

SEQ ID NO: 498 - DNA, 171420 bp, Homo sapiens
acataactaataaaagccaaatatccatggcttcctggtttatgtaaacagccctacaactgacatttcaactgctagagatttctgatatcctcccagttgactaaacaatgttatcagcaagaagcttatgaaccaaatctaaacctgggcatggattttcaagacttttgacctatactgtgagcactggccacatttgacaattttacatttttctcttcagtttgtttttccctgttttgaacattattttctctgaatgtggatttgcttttgctattatgttttcaaaaccactaccacagtttttaatctcccaaatctgatgttgtctatctttcaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacaggtgggaatgtaggtgattagtgactgttttcaagaatctgggacagaatattaactaaaagaaagacatagatagttatagaaggattcatttatctctatatcagaatctttgggcttggtaagctatcatgtcaaagtagtttcttattctgttactatttttaaacaataaaggaaaccattcctatgccaagaatcctgttcttgaagataaactgttatctttggtgcatgatactttgtctagaatgttaaaagaaatttaagttgaccagtaaagaatgagaaattaacatttgtggttttatatcatttttgcattagagaaaattttatgataaaccattttttgttcctaatcggttactttgcagtctccaagctgtctatactctgattctgtacagaaatttatcaagtgcagtactcagatactatgagaattagccaaaagtttgtgttttgttttatattttaatattttaccttaaggacaggcaaggcatccaaattttgcctcctcagtaaagaaatgtagctcatgagctctctttgaaatgctgtgtgcatgggctggataagactcagagttatgatgaagtagaacttctcagtgcaagctcaaggctttccaggcactgagggcagccaggtcactttaaatgagtatcaaaagctgaagttcctctaggtctaatctcccatttaatccaggcctatcccaattctctacgctggcttgctcccttctcttcctgtgttctagcctctttttttttgagacagggtctcactcttgttgcccaggctgcagtgcagtggtgggatctcggttcactgcaacctctgcctactgggctcaagcaattctcccacctcagcttcccaagtagctggaattacacgagcatgccaccgcactcagctaacttttaaaactttttgtgagatgaggtctcactacactgcccaggctggtctcaaactcctggactcaagccatcctcctgcttcagcctaccaaagtagtgagattacaggtgtgagccactgcccctggcctgttctagcctcttatctccagtccctgccactcccacatcaagactgggagctgagggccaccattccaccttgaagattatggcatctgagcaggggcagcagccaggacagtagagctgttgggagacctagcagcatatgggggaggtaatgagctaggccagagttgaaaaggagataatggaaggactttgaaccagtcccaagttcatgttcgggtatttgagtacctactatgggccaagcagttagttgctggagatatagtaacaaaacagatgaaagtccaggtcccattctaatagttggggacagacactaaatgcaatatgcaaacagtagcacattagcagatgatgagtgcagtggagaaagtaggaaaggaggctagtatgtgtcaggactaggtgatctgagaaggcctcacagagatggtgacacttgaaccaagtcttgaaagaggagagggcataaaccatgagactacctgaggcaagaaagtttcaggcagacagacgccaagagcacaagttgtgaggcacgtgcttgcttggcccatatgaaaaatagcaaggagaacaggagagttggaatgagcgcggtgaggagcagtgggataggagggccaggtcatgcagggtgttatccagagggagatggagagcctcagagggttggagcagaggagagacatggtctgattctgtgttgagaggactgctgatagttatgtgagaacaaactgtcaggagatgggaaataatccaggtgagagagattataatcaagagctatctggagaaaattcttgcccatggccactttcaaacttaccctcctctatccttcttttacagtagctctgccagttaaccctttcttcttctctccaagtgacgcttctgtctgttgcttggtatgtttggctaagcagagttgtatacttcaataacaaggacaaaaacacccgtttacaaactgtgataaacagaccattggcttcatgaatggccctatttgaaaagagattattctctctttgaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggtaaggcccagcttgagtatttcttgtatgcagtcttatgagtttgacatacttgtctttctgataagcattcaaataataaacaattggtctaaactacaccagctaaaaagagatagcaagggccactgtcaatttgctgttatttaaaatctgtctcattatttttaatctaatttttttaaagtgaaaaacaaaataattagccccacccaactgcagaattctgcctgtgaaaaactttatcacaaagtatgcgttttgtttcctagaaaaatattctatggacactgataaactattaacccaaaatatgcaaccattgaaatttgcctaaatcaattctatttgaatatacataaaatgcctatttgaatataacacattgcttatgggacacaaaatcttgctcaagatttctaacaataccagtttgtcagtttctaatcaaagcatgagtactgttttcctatggttttctttgctgatcaatagtcccaagaactcaaagaaagacaaaaatcagagcaaacttcgaaagagatgttttggtcttatttgagcgctccaaaatatactaaactgagcaatatctgtgcctaatggatctttgaacactgaggaggagttcttgggcaggactttaagagtacctggaatgaatggagactgatgttccacaggtgcctcagactcccagtcataatctaaactctttatcagcagtatttctgcaaaacaaacctgtttttacttttgtcttccctagcattgcctagtctctcaaggtagaatcctcaacgttatctttgactcctcttccttccaacctctatccccaaattattggttaccacttacttctgtctcaaatgtctgtcgctccctcctccttccttagccttatcacttagccttatcccttcatcccgtccctactgggataactgcttcctaattggtgtccttgcccctgctgtccacctttccttctaaacttttccttttcactgtctctcaggtaatctttctaaaacataaatctgatgatgtcagtctgcttcttaaaaattgcaactatttcccattacctaccagctaaagtcttcacagtgccacatagtgcttcctgatgggcttcagccctctttgctggcctcgttattttcttgcacgccccacatacccactgtgctacagcttttacttttcccaagttcacaccatgaacttgttctcacacccctttgctcatctttcctgtctcacagtccctctgtctagtaaaatcctacccattcattcatcataaacattttattcattcgacaaatatgatttcctaatgaggaccagaaactgtaggagactcagatcagtctacatatgcctactttgtgaactttccccaatatatttcctacagcactttcttcatttgactaataaagttcatcttagcatgcagcacactgaaaggcacttaaatgtttgttcacactaaaaacagttgtttatgaattatgttcttgacacacttcacttaatcctcacaagtaccaaataaggtagttattattaccctcattttatagatgagaaaattgatgttctgggaggttacaagtcttgcctgaaaccacacaaagtagcagaattatgatttctgatttgtccaactctttctgtcaactactgctgctaattatttgtatcatagtaagcacttcataaatctgtctttgcaactagattgtaagcttctcaagggcagccactagtctttatcattgtactctcaatgcctgctccagtgcttaataatgtttattgaatgaatgaatgatagcatgatttctgggttccacttaaatttgacaaatgagaaaatctcaataatatctcagtctctaggcatccttcagaatgattcatcaagccattgattcagcctcatgggctgggacattagccctatcattaacttacctatcttccctgagtagaattttttaaagttttgtgaaaaataatgatttttaaaaataaaatcatatttaatttttaaatatcactgttataattacgtagaatcattcaaattgccagagaacctctgcaaaatcacacatcagagccaccaatactaatgaccatgtgcttccctgaagaaactggatgatgtctataatctaatgaaataaaagggacaagctggaaaatctgcctctgccaattacttaccagtttcatggttatataaagggctcaatcagacctacaatcaagtcttttgtaaatgccaaattcactggtgggtgaggatgagagcaaatgttttaattcaggctttttacaaccattagtaatgaactatgattgaaataagttccattgttacagtaactcaaaatcatgcaaaaataataattttagttcttttatgagaggaaggcagaatatattagcatttaatctgcctgaaaataacagtgactcaccagaactatctagatagcagtcagtcattcagtcaacaacatttaaggcctactgcatgaagccttgttagcaagaggtaaaactggttggtggtgggggttcagctacattggaatattataaattcctccatctttttttttttttttttttactcttttggtgatggttgctttttttttttttttttccccaggaagcaccaactaataagcttctctatgccaaggatatcccaacctacaaagaagaagtaaaatcttattacaaagcaatcagggatttgcctccattgtcatcctcagaaatggaagaatttttaactcaggaatctaaggtatcattagaaagcagaaataagcttatatttggttactttacgtcatttcagaatctctcaacaagtctttcttttagaaacatgaaaatgaatttaatgaagaagtggccttgacagaaatttacaaatacatcgtaaaatattttgatgaggtaagattttaaataacattgtttttaacctttgaatcaggcacaaggatgtggttatagcattctgtcagtttcagaacagctctggcatcccaaaaggccagaaagggaagccaggaagcctgtctgagatgggggatcctggcactgagccagaccctgtacatggctgccccccttacagttttatcatgctgcccacatttggaccagcctgaatttacatttgagttcatggggcctacagccaccctgactcaagttaactttgatgagtaagtagtggccctattaaatggggtcagcttatgcttgattgtaatttgctaaaaatgaaagctaagcttgttaaattgcctagattctgtattcaatcgttatatgaaattatgacatatttctaacttaagcgactatttcaataaaccattctcctttatgattaattctccttaatctgggtttttttctttggaaattcaaacagacacattcatcagatgctttgtttccaaacaaatgttaactcccccttccctgattcccccccaatcatgctgggacaggctatccatgtcaatggtgagaatagctcaccaattccatttgctacttgaagatgaagtgaagctctaaggtagggtagaggcaatgagttcttaaacatgataagcatccctcgttccaggggtcaggggagagaagggaagcacgaggagggactacactgcccagatgggagggaagggaaggatctgtctctgaccaggatgtccctgcctgctgcatttaaggagaaatacttgcctgcatgttggctgcccaggaatgcttgctgtgcttggaatggctgtgacataatgcataaagcagggcctaggaagcctggccccatatttgtaagcaaatagttggtatttcttgcgagcttctattttaagccaaggtattgttgatcctgtgataaggacttagcaaaacaacttgcaaagtgagtatgtaaatgatggaagaaaatgttggcatctgtttcatacagattttaccactcacagcatcaggtatgcaaaaaacagaattgtaacgctaaaaccacaatatctaaaataactgttctaattgtcaacagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacattttatcgaattgctgttcacactggagtattatatataaatatatatatttgaggcccaaggcctgaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaacaatttctattttcaagtttctttgcatatttttttggtgcaaaaccatttataaacttttttttctaacactagtgtctacagcagcattcaaaaaaattctgttaccttttctgtattaggatttaaagtctatttcttattgtatacctgattgaagctgttcttggagatgaatgttttaaatgtctatatccaaaaaataaacattttgatgtaactgtggactgtcttttttttttttcaattttctagttataatagtttttttattctaagtggctccgtggaaattatttttcagagataaggtgtcactgtatatgctgtgaataagcagctatattatgtagtaagtaaacctagtttgctaaatggtgctaaggactgctcaattacagtcctggccttcttcactatcaactgggacttttgactatgaacaccttgggataatgaacattccacttaatttgggagacttgagctttagcctcgttaacatgaaattattccagcagaattcctctaaaagatgtcacattaaaaaggcttccaatgggtgtagaccaaaaaaaatgagagcatacttagggacacaaaacacataattatttggttagatccacagtaatgggaagtaaagttaaataccaacaatgtttataaaaggacctgagttcaagttttataatcaatggcccccttgttaatacagccataggatttaattatttgcacttattctctattctaacaaagccaaaatcagtagactgtcatattgctaaatatatgctatatggttgatgtaaaattaaacacacgattaaaaaaaaattaagctctttaattatgtgcacacagattttagaaaaggtagccttttgtatatagatacctttacattctttaggctgacttttaaattgtcatcttttttcaactacagtttttgtatatagtaaaccagaagatgtgtatggaccctgttatggccaagcatctcaaagatgaagagagaattaatgatagttatatttcactcaaaatgccaaaaaaaaaaattcaacaaagtaaaaattttaaaacttgactctaactagttcctttttgttttacattctcaaaccattgtcaaatattctaaatatctctgagaatttctcttttaatgcttcacttgtataatcttaaaatcctgacagtcatacaatacagcatgtagtaggtaccttttcttgaggcacattcaagtgttttggcaaacagtaaaaagtatctaaatgccacaggttaaaatgtcaagttttactgagtcaccaacttcacctcttttgatctgcctgttctccaagaacatcattctccggaagatccaagttcctctagttgttttctttgtgttgtttccagttcttctagtcttttgcgaagtagagagagttccctttgatgttgttcctccttaaaatgatgtagagaaagcatagcaaaagaaactattagaaaaactgttaggtagcaaccttggactgcctcttttatatatgcctataacatctggcaaggaaatgctgaccactgtagcagtctaaaaacagtagcatgggctaaactaccatctagttttgcttctctcctgcctcaggctctagccttaagcaaaacccgtagtctgttcttctctaggtataaaattcaccagggagtgaattagaaaatactaatgcagggcccaggtatacttacatggtaactttccaacaacactggtgtttaacagcagtttattataaacaaagcacttggcctgagattcaattcagtgattaaaatcttctgtgcttatgttataaaacataattacttattaatactcccatcttctgaaaaagaatcaatctgattccttcaatacctcaggggcttgatacaatagaaagagcccgggttttggattcaacaggtttaggtttgaaactttgtcacttattagctatgaccttatgcaagtcacttcactctgaatcagtttccttatctatgaattaggaatagtaatatctgccctcaaagcatttttcgttagtattagacattgcacggaacatgcacagttcactgcgttagtaaattctcagtagtaattactattaacattatgaataagctacaaactctaggttactcaatgactcaatcaagtttcctcttttctatcgtccagtaagagatttcactctcagcaccaacactaaaggatcatgattcaaactgaattcagcaaatttctatgctaaatgaaagggaagaagttaaaagtagttttaaatgtttatgccatttttgtggtgaattttgagcactgaccaaagttataatttgagttttatcaccatatttaaacataaaaacctacaaaaatgtacgactttttttttccccctaaaataaatgctcatacctgcatatgaggaggaaatggtagttccatgcttggaaccatggctgatgactgaaagctaacaggattgatagatgctgttggaggcatgttaggaaccaaaattagacttcgaaattcattatgtcttctctgtatatcttttagtcttttttgaagccttgtatagtcttcaaaaggaacattttgtcttaaaaagaaaaagaaatgtttctttaacatggttataccctattgaagcacagtatgattcacagaatataattttaaactggaatttctaaattatgagatctatatataatatatagataaaaaatctgtttacctagaaagataaacagaaacatgacataacatcttaatcattagcaatcattagcattgcagactatcaactcattataaagttttatttgctaattaaagatctaaaatcttttgatactttggtactcactcctaccctcctactcacccccattcatgaatcctgaaactaaagggagactctaaaccaaaagagtgccttatcttacagaaagaatcaaataaaaatacagttcatccctcagtatacacatgggattagttccaggacatccctcatatatcaaagcctgtgcatacaagtcctgcagtcagccctgcagaaccctcataatggaaaagttggttctctgaactggtgggtttcacatcctgtgaatactatattttctatccatgtttgcccgaataaaaatctgtatataagtagacccatgcagttcaagcccatgttgtcaagggtcaagtgtaaagaaaatgctggattgaagcttacaaaattgccatttttaaataggtgaaatatggtcaaatatagagattttcatagttcaatctaattttcaaaatgtcagtgtaatattttagtaagaaatatatatttggtctttgcccttggttcctggcacacagctcctaaaactctgggaaactctgaagtgataagagtatcttttgtatattaataagataactggtggctgggggcccctgaatagcttcaggatggggcaggtcaccagaaagactgaggcatgattagagggttggaactttcagccccactctccaaccccaccccatgacatctgggaaggtaaaggactaaaggttgagttgatcaccaatggccaatgatgtaatcaatcatgcctatgtaatgaagcctccataaaaacccaaaagcatggggtcagagagcttctgggttgctgaacatgtgcaggtgtctgcagggaggcatgcccagagagggcatggaaactccacacccccttcctcataacttttcctatgtatctctttcatctgactgctcatctatatattttgtaatatcctttctagtaagctggttaacataagtttccctgagttctgtaagctgctctagcaaattaactgaacatgatgagcaggtcatgggaaccccaatttatggccatttttagccagtcagaagcacgggttacaacttggggcttatggctgcattctgaagtggggggcagtcttgtgggactgagccctctacctgtgggatctgatgctaaatccaggtagacaggatcagacctgaattacaggacacctagctcgtgtccactggaaaactgattactccatgtataggaaaaaaccccaaacatctggtgtcagaaatgttgtgttgactgtgtgagaataggaaaaacactggtttttcctattataaaaggtaatcacaaaggtgaagctacacaactttaggaaaaaatgacatggagaaaaaggctaactttccaggccttcacagatcatcatctttttggacacgacatccagtaatcaaatataatttcaaaatcactcaaaattctagatgatctgcaccacaactggccaatcttgaattgctaacatttcaatattaatgtttatggaagaggaagtaagttgaattctgttttagaaggactgagccaggaatggtggctcatgcttgtaatcccagtgctttgggaggctgaggcaggagaatagattaagcctaggggttcgaggctacagttagctatgatcgtgccactgcactccaccctgaaccatagacgaagaccccatgtttaaaaaaaaaaagaattgaaacaaaattcaaaattacaagcatgtttgtaatttacaaattactaccaaattaataaactaaaggcggcctcctactttggaatagagtattgtaaggctggcactaattctacagtctagaaacttctagaatgttctttaaaaaacaattgttcacctgttggtaataattgcacccaagaacaccagtgcacatcataaaacgtcactgcatgatattataggcagtttccattacagaaaaatctatacttgaatagccaaggcgctgaaggctaccactaattcactaaattaaaaagatttttcttaacttgaatcaaatgtgtcatataatgccactaccaacaacttaatatgacaaatctctgctttaaaaatgctgatgatcctgattatcagatgtgcttgaatgtgactgcaaaacccgaaactacagctcaataaaatctccacaccaggaaaccaaaactgacctttgattcaaagttgtaggcacaattttcagaactatgcaatagctacaactgtcttgtacagcagcaacaactaacaccactccttgctaccaaagccagtgacattttctgttagtcccaatcataaggcaaacacctggtatgtgacagagaccttttggtttaaagaaacattcagttagggggtaaaaaaaggatagtacattaggagttatcaagctgttttagaaatctttaaaatgtatattttaaaagaaaagaaggtacgttatacttagagacaaagttctatgacatcaaaataaccacatggggaagatacacatacaaacacattacctatttaagacctgattttctgtttccaattcttctttctttgcctccaagacttctactttctcttgtagtcttttcaatttgttttcatgaagagattttctctaaaaagagaaatatgaacaagtatgttaatacataatctcttatttgaacaaaactatatagaaaatattttactcaccaaaaactgtgtttagatatgaatgttttcagtgaatactagaaacaaaggttagtagacatggctcttactgaaaattgcaaagataataaaccacaaatctatctaatattctcaatgtgacaattaattatgaatgccaaacaaaaaaactgttatcaataattgctgcaaaaaaaaaatctacaaagggaaggagtcaaattttactactgagtctgcctgtacatctggtaagaaataatgagctctccattgttccagaagatagcatgtgtttaagagaactgagccaggtacagtggctcatgcctgtaatcccagtgctttgggaggctgaggcaggaggatggattaagcctaggagttcaaggctacagttagctatgactgtgccactccaccctggacaacagatcaagaacccattaaaaaaaaaaaaaaaaaaaaagggtggggagccaggcacagtggctcacgcctataatcccagcactttgggaggccgaggcggacagatcacaaggtcaagagattgagaccatcctgaccaacatggtaaaaccccatctctactaaaaatataaaaattagctgggcgtggtggcgggtgcctgtagttccagctactcaggaggctgaggcaggagaatcacttgaacctgggaggcggaggttgcagtgagccgagattgcaccactgcactccagcctggcaaaaaagcaagactctgtctcaaaaaaggaaaagaaaagaactgaagtaaaattcaaaattacaagcacgtttgtaagttataaagtactaccaaattaataaaactgaaggatcagaaagctaagataaatatggatgcatctgtttaaaagttgcctttctaaatcttaaaaggaaaaaatttaaactttacaatatacaaagggagaaattcctaagtaaatcttgtatggtttcattaaacaatacggaaaagtccaggtaaaatgcaaaaggagtgtatggaaaaaagtagtattttttttcagtttttatacacaggccttttgttttttaatagaaaaacacctaaaatgttaaaactcatttagtcgctacaaaccttttaggtattttctaactcttttttaactgaagtataatcttacagcaaaatgcatagaatagaaacgtaaagctcaaagaaaaaccacaaaacaaatgctggcatgatttccttgtaggtcaagagcactgccatgccagaagggcccctacctttcccccttccaatcactagccctgtcatcctctgaaagggtaaccaactaatttacttccaaaactatagtttacttttgcctatttttgaacctcatatacatacaatcatagtatgtagtcttttattaatgactttatttcactcaacattgttagtgagatttatgttacttacagatatacttcattcattcccacatattatattccacttacgattattgcataacctagtatattcactcagtacaccgttaagggttatctgcattatttccagttgggactattacaaataactctgctacgagcattcattctcatgctttgattgtcccacatcctccaacatctcagaaggcttccttatgctcctgtctaccctggcaaaggaaccactcttctggtttttatcaccataagtatttatttatgaatttataggcagttaaggagtccatctgtctatccatccacccattcatatgaaagaaatcataaatttatgctcttttgtatctggacttttttctcaacattttatctatatgactaagccatggttatgtattgtcacagtacttctttttcattgcaatgttgtcattcattgtacaaatataccacattttatacattttcctgttaatgaaaatttaaattctttccagtctggggatatcataaatattttacgaacattcctaaacatgtttttcgcagattaagtacctcattctcttcagtatatacctatgaatgggtcatagtgtatacatgttttagctttagtagatactgccagttttctaaagcagttttaccaattacatttccaccagcaatatgtgagagttctagctgttctacatttttgccagtacttggtatggtcggtcttttagcttttgcatcctgttttggtgaaatacagtatctcactgtagttttaatttacattttcctgatagctaaaggtattgagcatctttttttatgcatgttagtcatctggatatcccttctttgtgacgtgtccatcctagtcttttgtccattaaaacttttgagtaacctgattcctactgatttgtagttctttatatattcaagatatgaatcgtatgtcagatatatatgtattgcagattgaccttctccagcctgtggtgtcattttcttttgcttaagagtatcccttaataaaaagattttaatttaaataaaatcaattacatcaatcatgtattttatagtaggaactttttgcatcctgcttatctttattatcccaagatcctaaaattttctcccaagttttcatctagaagctttattttttttttttacctatcacacttaggtgtatggttcatttttatctatgttgtgaggttaggctgagtttaatctattgactcactactatttgaaggaacatcctttatcgaaatgcagtggtacctttagtgtaaacctatttctggactctatactgttccatttgcctgtttatccttatgccaataccacactgaattactgtagcttatatttagtgttgatacctggtagttttaagtcctctagttttattgttcttcaagattgctttgggtattctagtcctttgtactttcagatgaattttagaatctactttctaatttctacaaagaaacctgctgagattttgattagaactgcattcaacttatggataaatttgggaagaactgacaccttaatattgaatcttccaagtcatgaacatggtacagttttccctttaggcatttttccatttttcttagcagtatttgtatttcagtgtagaagtcataaacatctttcactagatttgttcctaggtattttaggtatttttatgctattgtaaatggcatttaaatattttctaattgtgtgtgtaaagaaaaataactagtatttgttacttgacttcgtacttagaaattttaaaaattcatattaattttaatagtttgataggtttgacttttatgcatgcacagtgacatctgtgaataattttaaattcctgtctactctttatgtccatttctttattcttaaaactttttttaggctcagaggtacatgtgcaggtttgttttataggtaaatagattatttcatcacccaggtactaagcctagtacccaagttattttttctgatcctctccttcctcccatgctccagtctcaagtaggccccagtatctgttgctcccctttgtgtccatgtgttctcatcatttagctcccacttatgacaatgaaaacatgcagtattcggttttccttttttgtgttagtttgctaaggataatggcctcttgctccatccatgtacctggcaaaggacattatctcattcttttttatggctatatagtattccatggtgtatatataccgcattttctttatccaatcttccattgatgggcatttaggttgattccatgtctttgctattgtgaatagtgttgcaatgaacatatgcatgtgtctttatggcagaaagatttatattcctttgagtatatttacccagtaatgggattgctgggtccaatggtagttgtttctagctctttgaggaattaccacactgctttccacaatggttgaactaatttacactcccaccaacagtgtatcaaagtattcccttttctccacaacctcgccagaatctgctatttttttattttttaatagccattctgactggtgtaagatggtatctcattgtggttttgatttgcatttctctaatgatcagtgacattgagctttatttcatatgcttgttggtcacatgtatgtcttttgaaaatgatctgttcatttcctttgcccacttttgatggggttgtttttatcctgtaaatttaagttctttatagatgctagatagacctttgtcagatgcagatgcatagcttctaaatatcttctcccattctgtaggttatctgtctactctgttgacagtttcttttgctgtgcagaagctcttaagtttaattagaacccatttatcaacttttgcttttgtcgtgattgcttttggcatcttcatcatgaaatctttgccagttcctatgtcctgaatggtattgcctaggttgtcctccagtgtttttatagttttggattttacatttaagtctttaatccttcttgagttgacttttgcatatggtgtaaggaagaggtctagtttcaatcttctgcatatggctagctgtttatcccagcaccatttaatgaatggggtgtcctttttcccattgcttgtttttgtcagctttgttgaagatcagatgattgtagctgtgaggccttaattctggttactctattctgttccattgatttatgtgtttgtttttgtatcaatatcatgctgttttggttattgttgctctatagtatagttttaagtcaggtagcatgatgactccacgttttttgttgttgttgtttggcataggattgctgtggctatttggactcttttttggttccacatgaattttaaaagtttttttctagttccatgaagaatgccattggtagtgtgatagaaatagcactgaatcaataaattgcttttgacagtatggccattttaatgatattgattcttcctatccatgagcatggaaagttttgccatttatttgtatcatctctgatttgtctaagcagtgttttataattatcattgtagagatcattcacccacatttagctgtattcctaggtattttattttgtgcaattgtgaatgggattgcattcctgatttggctctcagcttggctgttggtgtacaggaatgctagtgatttttgtacattgagtttgtatcttgaaactttgctaaagttatcagctgaaggagctttttggattgagactatgggggtttcctaaacataaaaccatgtcgactgcaaacatgaatagtttcacttcctctcctcctacttggatgccctttatttctttctttctcttgcctaactactctggccaggacttttaatactatgttgaatgggagtggtgagagagggtataattgtcttgtgctggttttcaaagagaatgcttccatattttgcccattcagtatgatgttagctgtgggtttgtcacagatggctctcacattttgtagtatgttccttcaatacttagtttattgagtttttaatagaaagggatggtgaattttatcaaaagccttttctacatctattgagataaccatgtggtttttgtctttagtcctgtttatgtgatgaatcacatttattgatttgcacatgttgaatcaaccttgcatcccaaagataaaacctacataatcatggtagattaggtttttgatgtgctactggattcggtttgtaagcattttgttaaggatttctgcatcaatattcgtcaaagatattggcctaaagttttcattgttgtgtctctgccaggttttgttatcaggacaatgctggcttcacagaatgatttgggaaggatttcctgctcctctattttttgttaacagtttcaggagaagcagtaccagctcttctttgaacatttggtagcatgtggctgtgaatccatctggccctgggctttttttggttggcaggtatttactactgcctcaatttcagaactcattattggtctgtacaggaaatcaacttcttcctggttctatcttgggaaggtgtatgtgtccagaaatttatctgtctcttctagctttgttagtttgtatgcagaaaggtgtttatagttgtctgtgacggttgtttgtatttctgtggggtcagtggtaacatcccctctgtcatttctaattgtgtttatttggatcttctcatttttcttcattaggctaactagtggcctaacaattttttcaaaaacgcaactcccgtattagttaatcttttgaatggctgttcatgttttgatctccttctgttcagctctaatgctagctttgggttggttttctcttggtcctctcattgttttagttgtgctgctaggttgctgatatcttttttaactgtttgatgtgggcatttggtgctataaatttccctcataacattgccttagctgtgtcccagagattctggtatgttgtatcttttttctcttagtttcaaataacttctcgatttctgccttaatttcattctttactcaaaagtcattcaggagcaggttaacttccatgtaaatggttttgagcaattatatttttagtcttgatttcaatttttattgtgctgtgtgtttggtatttcagttcttttgcatttgctgaggattgttttatgtctgattgtgtggtcaatttcagagtatgtgccatgcagcaatgagaagaatgtatattcctgttgtttttggatgtagagttctgtagaggtctatcagatctatctggtccaatgttaagttcacgtcctgaatatctttgttaactttcttcctcaaggatttaatactgtcagtggaatgtggaagtctcccactgttattgtgtgggagtataaatctctttgtaggtctctaagaacttgctttatgaatccgggtgctcctatgttgggtgcatatatatttaggatagttacgtcttcttattgaattgaaccctttaccattatgtaaacccgtgtcttttttgatttttgttggtttaaaatgttttgtctgaaactaggattgcaaccctggcatttttctgatttccatttgcttggcagatgttcctccatccatttattttgagcctatgggtgtcattgcatataagatgggtctcttgaagacagcatatcactgggtcttgcttttttatccagcttgccactctgtgccttttaaatgggggcacttagcccatttatattcaaggtcagtattaatatgtgtggatttgatcctgtcattgtgttgttagctggttattaggctggcttgtgtggttgctttatagtgtggctcatctgtgtacttaagtgtgtttctgtattggctggtaaccatcttttttttttaatgctctctctcagcagaatcatggtaaccatctttctatatttagtgttcctgtcaagatctcttgtgagatgggtctccatttaacaagcatttgcttatctaaaactccctcagtatttgcttatctaaaaaggatcttatttctcctttgtcgaggaaggttagtttggctggatatgaaattcttggttgaagatttttttaagaatgttgactataggtccccagtctctcctggcttgaagggctcctgctgagaagtcagctgttatcctgagggggtttcctttgtaggtgacctgccctttttctccaagtgcctttaatattctttcattttgaccttggaaaatctgatgattatgtgtcttggggattatcttcctgtgtagaattttgttctctatagttcctgttggtctctctagtgaggctgaggaagttttcttggacaatatcctgaaatatgtttcctaagttgtttgctttctccccaaccctttcagggatgccagtgatttgtagatttggtctctttacataatctcatatttcttggaggttttgttcattcttttctattcttcttttttatttttgtctgactgtcttactccaaagagccagtattcaagttctgaaattattcagcttggtctctctcttctgctgttaatacttgtgattgcattgtgacattcttgtgtttttcagctctatcagatcagttaggttcttttttatactggctatttcatctgtcagtgcctgtatcgttttattgtgattcttagattccttggattgggttttgccattctcctgaatcttgattatcttcatgcctattcatattctgaattctatttgtgtcacttcagccaactcagcctggttaagaacccttgttggagaactagtggccatttgacactccgaccatctgtgttgctagagttcttccgttgattccttctgtctgatggttccatctctgcgtgggggtgttcctttaactgctgggctgcctctgattgaagtggtcaggcaagctcagggtagttgtgctacagttccaggttgggtgaccctgcccagggaggagaagtgaggactgggacttgcatagagaacagtctggccacttttctgaggtaggtgctttgtgttgggcatccgtaccagcccctggtccccacagactctccagaacctggagacagtaagagtgagggctacaagacagcaaagatggcaacccatccctcccactaggagctctgtcccagacagtaacagagctgctactggctggatggccctggtggggatggctggagattcaggttgggaggacgtgctcagtgaggagatatagaatcaaggacccaaataacagtctggccacttttccatagggctgctacagtatgctgggggtccgctccaatcccttttcatcttaaattttccagtacctgaagatatcaacaaggaagtctgtgaaacagcaaagatggaggactgccttctctctgggaactctgtcccagggaggcacggacctgttgctggcagaacacactaacaggaggtggctagagacctcggttgggagatcctacctagtgaggagtaacaggatcagggacccacatacaaaagccgtctagctttttccatagggtagccatgctttgctaggggtccactccagccgctaatcacctcagactctctaaagcctgaagacaacagctaaggctgctaaacagcagaagtggtggtccacccctctctttgggagctctgttccagggaggtttgaaactgttgctagccaaaaaacactggtgcaggtggctggaaaccctggtcaaaaggtcctgtccactgaggaggaatgggattagggattcaagtaaaaaagcagtctggccactttttcatagagcagttgtgctgtgagggggtacctcgagaacagttgcttcagactctccaaatcccaaaggcaaagagataaggctgcaaaacagcaaagctggcaccctgcccctctctctgggagagccattccagggaggtttgaaactgctgctggccagaaaacactggttggggtatggttgtagacctcagtcgggagatcccacccagtgaggagaaatgagatccaggagccacatgaggaagcagcctgaccacttctccttagagctgctgctctgtaccaggggatcactccagtccctaaccaactcagactccctagagcccaaaggcaacaatggctaagaatgtgaaacatcaaagatgacagccccatccctccccctgggaactctgtcccagggtggcttggaaccactgccagctggaaaacaccaacaagggtgactagtgaccctggtcgggaggtcccccacccattgaaaagcagggtctgggacctgcataaaaaagcagtctggatgcttttccatagggtggctgcaatgaaggcaatagctaaggctacaaaacagcaaagatggcagcccacccctccctctgggagctccatctcagagaggtgtaacactgctaccagtggctggctagagttccaagccagtgggtcttatcctgcaaggtgccatggtagtggggcctgcagactgtcactgctctatcccctgtatacagcctctttcctaggggtatgtacaggggtctaacgtcctgcttggctggagttgcagttgcttttgatgggaaacctgggtatctaaagctcccagggctctacgtgtatctgagcggctgcattgctgagactccacataattctgtgtaacaggctgcagaccctggtggagtgggctcacaaggggatctcctgacctgtgggttgcaaagatccaagggagaagcgtgggtcgctggggtcactcactcactcaccacttccctgggaagaggaggctcctctggctctgtgtcactcccaagtggatgactgtcctgattgctcttctccattctttctgggtcaagttgttttcttgatgaatcccaatgcgtgtacctggatgcttcagttgaaggtgctgtatttacttactccttctatttctctccatgaaagtggcacacaccagctgcttctagttggccatcttgaccagcctccccctccatttctttttcttgccttattacactaactagaacctccgataaaatattaaacaaaatggtgatagtagacatctgttcctgaccttgggtaagtaaggggaagcagtcaatatttttaatcagtaagtatgatgttagctgcagaatttttatagataccatttataagattgaaaattcccttctgttcccagtttggcaaaagtttttatcatgaatgggtactgaatgttgtcaaattatgtttcacactagagatcacaatagttttccttctttgttctgttagggtgttgaattacactgaacaattttgcatgttaagccacctatattcccagaataaaacctaaatgctcatgctatattatcatttttctatatcactaaattcagtttgctaatatttaagatttttacatgtttataatgcaatttttcttatattgattctatcaggttctaatctcataagtggagatgtgtttcctccttttctatcatctggaagagtttgcgttaagattagtattaattcttccttaagtatttggaataatttaccagtgaagccaaatgaggcatttctttgtggaaggtttttaactaaagatttcatttcattaatagatacaggactatccaaatgacctaattcttcttgtattaggtttaagatgttcttaaagaaatgtattcatttattctaaattgcatgattaattagcataatagtttttatactattccttttgttttaatatctatatgcagatagttaatatctatagatagatatcccttttttcattcactacattgttcatttgtggctctaatctcatctcatctactttgtggggagtctgaggacaatcagtcttgccaaggctttatcaatttcgtaatctttttaaaaccaactcttggcatttctattttcctcactgtacatcttctgtctctgtcactgatttgtgctcatctcttgatgatggtgatgttgtttgctattaaatctatccattgagttaattattgttattgtatttttttagttctaaactcatcttttttagtgctgatctgtaacctggacaactaaaacatggtttccctgactcctattctgcccctctacacaacagccagagattcttcaaaaatgtaattcagatatcacttctcaattcaaaaacctccagtgtgttcctaccttaactgagaataaaagctgaagtcatggcataaatttggcctcctactatacctctttctattctagctccctgggcctcctgtgttccctcaacataccaagcagattcctgcctctcttgtacttgctattccctctggaacacccttaccttacatataacaacatggcatcctccctcctttccttcagtctctgctcaaatgttaccttaccagagaagccttgcctgaccacctacataaaacagcaccccctactcctgtcaattttctctcccttttttttttttgagatggagtcttgctgtgctgcccaggctggaatgtgctgccaccatctccgctcactgcaacctctgcctccagggttcaagcaattctccctgccttagccccctgactagctgggattacaggcacccgccaccatgcccggctaatttttgtagttttagtagagatggggtttccccatgttggccaggctggtctcaaactcctgacctcaggtgatctgtccgccttggcctcccaaagtgctgggattacaggcgtgagtcaccgcacccagcctactcctgtcaattttcctcttagtactcacctccacctgatagtatttctttctttattctatgtctcctaacaaactacaatgtaaactccatggtgcagggtctttgtttacttctgtattccagtgaatgagtaagtacctgatacataatagatgcttaacagatatgttgagtaaattggataaatgaatacagataaacctcgtagggaagacagtctgaccaaggatgttagtaataggaatgaaaagaaatatggggtgggggaaaatttgagaggcatcataaaggaagaattcataggctttatgagttcttattttaggttgaataatgtctcccaaaaattcatgggcacccagaatgtgactgtggtataagaagaaatatatttggtctttgtacccagatcctggtacaaagctgctaagacctatggaattgtataagtgataggagtggtttttgtataattcttagcaagtccccttcaatcatacctgagttgatgttaatgaggtaacttagagttgaggtccctagatagcctaaggatgggggctggtcaccagaaagaccaagtgattagatggtgaatgctttcaggttcactcccctgacccgtaagaaggggagggggctggaaactcttcaacaatgagattttgagagcttccgggctggtgaccacattgacttgctgggagggtggctcacacagagagggcatggaggctctgcaccacaatccccgacccccaacaccttgcccaatgcatttctcccatttggctattcctgacttttatcctttacaataaactggtaaatatagtgttttcctgaattttgtgagccattctagcaaattatcaaactggaggagggggtcatgggaacccctaagttagtcagtcagaatataggtgactcagacttgcaactggtgtctgcagttggggcagtcttgtgggactgagccgtttaacttgtgggatctgactctaactccaggtagatagtttcagaattgaatttttggacacctggttggtatccagagaacaaagaaatgattgctggtattggaaaacaccctagagtaaccttatttggaaatagggtctacaaatgtaatcaagttaagatgaagttagattggattcgagtgggccctaaatccactatgactggtgtccttacataacaggagtgaaatctggacacagagctacagatacacagggagaccatcatgtaaagacaaggcagagaccagagtgatgtgcctgtctaaaacccaagaactccaaggattaccagcaactaccagaagctacacaaggggcatgaaaaaagatcctcctccagagccttttgaagaaggatgctcctgctggcactctgactgtagatttctaggctccagaactgtgagagaataagcttttgttgttttaagccacaaggtttgtggtaatttgtcatagcagccctaggaaactaatatagtgcctgactaaatttggagataaggcagacctcaggatgaatcacaggtttgaagcctaagtgactggaagaataacttctactgaaagaaatgcaaagtccagaggtaaaattagtggaaaggaatgattctaatttttacttgagtggtccaacacaatcacaggatagtcaaatcgatgccttagtgttataaacaatatgacacaaaggactaatagaacaattaaaacaatatagatataagaattaaggctgggattccccttttaccaccctctagtcaaatccaattaactttttttcaatgatcatgttaatgaccatttatctttgataactttctttacctttggttcccataacatcacaatatagcttctacctctgttcaccaccacacctagctcctcgttctaagtaaacttagtattcttcagtgatctgcaaaatcctgagtttctaattatatttctctaatttgaattattcatctctgtacttcacattctattatttctagttacctatataatatctttacttaagagtctacgtcatgtctacatggatgcactgccatcatttcctatctgacatgtgttttttatctttctactcaactgacattcttcaatccattatcataactccacttacatcttctcacagctaaaatacttcatagttttctttcttatttaccaatatattctgcaattattttttcctttggaatacctctggcagtcacgctttaccttcattcctatattccaagccccaattctagacttcttacctcactttaagtttactataacagcttcctaactggtctccttgtcttcagacttttgtctgtctagcacagtggttctcaaactttagagtccacataaatcacccaggagtgactagtgggattatttaggtgtttcttgcatgttatcttatttctccagcaagattatatagttatcaaagccaaggagtaatcatggcttctatttctccccagtgtatagtgtaatctaggccacacaacatattcaatcagatattttgcaacttcaagactatgattcatctcttttttgaaaacattcataatagtatctgaccaagaattatttcagagacgtataccttagaataaaattaacaagttgtcatttcaggttcctcaagaaaaaagaaaaaaacccaactcactgtgttcacttcaagagatctctcttcaatgggggtggggggaatacactctctctgtatgtatcagtcacagaagggcatcccaactcaagatcctgttcaagcttttccaaacaaatcaacacaacaaaacatcatttacaccaaagactacttaaaaacagcagaaatgacaatctctgtgctcaggagcttggagctctgagtaaacacagacggcagcgagccatcttacccagcctcagggaaaaaagaacttttcacaggaaagcaactccaaaggattatttctgcactgggttcataatttgtgacttttgttacatcttacggcaaaaaatgctatgacttttggcattaaagaatctaagaagtctgttgcactcttatgaattatatttatgtaatctgatagccaaaatggtcaaatagaagcattatctttaacttgaatgggaaaagggtatgagttaaattaatttacagtgattattctgacataagaaacgactcatatggaccatagctatattaagcgaaaagttgtaaagtatttggaatcaaggaaagtaggaaattaaagcctaacagcgcagtggaaagagcaccagactgagaacagaaacatgtagattttagtcaacttttgattcttactagttaagtaatcttgggtacctcctactttaggttgctaacttgtaaaagctatttgaatgctaagatcccttccagtcctaaaattatacatacttatatactttttaattgtatttctaagttacacatgatgtttttctattttaattgatgtaaacttgtaagctcctagggcagtgtcccacatagtaggacaattctaggtcataatcattcactgaattgaccttaacaatttcactatgacttaaatcacaatccatagatcacattttaaaaagtaaaatgactatctactatcttcacactcatcatctggtagacatttcagtagaaaaaaaaattcatcctgtcacaatactaatgaaatgttactttgtagtgttttggggtttttttgtttaattattatttttttttgagatagggtcttgctgtgtcatccaggctggagggcagtggtgccatcacagctctttgcaatcttgaactcctgggctcaagcaatcctcccacctcagccttccaagtagctgggactacaagcatgtgccaccatgcacagttttttcatgttttatagagatggggtctggctatattttgtagatttttaaaaatataacctcctccactccttctggtatacttatgattagctgataatctcaccactgggtgtcacttttgcttcaaaagaattcaacccaaactaaccttaataattagaatttgatctgtaagatacttattcctaaagcctcaaaatttagctcttaaaatttcttgctgtaacacggcttcagatgtttctaggcttcaaacacagtgcaaacaaaaatcagtaggatttctgagttcataggtcataaaacaatcctctgaaatcccattaatattcatacacttttcagtacctacatcgacagaaaggaagaaaagtgacatatacagaaaaacaaacaagtgtgcatatttgggtataaaacactgggatccctatataataaatgctgtttttccaataatactacttctagcattatgagaagataaaagtaatattcagagaccaagaaagtagagaaggaatgacttttagactactcatgttgtcactccaaccatcagcaacatttggcagtgatatccaattacataaaaaggggtctaggaactgctgtgtggttttcaaattcagaataactgaacgatctacagttattttctcttatccaaatataaacagttaacctttccaataaacagatattaagataatggttcctgcacctagaagcattttcctctcacctcagatcttctctcctctccacaacaaatgctactattaggggaatttatcaaatgaagacaactcaaatcatttgtgggactttacatataacacgcacacacacacacacacactttatcatgtccctcctcttcctctaatcctgttgaaaagattaccatgtccttcccctcccttaatcaccaccataagtcatggttactaatgggacctgttatattattcttgggtttgctgaaatagaaaaaagttgtaagtcactgatttagaagatccatctagatacattatttccatgatgccctggattgtttccaagaaaacaaagttaggttctggagaaaagtatgcctgcaaaggtaaaacttaaaaaggatcacaatgctgtgggaactcctgtggcagtttcagaaaccaagggagtcccatttcctcctgctggagcaaagaaatacttgctcttgtatttctgaattggaaacaaaaaagccttttaaccacaaaagcaataaaacagatattaggtataaatgaaacaagcttaatcacactataatttaactggagaatgtgttaaatatgacttccatgggatggcctggaaactatcactctgaaaaacaccttctgtatggaaaaatgcatgtcagctcaaaacaactgacttacatacaaaatttagaaacaaacctgctggacagtttggattttcccaatttatttctgcaaggttgacagcaaaatgtcatgcttatatatcaaattaaacatatcactaaaatctcagattcaactatatactttattctcctataagagtttattaggatggacgcggtagctcacacctcttaatcccagcactttgggaggctgaggtgggaggatcacttgaggtcaggagtttgagaccagtctggcaaacatgggaaaccctgtctctactaaaaatacaaaaattagtcgggtgtggtggcatgtgcctataattccagctactcgaaaggctgaggtatgagaatcgcttgaacccaggggatggaggttgcagtgagccaagattgcaccactgcaatccaacctgggtgatgggagtcagactctcagaaaaaaaaaaaaaaaaaaaaaaaaaaagatttaattatattttactccatagaaatcaccttttttcctttttttttttttttttttttttttttgcgacagagtcttgctctgtcacccaggctggagtgcagtggcacgatctcggctcactataagctctgcctcccgggttcatgccattctcctgtctcagcctcccgagtagctggggctacaggcgcccgccactatgcctggctaatttttttgtattttttcagtagagatggggtttcactgtgttagccaggatggtctcaatgatctcctgacctcgtgatccacctgcctccgcctcccaaagtgctgggattacaggtgtgagccaccatgcctggccagagatcactttaataagaaccacttgcctttttctgggcaattgcagctcgctgcagtttctccttagcttgattgtacttttcttctctgtctgtgatacgctcatgaagcttatgcttttcttccaaccactgtatctgtttctcttccaatgtcctgtcagaagaatgtatgtaaaacatggaagttaaataagttcttaggattaaatagatattatcacaagtataagcaaactcactacctgtctgaccacattcttaattatccaactgcaggccctcctgtatggccacttgtttggaaatcccaccattactgagcacttcctatgaataaggcactggacttagaaaactatgtgttctttacaaaaatcctgagttaggtatttctgtcacctttatacttctgtccattttataaatgaggaaactgaggattagagcagttaacgaacttaagggctcacatctagttaatggcaagacaaacacttgataaccagatgtgaagtataataaccatcaaactacaaatatctgtcctcataaatttggtttaagaaaatcaagcctggtatcaaatcttaatgcagtatgtcttctgactagagtaaaatgcatataaatgatatcttaaaataacatcataacaacttatatttttaaagctattctgcatactttatatgatttttttagtattcttactataggcagtactaatgaaaataacaaaccctgagaagttagattacttgcctaaggtcatacaagattttaagtatcttagctggaactaaaatcacattccattgacccttagttcagctattttcttctatgaaattctatgaatattatttagaaaccaatgattaattacttaaatttgctagctatactgtcattagaattattaagctcatttcaatcaaacacttgagaaatccaagcacatgtttctgttttttacaaaataaaagaaaaataagttggatcaactgaaatgtcacatgctatggacatttatcttgcttacttccttttcttgaaattcaaccccatataaaaaagcatggacaaacctttgaatatgtaataatagaaaaactgaagaaatacagttttatgtggcatggtggccttcagaagaagaaatttgaaaagaataatgttttgtagattaaaataaaaacttacttacaaggccaacatgttataaagacaaagcaaatacaaaatagtacagtgttctaccacatctaaacaaatttttccagaggatataagatcttgaacatcaccacaatcattttatccctaccagttttactccatactgtctactagtaacaaattttaagaccaaaaaaaaaaaaaaaaaaaacaaataaattagcttttcaaagaaaatccaagatagttctaattcaaggaattaagttttgcacatcaaaaacaaaacaaaaaacccattctgttctctggcattcagaagaatagatttttgaagaaatgttttggtttaatcaatgaataaaaaaagttttctttgaggtttttcagaatactatactgtcagaattttaatgtcttaatttttttaaaaacaattcaagagtcagtatagttcattctataaaaacataaagtacattattacctcagtagaccattgtacactattaaagtgtatttgtaactagtttctaaaatataatcaacattggaatcattactaaaataagtacatgttatatagaaaaaagaaaaaatagtttgtacataaagagcaaactctacttttcagcttctagttgcgctttttcagcttggcttctaaaatttcggcattcttgttttaatctctccaccatttccttcagcatttggtttgaattcagcaagtcattctctgactgtgcaagtgaagtcacttggatctgcaaactactgatttgcttaaaagagaagaaagaagataaattaaagcccactaaataaatgcggtaaggtatgagagaagcagaagatactaagcatctccctttgcaaatgctccctcaagctggtgtgtccttggagatgacccctaaaggaaataacaaatagcagcacccaggagcatttcttattataatcagagactatcaagaactatattcctcagtcactgagtcccctccctcttctttccaaaatatgcaggccaggagaggtattgggaatggagagaagggttatcagggggattagcagtgagatgagaaaagggaatccagtgattagagtgagtctcctaccactctagccttctcctcacctcctaggaaaaaaaactgattttaaaagcaagtcagctgggaaagcagctaaaaaaaaaaatccatcctcctcttcccacataccctgagatcagcaaccttccagaagttctactctccgagcaatcaaaattgttcagtgtaaatgtgggaaggatcactcctcacattgtttttaaaaggtttccaaaccttctgtatgtccagtgctgggcagaagaaagatgctctgggaaatctaataaatgctatagattccttggcctctacagccatttaccaaactacataatgtcactcacagcttttttttccatcccaatttacctttatctgggagtactttttctcataagaagtctagttacagattaacaggctagaaagattcacactcttctaaattatatccaaatctctttatttgggacagttacacatacctcccccacaagctattttaccaattagtaaacaataaaagtccttattttcctttcacttccttttatctctcttagccattttctgaagacatttcaaagcaaagacagtcaagagacagggatcaaaagaacctattatgagattcaagggtaaaaagaaacaagattcttatataataaacaaaataaatgggtaataatctcattacttcctaatggtaacaaaacaattcagataggattctgaaggtccacagagcaatttttagcagaataaaactaaacggtatgtctcagatttctattttagaataaatttatccatgtagaactattcactctttatttttaactggagtggcaaatattaaatctgtattacagctgcttgaataagcaaccttcaaagagcttaatacctctccatatgcatagcatgacagaaagcccaaatgccaatgatactaaataacttctgagtatcaaacgttatgtccatctagttaagacttagaaaccataactgcacatgaaaagcagtaccaactcgcatatgagcatgaattctaaaaatggaatcctacttcataatttatagggaaaaaaacaacaacaaaaaagaaaatagaattcagaaaagatcactcttccatgttttacccaactttatacaaatctttcctgaacccaaataactttaattataaacacaaatttccttccataaatacaaatcttggatttcatagggatatagcaaaaaatacctcatgatataaagttacaagtcaatcacacaagtaacttaaaacctggatgatatttctattgagtttttaaaattctgaatattaaaatactgtccttataactgtaattaaaaattatcatgggccacagcatttaataaataaatatatatatcttaagaataatagcagttagccaaagaagcttattaaagtatagaagtttaaacattttaaaacattttatctttacatatcacctccaacaatatgttaccaattgtggttagattctaaaaatactgatggcaaaatttttttaaaatttgcaaaacataaatttaaagaagcacttgaaaaaataaaaggaaaatcttcgctaaaatcatacctgttttaggtcagaattttcatttttttccttctctgcattttcaatagtcacaatttgttgctgaagttttaacctaaaaatcacaacccaacaaaaggcattattaagaatccatgattcatttatttcactgaattaaagagtcattttattgaatgcctgtttgacaccagagcacaaacacaaccaaagattgagacttcaagaaactaggttgtgttcacgtataacaaaaatgtaaaacaaattactgctattgtgataggaaaatctacaaactaggggcatagagaggataagaaatcaagtctgtccaggggtactggggaacgctacatggataaaaacctgacaggtaggattttgatatacataaacaacagcctgaaaaagtggcctttcatggaaaattatagaatgtgttgctaaggtatcagaaagtagtctagtttaggagaggccaacttacatccatatagtattttacaatttgcaaaattctttcagacacacgctacttcattttccttctaacaaggctacagatttaaaagaaaactaatacaacacaccatcctgtattctataaaatatcttatggagcttttcatccctgagatgaatgaatacttacacatttgcagactcttcaaagggaataatacatctacagccagagccttaaaaagcagagcagctctagtgaccaaatgagtaacctcatgaggaagacattacactaattaggtttggcaggataggcccttcagcctcctccctttcaaaactcttcaaacgcctatctcaaatataattcacttggcacctatttatagcttggtattattagcatgtcttatctgcccaagtagaatgtgtttatctagacaacactctcaagaccctaggtctgtgctttaaacacaataaggactcaataaacatttgttggcagactgaacgaaccaacccaaatcatggattagctgtttaaatgtgtgagatgattggataatataacataaaaaacctgaagatatgacccattgcttcctgagacgtttacatacaaatgccagaaacgataaatctaaagagggccagtccttttccttttgctccaccgtcagtaccagtcacattcttatttcataattctagctacatgattactcattcaaactttctgtgcacttcctccattaaatgtttatgaatgttatcaactgggtgccttctttttttttttttaaataagagatgtggtctcactatattgcctaggctgggctcaaactctttggcttaagcaatcctcctgcctcagcctctcaggtagcagggtggctaacttggggcttttaggttactgacttataaaggtttctttccacaaaatcatgaagatgaaaatggaacagagaacactgtgggtcccagctcaggtccacagttagaaaacttaggccctaagtatatcctagctccagttgagaatctggatacaattggtaaattaacaagaaacatgacccagttaagaaagttatggcctaatgctttctatataggttacacagacatgaagagaaacaatagtgccctacatacaaaagctgaagccaaagaaaccaatggtagagtatctgaaaattcattaaaatatgaaaggatggggaaaacaactaaatgaaaatatgaactaagtaagagcaccattgtggtagactatagaagatgatatacaacaagaccttccttcaggtcattttgttgaagcagtactgggttagaatctaaaactcatttttttttggagaaaattagtccatgatttaagatcattacatttaggattctatgggataatgaatcttaagataaataagataggaataagactaatggtattaaagttcaaaaaggcagatagtttcaaaagacagtgctgtaaatttaggagtaaagtacagtatctctttttattaggttttgaatactcaaggtgtgtcacagtaagtcaaaagaaaatataccttataacagacgtacaaggaacagaaaaaactgcaattaactttcattagaggataagttaaggctacataaaagagatgcaatttgaactagatcttgaaggaaaaataagagtccgagatagagaaattaaagatacaggtgacgaagagtatagaggaagtagagagatgggattaaaagcactgttcacttaagaagtaaaggggaaaaggacattttcaaaatagaaagggaggagagaatggatgaaggtaccggaattataagatggcaagaagttgagaaaattcatatccttagcttatgtacaagtaagaacatcgaacagtttccaagctgaaaaggaagcaagggagccaggttaataggctggaagaaaaagagaagtccaaagactgctaatttcagtatcttcagtgacaggagcatggataagagaaagaaaagatatttatgtctttgaagtgatcagttctaggtgacgacaaggtccaagaagcgtctaggtgtacaagatgctaaagtagaataaagataaaagaatgccagagtgcagatagaataaactgtaaggctaaggtgttgggtagttcaacaatatgaatacatagtcaccaagaatgatggtaagagaaacagaaaacagaaaaaagttgagccagatatcaaagtcctcagcgactgttaaggaatacactgtaggtcattaactgcaagagataaaagacaggtataaaactggatgccacaaatatcaaagaaaaaaatcactttaaccatactcaaacaatgaactggaagcacaaacggggcttacaaatgctcatttctcttcttggtctcttgttgcaggagagaggaaggaaaagtaatttctacttaaaaggcattccaggttatatgccatgagaggaagaaagcagttttcagcagggggagaggcattaaaaaaatgttgagattgcaaaaaaagttattggtatcagaatagggattccagaggctacagtggaaactgttaaaagttttaatgagtaggtgatagggagaaatcagagggtgaaggatgagtaagttgggggaaaagttaactatgagatcaagtactttatacttttgaagtaattatgaaggcagaaatagtaggtgaactggagggccaagttacaacagaaaatgtagctataaataagtttaaatggaaactttggaataacattaagatggaactatttcaagttcccttcaaagtatagggaagtcaaccgtaaggatcatggtctaggtcttctgtggcaggcagctgatatactgatatatactatttctttttttttttttctttttttagagatggagtttcactcttgttgcccaggctggagtgcaatggtgtgatctcagctcaccgcaacctccgcctcctgggttcaagtgattctcctgcctcagcctctcaagtagctgggattacaggcatccaccaccacgcccggctaattttttgtatttttagtagagacggagtttctccatgttgggcaggctggtcttgaactcccgacctcaggtaatctgcccgccttggcctcccaatatatgctatttcgacattcaacaaatatttattgagtacctatacatgctaagcccattctaagtgttgtggatacatcagaaaataacaaggacagaatgcctacccttgagtttatactccaacagtgttgtctgatagaactttctttgatggtggaaatattctacaatctgtgccttccaatatgatagtcactagcaacatgttgctagtgcacacttgaaatgtacttcatgtgactgaagaaactgaattttaattttttaaaattctaatttaaatttaggtttcaacagtcatctgtgactagtaatatcatattgggcagcaaaggctctaatgtaacttcttggcttcatttaatgtgagtccctgctatcaaagggaagcaacatacagggcaaacaatagaagttgtatttttctactgtgatttctctactgtcaaagagtcctacaagtctcatgagaatggcagtagccttcttataccaaccttctgaaagcatggttcttgcttgtgagcactggaaattgacactggccattattagcaaaaataaactttcctgaaagaatataagaacccactcaaaagagaactagaaaactgaaaccaggatacaataattgataggaatcacaggcaaagacatgccacagccctgcctggtccttcaaacattgacacatatcctttcatcccttacttcacagtttaaattcttgggagaaaatgtgtccaatgggccaatataattcttttcaagatggagtctaagtagaaaggtggatatattaaatgatagttttttggtttgtttttaaaaaagcaaatatccaacactggcagcaaagaaatccaaactgatgaaatgtaaacgttcattaaaagctcaagaaaaaaacagaaagccccaaatgggaaataagagccctggctttaagccatgcaaaaaataaattaagggggtattgactacaggatatcataaatgttcagcttccctttcccttggttattgctattccccttggttatttgctattatatcaaactgcatatcatttacttcctcctccttcacccactccacacagagacatgggcatataaccttggctgagccagagtgcctgataccacggtcgcagtggtaggtccagggatgagcatgtgaactagacccaaacttgtctctagattttttttttttttttttaagacagagtctcactctgtcacccaggctggagtgcagtggcacaatcttggctcactgtaacctccgcctcccaggttcacgcaattctcctgcctcagcctcctgagtagctgggactataggtggctgccaccacaccccactaatttttgtattttcagtagagatggggtttaaccaagttggccaggctggtctcaaatgcctgacctcaggtgttccacccgcctcggcctcccaaagtgctgggatcacaggcgtgagccaccacgcccagcctcgactctagactttttaaacttgagtttgctaacaagaactttgtcctcttggcttcaacatatgttcccagcatcacagagataggacagcagacaaacgagagagataataagagaggagagagaaaataagagaggaggaataaaagaaaaggaggagaaaagtcactattatctaattgcatttgagttcctagatccaggtgtccctgaaaccagcaaaacccttatctttcccacaattgtgtaaaccaagaaagtcccttttgtttgcttgcattagttggagttgcgttgctgtcataaccaaaagttgactacatattctattatatttaaactcctttaatttttacatggttttaatttgcaaattgaataaatgtgcagcggagcagccttttgaaatacagtacttttataaaaataatttttattactcttggcactatgataagctagtggtaaaaaaaaaacactttcatcaaaagaaaagactggtatataattaataaaggatctgtcaaagcagtgattaatatgtaatagattaatatctacttatcacagatatatattatttgtaaataaatggatatttctgctttgcatgatttatactttccatttccttagtaagaccttttgcttcacagataagtctccaatctgtcacgggttatctaaataggaggtgctgcaattatgaccattttaatgaatgatcaaaatagacctggttgatgtagctggacttataaatcagtaaatcataactgtcaaggaaaaaataccacaattgttgaacattaaaaaaaaaaagccatgcaaatcgtgtgaatttaatcctgctagattttatgttggttactatgtctttattttaaaataagttgaggtcatttacacattgtaagtgaaactccagaggaatcaaagaaaaattatcaatgtgactaacagaatagaaaattattcacatttaagaaaagctaaaggaatgaaagctgttttatatagcaaaaaactaaaaaacaaaacaaaacaaaacctaagggtcaagttcattattgtgttcaagtaatgacagaatgctgaacattttatcactatggcaacagaaacccaaagcaggagaaacaggcttaaattctaacagaaaagattctaactggccaaactgtgggattatcataggataaaacattagagtaggatgcctggggagggtctacccctactttctggagactgtcaaagagagatttaaaaacgacctgtcttgaatatgtcctaaaaaatgtacccatctaaaagcaaaaggacagacaagattggttcttaaaatctattacagattcatgcttttagaatcacagccactaacaatttaaataaagttataaaacctaagtaagtaataagtatacctctgcctgaagtaattctttcctaagtaatgcagatcaagaactctgtctcaaaacatagcctaccacttaatgaacatgatttttaaaagccactcaaactttatataattagagacgtcactaagatattagaatttgaaaagcagacataaagcatttccaagtgttgaggataacagcagatgtctagctctgtgttatccatatattctgcaaaaacaatacagaaaaagcaaagagaacaaataaagccacacaaaaccatacccttagcataactggcagacagaaaatgcccaaaacctcaaagtaactaagtaaaatgaaggaaaaaataccaaatcccagcaagtgatctctcccattcccgcctgcacatctttgcaggcaagggctcactgcatgtgaatgtacttaattcgcccattaaaataaaatgtttaatttattaaaatttggcccacaaaacaagacccaactaaacgctacatataaaacacacatttaaaaagcaaaacgattcagaaaatttaaaaataagaggataaaagtataccaggcaaatggaaactatatgaaaacagaagtggtgatggtatcagacaagtcaagcaaaaaaaaaagacaaaaaaagcaatttttaatgctaaacgctacaattcacacttaaaatagaactgctatgaatatttatattctgtaccaaataccatgaaactcacctttatgaaacaaaaactacaagatatacaaagagtcacatacagaaacacagtaataataggagactttaatatatcattctttgtacaagacaaatcaagtggacaaaaaataagcaagtatacagaagacctaaacatcgcagttaacaaggcagatcctatgtgtacagacacatatgtgtgtatgtatgtctgtgtgtgtatgtatatatatatagaacttcatatatatatatatatatagaacttcatactcttataagactccatgtgtttacgtaacacaataactgacatatactatgggactaagtgactatagttctatagtcgctgggcatgtgacatgtccagaatgcgaacttaagaagacacccattctaagactcctgcaagtgcagggtcagcaccgtgagactgtcgccttaaattttttgcaccctgggtgcctcaattgctttaccctagtcctacccttgatagattaggttacaaagaaacatcagagtgttccacaaagcagaaagagtacaaacaatattgtgatcacaatgcaataaagctagaaattaacttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttttttagtagagacggggtttcaccttgttagccaggatggtctcgatctcctgacctcatgatccacccgcctcggcctcccaaagtgctgggattacaggcgtgagccaccgcgcccagccgaaattaactttttaaaaaggttctcctacctggaaattaaaaaaccttctgttatagactgaaacatgttccttcaagatatgactacatttcgagatagggcctttaaagagacaattaaggttaaagtcatatgggtgggccctaatccaatatgactagtgtccttacaaaaaggatagacaagaggggatgcaaaggcacagagaaaaggccatgtgaggacaaagtgggaagaaggtggctacctgcaagtcaagaagagaggtcttaggagaaaccaagccaggcaataccttaatctatgacttctagtctccaaaactgtaagaaaattaattcctgttgtttgatcacccagtctgtggtattttattatggcagacttagcaaactactacatcttctgttaaacaactctttggcagaaagaaaaatgcaaattaaaattagtgaatttctttaaaaataataattaaaacactatataatttatgggatacacgtaaagcagtgatgagaagaaaattattagcactaaatactcttaccaataagaatgaaagaataaactgtagtaaaattaaattctcaactcaaaaacaaccaaatgaacaaagtaaactaaaagaaagcccaaggtatacaacatgaccttagaaaactctaagaaatcaacaaagcagctattagaaaatatgtgactttagtaaagtcacaggattcaagatcaatacataaaagtaaactatatttctatatgcaacgaacaattaagaagtcaaatgaactccatttataccatatttagaaataaaattgaatcaaagatgaacatgatatatacaatgaaaactgcaacacactgatgaaagaaatgaaacctaaataaatggagagatgtatgatattcatggattggaagactcaatattgttaaggtaacaattctcctcaaattgacctaaaaatccaatacaatcccaattaaaattttaacaagaatttaaaaagataaaaaactgattaaaaaattaatatttgaaaggcaaaggacctagaaaagccaaaagaatttagacaaaaaagaaccaggtagaggacgtgcactacctgaaccaaacttactataaagctacagtaatcaaaatggtatgatactggtgtaaagacaagatcagtaaaatagaatagagtccagaaatagactcacacctgtaattcagtgagggaaaagatagtcttcaaaaaatggtgctggaacaactggatacctacatgaaaataaaaagcatatgtgtgccattaccttacaccacataaaagttaagatgaattagaccttaaaacctaaaggtaaaaaccaaatattaatcttttagaagaaaacaaatatctttttaacacagaattaggcaaagacttcttgaagagaacacaaaaaatacaaacaagaaaaaaattgataaagtggtgtagtattatgatgtatatatattggtttacatatacatatgggtttacattcatggttcctggctcgtaacttccatagcccttgtccacatttcctaagtgactaaaacaatacatgtatctttgttaccgtattaggccctttgtttatggctcgggaggcagcttcagaacagcttcagagtgataaaggcgaaagacagtctttggttataatactggggtgctctgggcctcagaaaacagaatctctctctgaccttctgtcctccttttacctgcgcctttttctctccaaggcaggccacacacactaaaaatatactccaatcttcccccatctttctgtcttggaactggtcataaaaaaatcctctgaattaccttacccgacagcaggtcataagacccgcatttctgaaggggtcctgccccttccttatccaggaggaaataatgctacacagaggggccaagaagaatctaaatgcacaggacttgttacaattctctgcacagtctattagtattagatcatgccctttttgtccaataagatttccatacgattgtccattcttcaatcatgtttatccaatgaagtctccaaaaaagactcaagaggacagggtaccgcaagcctccagacagctgaactcatggaggattacatgaaggtaaacaagaactcacccatgtgctaggagaatggcacactccaacttcacaggaacagaagctcctgagctctggacccttgagatctcaccctattatttctctttcttattgtttttttgagacggggtcttgctctgctgcccaggctggagtgcaatggccaatctcggctcactgcaacctctgcctcccaggttcaagcaagtctcctgcctcagcctcccgagtagctgggattacaggcacctgccaccacgcccaactaattttttttgtatttttagtagagacggggtttcactatgttggtcaggctggtctcaaactcctgacctcaggtgatccacccacctcagcttcccaaaatgctgggattataggcgtgggccaccgcacctggcctattatttcttcatctagctgtttatttgtatccgcagtgagctgagatcacaccattgcactccagcctgggtgacagagcgagacgccgtctcaaaaaaaaaaaaaaaatcctcttcaataacctgggaaacataaagtgtttccttaagcttgtgaaccactctagtaaatttagctgaaagagaaggttatggaaaccccaacttaaaaacctggtcgatcagaagttccagagtcctgaaagtgagactggtgtctgaaatggtggcaatcttgtgggaccaagccttcaacccgcaggatctgatgctatctccatatagagagcagtagaatcaaattagattagaagatgtcagactgctgtccactgcagaactgaatgcttgcttgttgatgggtagaaatccatacatttggtcacagaagttttctgtgttgtggtgtgaaaacacaggaaaaaacaccactcaggagttcaagaccagtctgggaaacatggagaaaccttgtctctgctaaaaatataaaacttagccaggcacggtgccatgcacctgtagtcccagctactcaggaggctgaggtgggaggatcgcttgagcccaagaggcagaggttgcagtgagctgagatggcaccacggcactccagcctgggcaacagagcaagatcctgtatcaaaaaataaacaaatatatatatatatatatacacatacacacacacacacacacatacacacacacacacatacacacacaagtaaatgaaaaggaaagtcatagataaggagaaaatatctgtaaaatatgtatctaagaaagagcttttatgcgtaacacataaataactattataaatcaataagataacttctgaatgtaaaaagtggccaaaatatttgaacagaaacttcacaaaagtagcttataagcacacaaaaagatgctaaccaccactagtcacagagacaataaaattaagaccacaggtgacatgttacaacatatccaattagaattattattaagactgaaaataacaagtgtcagtagggatgtaaaacaaacaaaatcctcatatattgctagttggaatgaaaaaacttctcaagtgtttccacattggaaaacagtatttctgtatgttataaaattaaatatatacttaacatatgacttagtaatcccatttctaggtatttaacaaggagaaataaaaacatatttccacacaaagacttgtaaatgaatgttcacagcagcattattcataatagcccccaactaaaaacaacccaacatttgtccaacaaaagaataaataaatcatattacgtttatacaatgaatactaatcagcaataaaaagacatgggctactgatacactcagagcatggataagtcacgggttgcctaatgttgggactcaggaaaggaggtcaactataaagagacataaagaaacttttggggtgatgaaactattccatatttttattatggtgaggattgtacaactgtatacaaaatggatgaattttattttaggtacattaaatgataacaataaaactatagaaactttttaagggcaaagaaccagaagataaaagcagaaattaatgagttagaaaatgggaaaccagtcgatctaataaataaaccaaaatcctaatttaaatgaatgtactgaactgtatgttttaaaatagttaaaatggtaaattttatgtatattttaccacaaaaaaaatatatatatatacacaaagcagtggctgacttgaccaagaaagaaagaaagcacacgtatagaacaaaaaataacaaaggggaaataagcattgaaacagaaaaaaaatttaaaaaaaagaggtctacttttcaaaaggaggagcatagtggccagccgtcagaagttgacaatgaccagttgagagcaatcattggagctgatcctctacaactacacaagaagctgccaaagaactcaatgtcaaccattttatggtcatttggcatttgaagcaattcggaaaggtgaaaaagctagataagtgggtgtctcatgaactgagtgaaaatttaaaatatcgtcattttgaagtgtagtcttctcttattctatgcaacaacaaactatttctcaagcagattgtgacatgcgacaaaaagtggatttcatacgactaccggcaatgaccacctcagtggctggatggagaagaagctccagagcacttcccgaagccaaacttgtgccaaaaaggctcatggtcactgtttggtggtctgctgccggtctgatctactacagctttctgaatcccagggaaaccattacatttgataagtatgctcagcaaatcgatgagatgcattgaaaactgcaatgcccgcagccggcactgatcaacagaaagggtccaattcttctctacgacaatgtccaactgtatgccacacaaccaatgcgtcaaaagtggaacgaactgcactacaaagttttgcctcatctgccatagtcacctgacctcttgccaactgactatgacttctttaagcatctcaacaactttttgcagggaaaatgcttccacaacgagcaggatgcagaaaatgctaagtgtttgtctaatcccaccaggtgtggtggctcacacttgtaatcccagcactttgggaggccgaggtgggtggatcacctgagatcaggagttcaagaccagcctggccaacatagtgaaacaccgtctctactaaaaatacaaaaattagctaggtgtggtggtgggtgcctataatcccagctactcgggaggctgaggcaggagaatcgctgaacccaggaggtggaacttgcagtgagccaagattgcgccactgcactccagcctgggtgacaagagcaagactctgtctcaaaaaaaaaaaaaaaaagaaaaaaagtttgtagaatcccgaagcatggatttttatactacaagaataaacttatttctcattggcaaaaatgtgttgactgtaatggttcctattttgattaataaagatgtgtttgagcctagttacactgatttaaaattcatggtccaaaaccacaattacttttgcaccaacctaataatacaccatattaaaagaatgaagaaaaaaatgcatgatcatctcaactgatgcagaaaaagcatttgacaaaattcaacaccctttcatgataaaacaaactaacaaactcggaatagaaggacactacctcaacataataaagccatatatgaaaaagccacagtgagtatcataagcaatggtgagagactgaaatgttttcctttaagatcaggaataaaccaagtactcccacttttgccacttccatttgacatgaaactggaagttctagccagagctattaggcaagagaaagacaatgaattcagcaaagtagctgaatacaaagccaacaaacaaaaattagctgcatctctatacactaacaatgaatactatgaaaaggaaaatgaagaaaataattccatttacaatagcatcaaaaagaatacataaaaattaactgaaccaaggaggtgaaatacttagaaaactaaaagacgctgctaacagaaattaaagaagatataaataaatggaaacacatcccatgttcataaattgaaagattcaatattgttgagatgtcaatactaccaaaaataatctacagaatcaatgcaattgctatcaaaatcccaatattttgcacagaaatagaaaaatctatcctaaaattcgtatggaatctcaaggcaacccaagtagatgaaataatcctgaagaacaaaactagagaactcatacttccttatttcaaaatttattgcaaagttataataatcaaaatagtgtgacactgacataaagaccaacatataagcaactggaatagaatacagaatgagtaaataaaccctcccatatacggtcaaatgatttttgacaagagtaccaaggtcattcaatgaagaaagggcaatgttgtcaacaaacagtgttgggaaaactggatacatacatataaaagaatgaacttggacctctctttatataggaaaattaatttaaaatagatcaaaggactaaatgtgcaacctaaaactataaactcttagaagatgggggaaaggcttcatggaatttgatttgataatgatttcttggatatgacacgaaaggcatagggcaataacaacaacaacaaaaaaaaacagacaaaatgaactccatgaaaataaatttttctgcaacaaaagatacttatcaacagagtaaaaccctacagaataggagaaaatatttgcaaatcatgtatctgataaggcattaatatccagaatatacagagaaaaactaaacaagaataaaaaataaaatttttaaatggacaaaaaacttgactagctgtttttcaaaaaagatgcatattaaaagatgctcgacatcactaatcattagaaagatgcaaatcaaaactacaatgagatacttactacctcacacctatcaggatggttactatcaaaaaaacatgaggaagacatcattaagatgactgactagaggaccaacactcttccacaaaggcccaaaataacaagtaaataactgcacttcaggtaagagtttctaagggagaacaacagaattcacatgaaagagaaaaaaaaaatccacttaatcatggagacttgagatggcagcatagagaagaaagcaaagcacccagccaggattggctcagaaccaagagagactccccattgtgtgagaaatggtaggtaggagttccttagcaatccctaataccactgtggacatgtgtaaacctagctacagaagagccctagagtcctaacaggccctgaatccggtacagggagctgcttggagtccacatggttacattgctccagagaaggaacacacactgggtccccccactccctgtgacccaagctgctacagcatggcaccattttgagaaccgagccaatgctgaaatacatgctgccatggggttcaacagacctggtatttccatatctgaagggtcccactgtaatcatgccacaatcaaataaaagggtccaacaccacaacctcagctacacagagcagtaaagccaaaactccagaacctgagctgatatagtagacctaaaggaacaagcaatctagcacagcagggaggccacctccaagaccaagggcactggtgcatgcagtccctagggtttaagaactagctgccagccactgccagcaatcccattcccataactggtgaagcagaaatgcaccccacatacctgtagggaccaatgatgggcccatatggcaacagccaccactggcaattccaccccacaactggcaaagccaccatacccaatgagcacccaacacccaaggcctgagaactgttccacctagaggcccctatcaacaccaaagacatgagattcattctacaaaaactcacagcagagaccactgaggtacttgcagacactgctgacacgaattacagccaaagatcatatggagactacattactgtactaatatagaaacaaagccaaagcaactacccaaacaatactgcaggacaaatatacaggaaaaagtccttctttacaaaagctactccataaaatagaaagagacaactattctaccagatgcacccataacatagggacacaagaaacatgaaaaaagttgggcgtggtggttcacgcctgtaattccagcactttgggaggccaaggcaggcagatcacgaggtcaggagtttgagaacagcctggccaacatactgaaaccccgtctctactaaaaatacaaaaaattacctgggcttggtggtgggtgcctgcaatcccagctacttgggaggctgtggcaggaaaatcgcttaaacctgggaggcagaggttgcagtgagccaagattgtgccactgcactccaacctgggtgacagtgtgagactttgtctcaaaaaaaaaaaaaaaagaaacatgaaaaagaaaacatgacacctcaaatggaacccaataatactccagtaatagaccctaacgaaaaagaaatctaaaaaatgcctgaaaagaaattaaaaataacaatgttaaggaaacttggaaagatacaagagaatacagatagaaaattcaacgaaatcaggaaaaaatgatatgaatgagaaatctgagagacacagatatcataaaaaagaaccaaacagaatccttggagctgaagaattccatgaacaaaattaaaaatacaatcaagaatttcaggaacagtctagatcaagcaggaaaaagaatttttgaacattaagacaggtcttttaaaataatccagtcagacaaataataataaagaataaaagggatgaagaaagcctatgagacttatgtgacaccattaagtgaacacatattcacattataaaaattccagaagaataagagatgggaaatggtatcaaaaacgttgtaaacaaaatcataactgtagagttcccaagtcttaggagagagatgaacatccaaatccaaaaagctcaaagaccccaaactgattcaacccaaaaaggtcctctccaaggcatactatactcaaacatcaaaaatcaaatcaaagagagaattctataaacaacaagaaaaaagcatcaagtcatatataagaaaatccccgtgagacaaacagcagatttctcaagagaaaccttacaggcaagaagagaacagaatgttatactcaaaagtagtgaaagaaaaataacttccattccaaaatactatacccagcaaaactatcttcagaaatgaagaagaaacaaagtctttctcagacaagcaaaaactgagacaattcatcaccactaaacctactcaacaagaaattcttaagggagtcctacaactgaaaatgaaaagacaatgactaacatcatgaaaacatgctagtataaaactcactagtagagcagatagatatacaaatgagaaagaaatcaaactttgtcactacagaaatccaccaaaccacaaagataaacaattaagagagcaagaaagaaacagaagatctacagtacaaccagaaaacaattaacaaaatgacaggactaagtccttctctaccaagaataactttgaatgtaaacagattacatcccccaattaagacatatagactgggtaaaggcataaaaactcaaagcccaaatataagctgcctaaacacaactcacttcacccataaagacatacatagtctgaaaacgaagtgggggaaaaaaaaaaaaacactccatgcaaagagaaaccaaaaatgaacagaagcaacttacttatatcagataaaataaactttaagtcaaaaactgtgaaaagtttgtcacactgtaaaaagaactgtaaaaaaaaaaagtttttaagctgtaaagagacaaggaagttcattatataatggaaaaaaaaacccaattcagcaagaggattagcaatagtaaatatgtatgcatcaaacaccagagaaccaagatatattaaagcaaatataattattatctaaggggaaagatagacaccaatgcaataatagtagaggatttcaataccccactctctgcattagagagatcacctagaaagaaacatagatttaaactacactgtagaccaaatggacttcacagacacttgtaaaacatttcatccagtagctggagaatgcagagtactcattcttcttcttctttttttttttgagatggagtcttgctctggcacccaggctggagggcagtggcacaatctcggctcactgtaacctctgcctcctgggttcttgtgcctcagcctctcgagtagcggggattactgtcacgcaccaccaaacccaatcaatttttttctgtatttttagtagggacaaggtttcaccattttggccaggctgctctccaactcctgacctcaagtgatctgcccaccttggtctcccaaagtgctgggattacaggtatgagccaccatgcttggccagaatattcactctttttatcagaacatggagcattccacaggacagaccatatgttaggccacaaaacaagtctcaataaatttttaaaaatcaatatatcaagtatattttctgacaacagcagtataaaactagaaatcagtaacaagaagaactctgaaaggtgtacaaatacatgaaaattaaataacatgctcctgaatgaccaatgagtcaaggaggaaattaaaaaattaactgaaggccgggtgtggtggctcacacctgtaatcccaacacttcagcaggctgaggcaggaggatcacaaggtcaagagatcgaaaccatcctggccatcatggtgaaaccctgtctgtactaaaaatataaaaattatatgggcgtggtggcacacgccttgctactcgggaggctgaagcaggagaactgcttgaatctgggaggtggaggttgcagttagctgagatcgtgccactgcactccagcctggctacagagtgagactccgtctcaaaaacacaaaacaaaaaaaaacagaaaaatttcttaaaaacaaataaataaaaataaaaatgcaacatacccaaaacctatgcaatgaataccacaaaagcagaattaagagtgaaagtttatagcaataaatgcctacatcaaaaaagtacagaaacttcaaatcaacaacataatcatgttccccagggaactagaaaaacaagaacaggccgggcacagtggctcacacctgtaatctcagcactttgggaggccaaggcgggtggatcacgaggtcaggagatcgagactatcctggctaacaccgtgaaaccccatctctactaaaaatacaaaaaattagccaggcatggtggcaggtgcctgtagtcctggctactcaggaggctgaggcgggagaatggcgtgaacccaggaggcagagcttgcagtgagcagatcgcaccactgcactccagcctgggcaacagagcgagactccgtctcaaaaaaaaagaaaagaaaaacaagaacaaacaaagcccaaagttagtagagagaactaaaacgtaaaaatcagtacagaaacttacaaaaagatgttgggagcaagccccccaaagtctggccataaactggccccaaaactggccataaataaaatctctgcagcaatgtaacatgtccataatggccataatgtccaagctggaaggttgtgggtttacaggaacgagggcaaggaacacctggcccgcccagggtggaaaaccgcttaaaagcattcttaagccacaaacaaaagcctgagcatctgtgtcttaagggcgtattcctgctgcaattaattcggcccatcctttcgtttcccttaaggggtacttttagttaatttaatatctatagaaacaatgctaatgactggtttgctgttaataaatatgtgggtaaatctctgttcagggctctcagctctgaaggctgtgagacccctgatttcccacttcacacctctatatttctgcgtgtgtgtctttaattcctctagtgccgctgggttagggtctcccctaccaagcctgtctcggcaagtggcgcccattcatgggggctcgaatccaggtcgaagggtcgccagagcgacggctgggaacagaaaactagctggaggacacccgagtactcttaaagcaatccctgtggtgagtaagaaggggagctctgaagcatcagggtaacaatgggataggtatggggtctggttcgtttcatcttagaactttttcacactgataacaaggaggaacaagagtatagtgaagtaacagaagaggttacagagcatgtttatttgccagctaaagctaaagcggcaaaggaaggacaggttcatccctacccttctgcaccccctcattattttttgaggaaaatgaccccccagatctttcttttccagaggacactgggtgaaaaatagctgccccagtgactgttcgagcagcgcctcgagcgatggctcttagttctattaggcaggaattcggcaagctagacaagagggtgatttagaggcttggcagttccctgttagaatacatcccccagatcaagagggaaatattacagctatatttgagccttttccttttaaattacttaaagaactaaaacaagcaataagtcaatatggaccaggttctccttttgtaatgggactgttaaggaatgttactgtttccagtcggatgattcctactgactgggacgctcttactcgagcttgtctaactcctgctcagttcttacaatttaaaatttggtgggcagatgaagcttccatttgggctgctcgcaatgcccaggcccaacctcaaattaatataactgcagaccaacttttgggggttggcggctgggctggtttagatgcacaactggtcatgcaggatgatgccatagaacaacttagaggtgtgcacattagagcttggggaaaaaaaatcacttaatgtggggaacaatacccttcctttagtgctataaaacagggaccaagggaaccatatgttgattttatagctcggttacaggagtctcttaaaaagatgattgcagatttggctgctcaggatatagtgttgcagttattagctttccacaatgctaatcccgattgccaggctgctctgtgacctatcagagggaaaacacatttagttgattatatcaaggcctgtgatggtatcggaggtaatctgcataaagctaccttgttggcacaggcaatggcaggactgagagtggataaaggaaatactccatttcctggagcttgttttaactgtgggaagcatggtcatactaaaaaagaatgtagaaaaaatcagcgagtcaggccaccagataggggaaaaaagaaaactgttgagccagaaatatgtccaaaatgtaaaaaaggaagacactgggctagtcagtgtcactctaagtttgataaagaagggaatccgatttcgggaaatgccatgagggagccgtctcgggccctgttctaaaccggggcatttccagcacaggccattccctcacccctgtacaatgtctgtcccctgccacagcaagtagttccacagtagatttatgctgcacaaaagctgtgagccttctgcctggggaacccctgcaaaaggtcccaacaggagtctgtggacccttgccagcagggactataggattacttttaggaaggtctagtgtaagtttaaaaggtgtacaaatacatacaggagtcattgattcagattataatgggtatattcaaattgttatatctacttctgttccctggaaagcagagccaggaaagcacatagcacagctcctgattgtgccgtatgtgggaatgggaaaaagtgaaattaaacgaacaggaggatttggaagcacaaataaacaaggcaaagcagcttactgggtaaatcaaattactgataaatgtcctacctgtgaaataactattgaaggaaagaaatgtaaaggtttggtagatacaggagcagacatttcaatcatttctctacagtactggccatccacgtggccaattcaacctgctcaatttaacatagttgaagttggtaaagtcactgaagtatatcaaagtagttatattttgcattgtgaggggcccgatggacaacctgggactattcaagcaattataacttctgtacctataaactgatggggaagagatttattacaacaatggggagcacaagttctaattccagaacaattatatagccctcaaagtcaatatacaatgcatgaaatgaggtatgtccctggtacgggactagaaaaaaaaattgcaaggtttgaaagaaccacttcaagtggaaaaaacaaagttcccgccaaacattagggaaaaatttttgatggcagccattgttaagcctccagaacctatacctttcaaatggttaacagatacccaatttggatagaacaatggctgctaagtaaagagaaactggaggctttagagaaattagttgctgaacaattagaaaatgggcacatagctccaacattttcttcttggaattctccaattttcgtaattaagaaaaaatcaggaaaatggaaaatgttcactgacttaagagccaccaattcagttatacaacctatgggagcattacagccaggattgccttctcctgctataattccaaaaaactggcctgattcctgcaagaagtagctcaccatgacaaagctgcccttgcttttatctctttgcaaatctaagaagggagacatgttgggagcaaccccccaaagtctggccataaactggccccaaaactggccataaataaaatctctgcagcaatgtaacatgtccataatggccataaagtccaagctggaaggttgtgagtttatgggaatgaggacaaggaatacctggcccgcccagggcagaaaactgcttaaaggcattcttaagccacaaacaaaagcctgagcatctgtgtcttaagggtgtgttcctgctgcaattaatttggcccatcccttcatttcccttaagggatacttttagttaatttaatatctatagaaacaatgctaatgactggtttgctgttaataaatatgtgggtaaatctctgttcagggctctcagctctgaaggttgtgagaaatcaggggatttcccacttcacacttctatatttctgtgtgtgtgtctctaatccctctagtgccgctgggttagggtctccccaactgagctggtctcggcaaaaaggagactaaaaaactataaaatatcaacaaaacaaaatgttggttttttgaaaaaacaaaattgacaaaacattagctagactaactaaaagtgagaagacccaaataaataaaatcaaaaatgaaaaagcagacattacagctgatgccacagaaatactaaagatcattagagactattatgagcaactgtaggacaacaaataggaaaacctagagaaaatggataaattgctaaacacacaaaacctatcaagactgaaccaaacagaaggaaatacaaaacctgaacagatcaataatgagtaacaagactgcatcatcaataaaaagtctcccaagaaaaaaagcccaggaccagatggcttcactgctgaattctaccaaacttttaaaaaagaactaatactaattcttctcaaactattccaaaaaattgaaagggagaggattcttccaaactctacgaggccagcattaccctgacaccaaaaccagacagggacacaacaaaaaaaagagcactatggccagtatccctaataaatacagatgcaaaaaccctcaacaaaaacaccagcaaaccaaatccagcaacacgttaaaaagattattcaccatgatcaagttagatttatcacaggtatgcaaggatggttcaatatatgcaaatcaataaatgtgatacatcgtatcaactgaatgaagaaaaaacgataatttcaatacatgcagaaaaagcgtctgacaaaaattcagctttccttcatgacaaaaactttaaaaaaaattaggtataaaagaaacatacctcaatacaatgaataccatatatgacaaaaccacaactaacatcatactgaacaaaaaaacattgaaagcttttcccctaagaactagaacaatacaaggatgttcacccttgtcaatcttattcaacacagcactggaaatctcagccaaagcaattaggcatgagagagaaataaatggcttcaaaataaaaaaggagaaagtcaaaactgtccacttgcagatgacattatcttatatatagaaaaacctaaagatcccaccaaaaagctcttagaacttttaattcattaaagtttcaggataaaaaaactcaacatacaaaaatcagtagcatttctacatacttaaactaactggaaaagaaagaaatcttctttattataattataaaaattaaaatacctatgaataaatttaacaaaggaggtaaaagatctctaaaaggaaaactataaaatactgattaaagaaattgaagacaccaaaaaatgaaaagaaatctcatgcttatggattgggagattaatattgttaacatgaccatactaccaaaagtgatctacagtcaatgcaatttctaccatattaccaatgaatttcttcacagaaattgaaaaaaaaaatcttaaaatttgcatggagtcacaagactccaaagagtcaaagcaatcctgtgtaaaaagaacaaagttggagctatctatcacactatctgacttcaaaatatgctacaaagctgtagtaaccaaaacaccatagtactggcataaaaacacatacacccacaaatgaaacagaagagagaagtcaaaaataattccacatatttacagataactgattttcaacaaaagcaccaagaaaatacattggggaaaggacagcctcttcaataaatgattatgggaaaactgcatatccaaatgcagaagaataaaactagatccatctctcatcatatataaaaatcaaaaacttaagtatgagaccccaaactatgaaactactacaggaaaacacaaggaaaagacttcaggacattgccctaggggaagattttacgggtgagacctcaataacacaggcaacaagttgggcatggtggcacgtgcctatagtctcagctacttgggaagctgaggcaagaggatcacctgagtccagaaattttgtgctgtagatgctgtagtgcgctactgcaattgggcattcacattaagtttcgcatcaggataatgacctcccaagagtagaggaccaccagaatgcctaaggaggggtgacctgacccaggtcagaaatagagtgggtcaaaactctacgctgaacaatagtagcattgcacctgtgaatacccactgcaatccagcctgggcaacacagcaaaatcccatcccttatataaatacaaaaacaaaataaatgaaacaactataacaacagaaaacgcaggcaacaaaagcaaacatagataaatgagatcgtatcaaaccaagtttctgcacaacaaggaaacaatcaacagagtgaagagacaacctatacaatgggagaaaatattaatacctgcaaactaatttttttttttttgagacagagtttcgctctttttgcccaggctggggtgcaatggcatggtctcggctcaccacaacctccgcctcctgagttcaagcaattctcctgcctcagcctccagtgtagctgggattactggcgcacactaccaggcccagctaattttgtatttttagtagaggcagggtttcaccatgttggtcaggctggtcttgtactcctgacctcaggtgatccacccgccttggcctctcaaagtgctgggattacaggtgtgaaccatcatacctggcccacctgcaaactatttatctgacaagggattaaaatttagaataaacaagaaactcaaacaactgcaaaaagccccaagtaatttcatttaaaaatgggcaaatgatctgaatggatcattcatgaaaaattgttcaacataactatttatcagggaaatgcaaatcaaaccacaatgagatttcatctcaccagctagaatgcctgtcaaaaagacaaaacaaatgttgtcaagaatgaggagaaaagggactctaatacactgttagtggggatgtaaattagtatagccattaagaaaaatagtatggaagctctacaaaaaaaactaacaacaggccaagtgcggtggctcacgcttataatctcagtactttgggaggccaaggcaggtggatcacttgaggtcaagagttggagaccagcctggccaacacagtgaaaccccgtctctactaaaaataacagtcaatcaattaatcaataaattagccaggcatggtggcacacacctgtaatccagctgctcaggaggctgaggcaagagaatcacttgaacctgggaggcagaggttacagtgagccgagatcacaccactgcactccagcctaggtgacagagtgagaccctgtctcaaaaaaaactgaaacagaactaccacaggacccagaaattccacaactgggtatatacccaaagcaaaggaaattagtatgtcaaagtgatatctgcactcctatgtttactgtagaactattcacagtaagcaagatatggaatcaacctacgtgcccatcaacggatggataaagaaaatgtggcatatataaacaatggaatactattcagccataaaaaaggatgaaatcctgtcattcatggcaacatggacaagtatggaggacaattgttaattaaataagtcaggcacacaaagatatatactgcatgttctcactcacatgtgtaagctaaaaagtttatttcatagaactagagagtagaatagtggttactagaggctggaagggtagtgaggagggaagacagaggttggttaacaaatacaaaattactattggataggaagaataatttctggtgttctacagcactacagactgactacagttagcactaatttattgtatatttgagctagaagagacgattttgaatgttcccaaatcaaagaacatatgaaatgtttgaggtgattgaatatgctaattaccctgatttgatcattacacattgtatacgtgaatcaaaatatcacactgtaccctgtaaacatgtacaattgtgtgtcaattaagttttttaaaaacatgaaataagtgctggtgaagatatggagaaattagaagtcttttgcatttttggtgggaatttaaaatggtgcagccactgaagaaaatagaatggcagttcctcaaaaaattaaaaacagaattacaatataagccagtaattcttcttctggatatacacccaaaataactgaaaccaaggtcgtaaggagatgtttgtacacacatgttcataacagcattattaatagctaaaatgtggaagaaatccaggtgtccataaacaaatcgataaatatagtatatatgtagaactgaaatattattaagccttagaaagtaatgaacattagggcaggtgcggtggctcacgcttgtaatctcagcactttgggaggctgaggtgggcaaatcacctgaggtcatgagttcgagaccagcctggccaacatggtgaaacggcatctctacaaaaatacaaaaattagccaggtatggtagcaggcgcctttaatcccagctacttgggagactaaggcaggagaatggcttgaacctgggagacagaggttgcagtgagctgagatcatgccactgcactccagcctgggcaacagagtgagacgctgtctcaaaaaaaaaaaaaaaaaagtaattacatcatgctaagtaaaataacccagtcaaaaaaaaaagacaaatactgtttgattccacttacaaaggtatgtagagcagtcaaaaatcctaaaagacagaaagtgaaatggtgattaccagggtttgggaggatgggctaaaggggagttattgtttaatgggtacagagtttgttttacaagctaaaaagaactctggagatagatggtaatgatggttccacaatatgaatgtattcaataccactgaattgtacacttaaaaatagttaagatggtagattttatttttacatgtattttaacaattttcaaatattggaaaaaaattaatggaatcccaataaaactgcaaacaaactttttaatggagctagacattaatattcaagttgatatgaaaaaacaaacatataattatagctaggaaaatactgagagaaaaactataaggactgagtaccacaaccagacattaaagcatactataaagcctctataattaaagtatcataataatggtacaggcgcctaaagttccaactacttgggaggctgaggcaggaggattgcttgagctcaggagttcagtgttacagtgagccatgatcgctcactccagcctgggcaacaaagaaagactctgtctctaaataaaaattaaaacaaaaaaaatttttttaatgtaaaatggcacatgaacagacaaccagatgagtgaaacagaatagaaagtccagaaatatacccaagtatatatggaaatttaaaatacaataaaagcatcatcatgaatcactggggcaaagacaggtttttaataaaagtgtgggacaatcaattagccatttagaaaaaactgatcaaatccatacctcacagcatacaaaagaatacacttcaaatagatcagagaactaaatgtaaaaaatgaaaccatacaagcaaaaagaagtgaattcctctttaacctcagttcagggagagagtactaactctgacttaatacccagaggcaataacagattaaatttgattacataataaaaatttttgcatggcaaaaaaataacggaagcaaaatcaaaggactgctgacacacactggcagaaaatatctgcagcataatcctaatatataaagaactcttaaaaagtaaggtaatttaaaaaaaatttttaagcaagggaaaaaaggccaaaaaaaccaagtataatagggaaagacaagaacaaacaatacatacaaaaatgatataaaaatggcccttaaacacatggaacattgttcaatctcatttgtaatatgagaaatgcaaattaaactacactaagatgcaaagtgatataattctcttggatggaaatttggcaatatctaacaaaactgcgtatgatttaccttttgacccacctatttacttcaggaattcaccctgaagatacacctccagaaaatgaaaatatttacatgtacaacattattgattagttgtaatcacaaaatactggaggccaggtgcagtggctcaacacctataatcccagtactctgggaggccgaggtgggcagatcacccgaagccagaagtttgacagcagcctggccaacatggtgaaaccccacccctactaaaaatacaaaatttagccagttgtggtgacatacacctgtaatctcagctactcaggaggcaggagaatcacttgaatcccagaggcagaggcggaggctgcagtgagccaagatcgccccactgccctccagcctgggcaacagagcaagactgtgtttgaaaaaaaaaaaaaaaaaaagacaaaatattggaaattaaatgaacataggagactatttcactaaacactgatagatacacatagtggagtgctatgcagccataaaaaagaatgaggctaatccctatgaactaatctgaagcagtttccagggtgcactgataagaaagaaggaaaaatacaatgacatctggtatttgtgaggaacaaaaacaaacaaacaaaaaatgtaggaagtctaaaccagaaactaatgagattaatctcacatggggcaggatagatgagaaaagatgagggaaatgggaacagggtagaggagatgtgggaagtggcatttttttgaaggttttgtttttttgtttttgtttttttttggtgtattatagttctgtcctttagaaccatgtagacattccaaatgcccaacatattaataaataaataaacaaggatgaggtatggactcaaaacagaatagaatagaaagaataaacctgctttataagtgaataacaaaccacattaaaggagaatttggtgagaaaaatcctaagtaactttggaaaataatattttgactatatactctaaggctaaagataaaaacaactatacacaaatattacatgtaagttaataggtttgtttttcattgagtgatgagttagcaattctaaaacaactttatattttaggactgaggaaataagtaaatatggtaggaataatgaatgccagttttctcactgtcaaaagaattgcaagtatgaaaagaggaagaccagaatgaactccacggtgctggaacagaactggaaatatcaatgtaaactcaagattattaatatagagaaaaaataaagaaatagatgtaaatgtgtaattttcagttcactgggaggacctagaagcaatgactctctagtaccaataagcatacctagagttgagattttggtttctaaatgccattctccaattaaaaaggaatcaaagcacctcagataaatgtttaattccagggctggggcagggaaagtgaaagagaatcacagaacatcctgtaatgacagaaaaaagtcacaataaatggtgggattatgtcaaaaggacatgggattcaacttgaaagatcttccaatagccaaatctgagaaaagttaagcaacaaaaaaaataacaaaatcttataatctatagaaaaaatatgaatgtataaatccataatgatataaatatatttagaggagaagggaaagcacttactttcaggagaattccaactaataaatgaggaaggatcatagaaatggaaagatcaccatttggcaaatgctagagttataactgtttcagataagaattatcaatggatactaaaattaatggaagattatataaaggcaaaatatgagaatatttacacagacttgaaatatcatatgggcaaccacagataattatatattacaaagggaaaaaatagtaattttataggggaaaaatgtggcagataccaccttaaccaagtgatcaaggttaaaatcaccagttaaggggccaaatcatggaaattcactgaggacacatgactttgatgttttgctaaaaatgcctaacctgaatttaaccatgaaaaatgcaatacaaaaccaaaatgagagaggatatacaaaatactgacaagtatttgtcaaagtgttcataagttccagattaaaagtaactaaatgcaacatgtgatcctgaattgggttttagaccagaagaaagacatcagtgggacaactggtaaaatttaagtacagttaatagattttataatagtaatgcctgatttcctgattatattcatgttaatttcttaatcttgattattataatatggttacataggtatttgtatttgggagatcagggtgaagagcacatgggaattctttgtactagttgtacatcattttgttaactctgaccttatttcaacatgaaaaactttaaatatatatgtatatataacctaacactctgaagctccttcctggtgatctcttctgccatctgtgaagcccgcaatttctcttcatactgatccttttcagattgcctccagacatcatgttccactttcattttctccaaatctgctaatctgttctcgagttctaacctaaaacaagagatcataattatgttacaagaactataataaagatgatatgacagcaaaatgttttcatttgcaaggatatttaagtcaaactaaggtaattaagtacttacttttcatcttgtaataccacaagtttttgataaccttcttctttggcagcttgtactttacgtattaattcacgatccttttctactaagagcactttgtgatgttcaacagctgctttgagaatttcattgtctgactgtaatcctagtgtttttcaaggagaaaagtgtactatattcaatgttattaagatgaaaaatcacatttaacagcaagcattcataagctggtaagacaaatgaatgtagaaagtctctacaaatatatattctcaacaatactcacatcattaataaacactcttaaaataagaatgaaacaggctaaaactcagagcaaattttcctgtcactgtttatttagtgcatacacatataaaaactttaataaaagctgtatacatttactcattcgaacattgagagttgagatcaaactggatgataaccagaggtttacttacttcacctctaaagaggttctgtgacctaagcctcatagaaaaagctggctgatagcagagtgaaataaatcacaaaacccttcaaaacctattgattctagcagaattgctagatctctagcagaagtataaataacatggacactttcaagtttgtacaatgaattcagaaatctttgcaatgaaatggcaaatactttgcagatggaataactaaagcaaattcacatctaactcaaagtgaaaacaaaatgcagcattctttaagttcctaaaaaaatttacttcttaactctatggaaatccatgagtcaataaatagaaattaacaattggaaaaaatcattcatagcagccagacacggtgttagcacctgtagtcccagctactgaggaggcttaggcaggaggaccatttgagcccaggagttcaaggctagcctgggcaacatggtgagaccccatttcaaaacatgaaaggcattcatcataaactctgtctgaaatgagttcaactacagatcaactcaagcatagctacaggccaaaggtaagcttatttaaatacttcaagttagaaacaacataaataatgaggaaatctgatgagacagatgttccaagattaaactggaacttaaaaataagcctactcggctgggcgtggctcatgcctgtaatcccagtactttgggaggccgaggcaggcagatcacgaggtcaggagatcaagaccatcctggctaacacggtgaaacgctgtctctacttaaaaatacaaaaaaatagccagcctggtggtgggcgcctgtagtcccagctatttgggaggctgaggcaggagaatggcgtgaacctgggaggcagagcttccagtgagccgagatcacgccactgcactccagccagggggacagagcgagactccatctcaaaaataaaaaataaaaataaaaaataaataaataagcctactctgcactaggctacaatgaactggcctgaggtctacataaaaaaatctttttaattgaaaaaaattaagcctggaacccaattatcttcctcacattctccagacttaaaatgtcctgggactaataactacaccataaatagatttaaaatttataaatcaggaagtatggcatcccatttacaaaattcatttatgtatccaataactatgataaaaacataagactgatttttttaaagttattaaatcttacaatgaacaaaacactcaacatataataaacatttcatatgtactccaaaattaaaactaaattaagttgaaaatttggaaataaaaattcagattcaactattttaataatttgagttcatatctgaaaataagcagcagcagcagcagcaagggaaatcacatattaccatccagttcactttgaatcttattcctttctctttctagctcactcttagctcttgctgtctccagtttgatgtctgttatttccagtttgtttgaatgtttaagttcttttacctgttgataattaaaaactgaaattactattggtcattttcttgccattcaatacttaccccaaaacataagtggaaacaagaaaacgctctggtagtaaagtagagtctaagtatcttccaagaagaaagaagtgtcagtgcctgcaacagtacttcaagtaaggagacattaagaaaatactgttctttcctaacagaacagaggcatttctttacgaatatctgtgtatggtcctttggcttaatcttgccttaaagacttaattacaagtatctaaaatcaactactcaatgattggaaaatctgcaggggaaaaaaccctgaaacttttaaaatttgttaatatttctaaaagacagggtcttgctatgtcatccaggctggagtgcagtggcacgatcatagctcatttcaacttcaaactcctgggctcaagtgatcctctctcctcagcattccaagtagctgtcaggactataggtgcacaccaccacactcagataatttttcaatttttttgtagcaatagggtcttgctatgttgaccaggctggtctcaaactcctggcctcaagcaatccacctgctttggcctcctaaagtgctaggattatagttgtaatccactgcacttggcctgaaaccttccttttaaaaagtgtccacagctggatacagtaacttgcacctaaaatcccagctactcaagaggctgtggcagaaggaagtgtttgaggcctggtgttggagaccagcctgggcaacatagtgagatcctttctctaaaaaaaaatttaaaaattagccagacatgacatgccccttagtcccagccactggggagactgaggtaagaggatcacttgagtctaggggtttgaggctgcagtgctatgattgtgccaatgtattccagcctgggcaacagagtgagaccttgtctctaaaaaaaaattaaaattaaatttaagaataaaaaatgtgctggggacaaagaaggtattctaggtagaaggaacagcatacaaaatgttattatatgtataacatcacatggtctgctcttaaaacaagctaagcattacatgtagagcaccggaagatgtgaaatctgtggaggaatggcagggaataaactttatataccatacaaaagggttgtttttcaggttagctgttgaaggtggcacaattaactaatgcgaatctgttggcttaagaaactgaaggtaaataaatcaattaagaggcaagaaatgaataaacggaggggggaaggaagaatcaattgaatctggtgacaaaatagtgtaatgtgtatagactgtgtctgtgtgcgcatgtgcacaagtattaggtaggggattgggggcaggaacaagtataaatcatataaattcattttccatagcccttctctttggtaaggagcttctaaaattagatatagtcatataataaggatttaatcaatacaaacacaaaggttagattaacccattttctgatatattatccaaatatataaaagtatggaatcagagtaggaaactacaaatacatacacatcaaatacagaaaatgtgagatggcagaaacaggaaaataaaagacaatttacttaagagtccaataaaaccccataaatactggagttgggagtcagacacaaatcaaaaaaaggtcctagagccaaagagggcaaggataagaaatagaagtgtcttattggaagatattccatcaacaaaaggtcctgaaaacgtttcaaggaatagtttcatgcaaaatcctcatccaaaggaaataaacagaaaagtgagtactgccttatgtactggtaactacaataagacatccctccaaattaactcgtagatttttaaatgaccgtacataaaatggtgaccctgtgctgacatcagttttgcatttttatttatttattttctgagacagagtctcgctctgtcgcccaggctggagtacagtggcttaatctcagcttactgcaacctctgtctcctgggttcaagcaaattctctgcctcagcctcctgagtagctaggattacaggcatgcaccaccacacctggctaaattttgtatttttagtagagatggggtttcaccatcttggccaggctggtcttgaactcctgacctcgtgatccatccgcctcggccttccaaagtgctgggattacaggcgttaagccaccacacctggcctgtggttttaatttccttttggaagttattttctataaaagcaagttttataaaatgatgtttacatgacaacagctgataatttgttttaatacttaaactttctgtagattggattttactacattataatttcatggacagatagaatttaaattataaatactttaaaattttgaagaaatatgattacaaagaaaatccaatcactatgacaaatgtaattataacctgctattatatactaactgtaaaaggttaagaatgacacagcatttcattaacaaacatactatagctgcatgaggtggaaaattagagccatcttatttcataggaagttgattcatctcatggtaaaagatctacaaaaacttatttcttattcatttcaccctgaaatttactgaaatgagacgacatttttaactaaactacaattattgaaactgaaagaacaccgaataggaagtcaagcaacaagtgaggtctgtcttcaggcctacttttgctgttaaaccagtggtatatgctcaagcaatttacctgtcctctctgcattcaaatgtactcatttatggatctaaagtttttctttattgccttatttctattatcctaacatcactgatgcatcacttatatgaacactgttaatttcctaaaaatatactaaaaggaattttacttaacgtatgaaaatgtattacccagtaatgacaaataatagcacttttctatgagtaatctgaaccaaattccaaatgttacagtaaagtttctttctgcccctagatccttggttcttaatcttctttgtgatcaagtcccaaatcctaggaaaattagggattttttttttaaataaaatgctcatgttaaaatgttgcataaaatttcaagcaattcatggtctcctaaagctccactggaccaagtcaccctgttcttcacagaatgtttgccatatagattctggcctttatgttgtgaatttgctttatgttttgacacaatggaagtattcagatattactaacaaaactttaataaatgtcaaaactggcaaaactgggcattttacagggggtcagtatctgttaaagtacacatactcacagaaagacacacaagagcacagcataaataagcaagaaatggaaatataattgacaatatgtattacctaagaagctctggatacagattccaaagagatggtacttaaatcttgatctttttcaaagttctgagatgtaattacccaattaatttaggtaaataaggacaactctgttgggtggctttcttaaaactaccttttattggcattctgaaaatgaaaaaccttatgagggaactagaagaatttacctcactgaatgtgaaatctctttaaggtcatcattttcaggccatctttggtaataccttttaatccaagacactgatactcacactgacataactttgttctaaaatctgacaaacatttatgaatttgagtaactaagacaaacacaccccaggtgttcctttgcactgcaaacaaccatttgctagaattgcaaaatgttgatgaaaacttcaagttgcaaagaaaactgtggcagtcatgtttgaaatattattttaaaatctacccttccaatggaatctttacatacaagacttcaaatgaaacttggtttgtttaaagttgaaggatggtatttaatactccatttatatgcaaaataaggcaagtgtgcctttaaaaagacaggcaactcttagcaatgtgtattaataaacaagcacagagaaataaatactatactagattgctgttctttcttcagcggagtaggagaaatcacctaggctctaactctaagaggaaagagcaatagggaagagtatatatatatggaaaaaaagaagaaaaatcagggtcagcacacaggtgagctagggagctcaggtaaaatgtactgcatgaaaagtattatacttggtggcccccccaagagagaagccacagcagaagccagcacatcccatgtcctattgcgacatctgtggttccaattattccagcagtgtagtctggctactcaggtcaagaacaatgtgctgcaaatactacgtactcaatattatttcacaaaattgaaaataatttatactggaattggaagaaaagcatggaaactccccatatcctgaatttacttgtgttttgtatctatttttttgtatactctatagttataagctttcaatgtgtatctgttgaatatataatctacttacagttaatcaggaggcaatcaaattatttcctagtagttcttacacagtcttagtaggctggaagggttcttacagatataaggaaattggatcctaatgatattaggtaacttgccttaggttacacatagttattgagacagtgagacacagactagtcaatggactaaaaattctgtattctttatgttacaatattttcttatttaaggatatcaccagtgtataatcactgctattatcattttcatcatcagctacatttaatttttgccacaactctgtaatgtaggtattagtcccattgcatagacaaaggcacttaagtttcagagagacagtgaactgcccaaggtcacacagctttttttagtaatgaaaaaatcagaatttgaatccagtctgttaaggagaatataaatgtagatcatgctgctactactaatttattcattgaagaaatatttgagtacctactatgtgccggcaccattctagaagctggaaaagcagtagtgatgaaaacaatgtccctgctctcttggagcttacattgggttgaggggaaggtggtgggaaagaaaaggagagaccaaaaaataaaaaccaaataactatatcagatagtattaagagctatgaagcaggtaaggaagacagagagaaagacagaggaagaaggaagatgctgttttacaatgtgaagacaaggaaagcctccctggttaggcaacatctaggtggtgaagaagcaagttatgtggatacgtgagggaagactgagccaaactcagacaagtgcagaaaccctgagcaagatgtgagtttgctcaaagagtgagaaggccaaagggagcaaagtgaacaggaggaaaaatacaggtcatggctgtgaaaagactgcaggatccagatcatacagagctctgaatgggtagaaagcagaaagaccagttagcaacctagcacagaaatggagcctagaaaaatcatggcttggactggaatagtcacagtggatgtcataagaattgatcagattctgcatgtatttggaaggtagaatgataaaggattaaaaatatttcaatacagagaactaaacacaaaatttgtcactgtacagtatcaagcattctaaagaatgaaatagaggcataagataacatactctactgatcaatgtatttatttcttagaaggcagaatgatataataaaacatttcagtataaagaaatcaattattaaaaataaaatttatcattatatactaacaaacattctaaagaatgaaacagaaacataaaacaacttactttactggacaatgtatttatttctcgttcagctttatgcaatttattaattaaaaaggtattttgttcactgcttgattgtagctctttttccaaacgttctgcccgtaaattagctgattgtttttcagcctttcatacaaacaaaatagtttaaaattcatcatttttcaagtatttcaaaatcaaataagcactatttaaaatacatttataattatactaaaattattcaaaacctcaacttaacatataccaatgtaacaaaaattttctcaaactaattggcagaattcaaacgaaagatagtgttccaggaaatatgcaacaaaggcatctagacaaacaacatatgaatgaccatcaataaaataaagtttatacacttctctcacgacagaaagtacctaaggcattcatttgatgtctatttactcttaacactgacttatttcaaacattttggaagtttccagtctataacagataagaaaaagcatattagaaactagaagacagggctcattgatagtaacaagtaaaaattgaaaatctaaaatcaatgattttaaaaaaagaaacagggaaagatatgatttcaaaatcctcagctcatctgcagactttttaagtacgagcaaagaggctcttgatctcatgacacaattaagattgttaatgaagtctgcaggttgtcaaaaaagtttctggatggtaatatcgatagtactctttcatgaggggagggaaactaaaatcttttttgaaaaaacatgtctattcaacataatatatatacatatatacacacacacacacacacacacacacacacacacacacacacatatatatatatatattttttttttgagacaaggtcttgctctgtctcccaggctgcagtgcaatggcacgatcttggctcaccacaacctccgcctcccaagctcaaacaattctcctgcctcagcctcccgagtagctaggacttcaggtgcacaccatggcacctggctaatttttgtactttttgtagagacagggtttcacccgtgttgttcaggctcatctcaaactcctgagctcaggtgatccagctacctcagcctcccaaactgctgggattacaggcataagcgaccacacctgacctcaacataattaaaatgaagacattttggcatttaaaggataaatttcagttttataacatctcatttcgtacatatagatgctgttcgacttatgatggggttacatcctgataaacccatcacaaattgaaaatacctaagtccataacttagactagcctaacttaagcatcctcaacacacgtgcattagcctacagttggaaaaaatcatttggcgacacagtactctgtaaagaggttatttaccctcatgaccacatgactgactgggaactgtggctcagtgcagctacccagcattaagagtatcacaccacatatcagtaacccaggaaaagatcaaaattcaaagtacataaatgcatatatggctttcacaccatcggacagtcaaaaaatagtaagtcaaaccaccttaagttggggaacatctagcttaaatgtggtaaggactatattcgacaaacaattagggaaaaaaactattttcttcatatatgaaataatactctctgggcacaatgatagccaagaaagttaaagaagaaagaaatgcttgctgtcatacgcttattttcatttcatctgacaaataataaaattaaatataggctcttctgaaaatgtcacaaataaatcttctgtcatcattcaacttgccctgaaaataatcactctaaaggacctcaatggaaagtttcacatcaggactgtatgctatattcaactgcaatcatctcacttattctgtcactgtgtaaaatacattaaggatggaaggatggcaacataaatagtctcacaatgaactgcttcatgtttaaggtacaatgatactgacaacttttaattcagaaaaccagtaaatactgacagagcgtcatgtaacaaaataaaaagtaacttctactcttcaaaacataccattgtactcctgtaccactggctggggaaaaaaaaaatcaccatcttggatttggatattgattttaactacaaattaaatgcccgctaatgtcccccccacccaaatcattttataactattccaaaggaaaaagaaacactttgaactatacaaaataaataaaaacaattaaacaggtatgtttgctacaagttaggcactaagaactaagaagaataagtgtatctgaataaaatggaaaccaagaattttcataaggcaatacccgtaggagtaccagtcaggtctgccaacacttatctttctctaatgaacccagggaaataattctgtaaaggcatgtatacctttacagttggattttactactctggcaagaagctgtcgtaagatacatcagtatggtatttctgttcaaacaggatttgtgactttaagacctcaaatcccagtgtaaggaatgtactatcttgaaagaaattattctttctggtttgagatgactttacgctcagaaactcaaatacatatatttttattttgcatattctattatgtggcattttaagagttaagacatttcagataggtgacttgactcccaaagaataaatacccctttgtaaatgtggtagcatacgtattgcttatgaatcaatagctttcttctttactaaaagaataaatactcttgggattacacaaatgcatcagcattagcttggggggcatacatttatgctctaaaaatcaaaggcttgtcaactgcactttaaaaaagtatgccatactctactgggaagtaattagaatcttacctccagggatctgactgtagcctgcatctcagccaactgccgcacctgtattctttgggcattttccacctgagcctcagaattctccttttcagcctttaattccgctacttcagcctctaaaccttttaatttttgacacaaatagactttttctcgagcaagttgttccactcgtttgctgtcttttgtgagatcaacattaagcagctggttacgtagttcttctttatcttcctccagtcttgcaatctaataataattttaaagaaagcatacaaggttaaattattaaattttcagtcatgaacatgctttacaagtcagtaaaattaaaaaatgcacaaaatcaaagctcaggtgctgaaacaaagtacaaaggaaaaaattttaagtatcactatctttttgttcttagtgggactcaaatgtgaggtcaaggactgtgtcctgttttccctgtatctccacgtggtgtctagaacagggcttaatcagttgctgactaaaatttaaaattataatactgtaagtactaaacatacatcaagtattttaaaattcatcataacattataggggttcatgaccaaaactctgactactccaaagcttttcctcacatgactgtaattcttgagctagtctatactaataaaattatctatgtcagggcaacttaattcacacaaaaactgcctgtctgtgtacataaaagcaaatgtgattgatgagagtttttaaatgatagctgagagtttattaaagtcctaattgtaatgatggcctagttcttagttcttagattcaagaagaattgaaaaatcattactccagggcaggtgttaaagtcactggggaacttgcagagcagagacaccagtggtcttgtcattcatgccaattatcactgctggacttcgtgggcctccaaatcagtgggtttcaaactgtttcctaacctctgaggcatttcagaagctcctcacctctggagaccaggggcaagcaatcagggtctagaactcattctttccctttcctgatctccccaactatctatcccctaccaccacccccaccaaatttctggcattaaccatacgcttctatttttagtctctttctggggtttcttcaaatgattcaacttaagtaaatgattcagctgggttttttgtttgttaagaagaagttgaaaaccactgctcaaaacaggacaagaggttgtttgtagccaggatgaacatcaaagactcactgtaagctccccggccctgcaaaaaaaaaaaaaaaaaaacaaaaaacaaaaacagaaaaaactaaagaaatgctccaaaaccttaggcaaaagtggtccaagaaacaactgtttgatcacagcactatcaatgaatctaaaaagtttaagacctccaccccagggcaggatctgttctccacacctgtaaaatgggaaactgaattacatgcactctaacaacctttttagttttaacacatagtgattccagtttgtttttggacatgctgaatttaaatgccaatgagaaatataggtagagctatccagcagacaaatattattttgcagagaataaaatttatccttgaaggcagctgtggcatttagagttaagtcctcaaaagcccaactaattagtatttctctcctatttttcctcccacgctttacaaataactattacttcctggtttggtcccggattacttttttatccactgtattctgtcctcagtttaaatgaagaacttgggctagctgatctttaagatactgtttaccttttacatgaggtaacctgatatggttttaatgtgctatattagaggtgtgatggctcatctaaggtcaggagtcaatgtgtaactcaagttcagacaatggtgccctttactgagtacttactatggatcaaatactgagctaagtgctctacatgtaaaatcaacattaacaataatttctcttgtagtccccattttacacatagggtcacacagttcacaatgttcttgacctgcatacttcccatattattgctttctttccacgttttgggaggcatctgtgtgatagctgaagtgatagttgaagctatgagactggatgacagctagctgatgactgaaaattagattccatgtttataactcctaaaccagacatatcaaatcattcttacaaaactgccatctaattttgctattcatttatttattcaggcaacaaatatttactgagtacttactaagtacccaaaactgttttaggtagtaaggatacaacccagcagataagcaaacacaaaacctctgctgatgcagagcttattacattcaatcactgccataacaccacttgtgtcccagacatttggcacagatcttggatacagcctcagctctttctttttccgccattctcaatcagacttacatgtcatcttccttgatgtcctcaatttcttgtgctctcaatctttcctctaaatttccaaagggctttgtttaaatttctcttttatgaactttatttaaatctgcctgtattgcagctacctctacatttactctattctattctaaatacaaacttacttgacagataagacaatgtgttaactaatattactttttaaaaagttattgaagtaaaggaaactaaacagaaacaatagggactaggaatagtgactgatttccttttcaaaaaatgatagcacttcaattccccaaggcacacaagagggaaaggtagtgttacctaattactccatccttctttgttgttattacctttacgatataacatagggatatgggtaagagaaaaggctctggaatcaaactgcctaggtttcttttttcttttggtattttaaagatattgctttactgtcttctggcttttattacttgtaaaaataagtctgtcgtcattatctgttcctctgtataagatgtcttttctttcttcagttacttcttttaaaattaaactttttcagataatggcaggttcacaaggaattattataaggattaatatagcgggatcctgtatatcctttaaccaagattcccctattggtaacattcctcttccctttttggggaagacattatgtagaattggtactgatacttctttaaacacctggtaaaattctctagttaactattcattttgggagttttaaaattacagattgaatttccctaacagtaataggtctatacaaactgccaatttcacattaaatgagttgtggtcgtttgtgccttttaagaaattgattcatttcatctgcattgtcaaatttattagagtagagttgttcaaaggattatctgatttcccttctaatgtctgcaaggtcatgagtgatactctttcattcctgagataggtaaaatttttatcttccatcttttttgttagttttgctaaaagttggtcaattttattgtcttttcaaagaaccagctctttgtttcactgattttctctattatttttgttttcaatttctgctatgtttattatttccctccttctgcttgctttacttttattttgatactctttttctaggttcttgaggtgggagcttacattactgacttgttccctcatttctaatgcatgtatttagtgctataaatgtttcttggcactgctttagctgtgtcctaaaatttttgatatgctgcattttcattttcatccaatgtattttttgaaatgtaatctcattgaaatgtttttctttgaaatttccaccttgacccataaatttttttaagtatgtcatttcatttccaagtgtttgaagatttccctgttattttctgttattaatttctagtttgattctattgtggtcagaaaactcactcattatgatttcaagttgtataagtttgttgaggtttatttcatagcccaggatatggtctatcttgtatatgttcagtgagcatttatatacattcagcgaatacttcaaaagaacatgtctgggtgttctccttgggtggcatgttttataaatgttatttaggttctgatggttgatggtgttattgcgttcttatttatccttgctgatttttaattgttctatcacttgttgagagaggggtatgaagtcaccaactataattatagatttgtctatttcaccttttagttctttcaatttttgcttcaaacattttgcacctctggtgcacatacatttagtattcctgtgtcttcttgctgggttgacctcttttgtcactatataatctctttctatataaatctggtatttttctttgttattttcctttgccctgaagtctgctctatctgatattaatactgatgctcctgcttttaattaatgattccatgatatagctttgtatatccttttatttacaaactgcctatactgttatacttggagtttcttatagacatcatacagttaccccttgacttatgatgcaattacatcccaataaactcatgaaaagtgaaaaatgcagtttatgccggcaacacagcatatggaccctgacttatgatggttcaagttacaacttttcaactttacaatggtataaaatgacatgcattcagtagaaaccatatgtcataaggagcaccctgacttacaatggagttacatcccaataaacccattgttaagttgaaaaatcatccaagttcaaacactgtaatctggggactgtcagtacagttaggtcatttttaaaaatctacactgtaaatatctgtattttaattcatgtattcagaccatttacatttattatgattgatacgttaagccattttggtctgtttcttctcttagtttctctgttttctttttcttgcctgttacatgaacatatttcaggattccattttatctataatgttttaaatgtatctccttgtatagctttcttagtggttgttctagttattatatttatgtaacttatcatggtctactgaattcattttgtcagtttgagtgatatgtagaaacttcacctccttttatatccctttgtccttgctcatttataatataattacctaaaatattttctctatatatttagaaccacatcagagttaaaatttttacttcaaccaccaaacaaaatttagaaaattcatgaagcaaaaggaagtctattacatatacccacagttctgtttaccatgtacatttatccttcctaatactttgagattccttctttttactgttttcttcctatttagacaaacttctcttttggataggtctactggcaaaaagttccttcattttccttcatttgagaatgtcttgatttcccctacattcctgaaggatatttttgctggatatagaattatgagttgacagtccttatctttcagcacttgataatgtgccacttccttctggcctctgatttctgatgagaaatgagctagttttctaattgttttccccaatgggtaagatataatttcttgggctgctttcaagattttcctatagtttttttttaaacctgactatggtatctcttgctgtgaatgtgttcagcttcttgaagctacatgtttgtgcctttaccaaacttggaaagtttttagtcattatttcttccattaccttctcaccctgccctcttttctcctttcagggacagaaatcttagatcttttgttatagtcctacaggatactgagaatctgtttatttgctttttaaatctattttctctagtctgttcagattgggtaatttctaatgttctacctttaagctcagtagttttttcctctatcccttccattctgcagttgagcctggcaactcaggctttcttagtcactctttcagttctaaaatttccaattttcttctctttattctctgtttctttgctaagtcttttgggttttgtttgtttgtttgtttcaaccacgtttataattcctcattgaatcattcttaccatggctgctttgaaatgtttgtcaaataattctaacacctctgcatctcagtgttggcatctattagtgtgttttacattcagtttcagaccttcctagttcgtggtgtgacaagcaattttcaatggaaacttggacatttggggaattaagttatgagactccagatcttaaacaaagtttgtattagctggctttttgtgatattgctatggtaggggatgggtggtgttgccacctcattactaccacgaggaggtagtagtcccgattctccactctacttctgttgatacccaaggtgggagggcttctcatgatacccataatgaacaggggtgggagttctggttccccattaggcctcaactgacacctccctggatgggaagcgtaggagtaatttattattgctcctcatgttacctccatcgataccacagggccagatgtggcctccattgataacacgcagctgggtagtggttaaagtcctgaccctgtactaggcctcctctgacatgacccaggatgtcatgtcagagcaggatgagggcagggtacctcattactgccagttgagagtggatgtccaagctcctcatactgtctctagtgacagcatggcagaggatgggagcccttgttattacccaggtgaagatgtctttgtctggttttggtattaggataatgctggccttgtagaatgagttaggaggcatttcctctgattctgtcttctggaagagattatagagaattaacataaattctcccttaaatggctgatagagttcaccaatgaacccacctgggctgcccagtcatttctgattggatgtcagacattgtgaatttaatgtttttttcagagctggattctttgttttcctttacttatttctgaatcttcattctggaatgcagctaagatatagtaatgagccacataatgaagtttcagtcaacaacagtccacatacatatgacaggggtcccatgagtataatattgtatttttactgtttaaaccttttctatgtttagatatgtttaggtacacaaatattaaccattatgttacaatgcctacagtattcagtacagtgatatgctttacaggtttgtagcctaggagtaataggctgtaccatataggataggtatgtagtatactgtgccatctaggtgcatatatgtatagtccatgatgtttgcacatgacaaaatcgcctaatgacacatttctcagaacatatccctgtcattaagctacacgttactgtacttagaaacagtctgatcttttcaaatcttacttttattcttgttaaccagaaccagaatagcctttagtctatggctaatttggccctgctactgaggcaaaatccttctgagatttctactcaaagtactatgcattaagagtatctttccactctgtctaacggaaaaataaattttcccagtcccatgtgaactctagagactgtcccacctaaataattttctttctctggccttgtatagtttcctccacacatgcgctaatcaatactgcaaagttaccctctgcagaactctggagctctgcaatactctgcttttcaaattctagtttccttggcctctcaaattctgaactccaactcctcagctcaaagatcatgtagctcaatttaggttttttatctctgcacagtggcctggaaactctccagaacctaagatggggcaatcatagagctcttatcatttgttttccttccctcagatctgccctgtgctgcctattttccaatgtctgaaaactgtggtttcctatttttgtcccagttttcagtaaacgccttaaagtaaattccatccctattccatcctagccagaagcagaaatccccagactacttagatttgaatcctgaccatatactagttgtgcaaccttgggccagtctctcagtgtttttatcttctcatttataaaatgaagatgattatctaactcctagcattgttgagatgattttttaaaagtatatataaagatactggtacaaaaacagacacacagccaaatggaacagaatacagtaaccagaaataaagctgcatatctacaacaatctgatgctcaacaaagttgacaaaaacaaacaatggggaaaggactccctatttaataactggtgttgggaaaactggctagccatatgcaaaggaatgaaactggatctctacttttaaccacacccaaaagataactcaagataaattaggaaataccattctggacattagccttggcaaaaaatttatgactaaatttatgaccctctaaagcaagggtccccaaaccctaggccatggaccattaccagtccatggcctgtcaggaatggggccacacagcaggaagtgagcagcaggtgagcgaccattactgcctgagctctacctcctgtcagatcagtgggagcattagattctcatagtggtgtgaaccctattgcgaactgcacatctgagggatctaggttgcatgctccttatgagaatttaatgccctaatgcctgatgatctaaggtggaacaatttcatcctgaaaccattcctcccagagccttggttcatggagtaattgtcttccacgaaaccagtccccagtgtcaaatggcaccagggactttggggaccactgctctaaagcaattacaacaaagacaaaaagtgataactgggacctaattaaactaatgagctttggtttggcaaaagaaactatcaacagagtaaacagacaacccacagaatgggagaaaatacctgcaaactatgcatctgacaaagttctaatatctagaatctataaggaatttacataactcaacaaggaaaaaacaaccccataataaagtaggcaaagtacataaacagacacttctcaaaagaagacatataagcagccaacaaacatgaaaaaaatgcttaacatcactaatcatcagagaaatgcaaattaaaaaacacaatgagataccatctcacaccagtcagaatagctattactaaaaggaaaaaaaaaataacagatgctagcaaggctgcagaaaaaagggaacattatacactattgatggctacgtaaattagttcagccactgtggaaaacagtttggagatttctcaaataactaaaaatagaactaccattccagcaatcccattactgggtatatactgaaaggagagtaaatcattctattaaattgacacacacactcatatgttcatcacagcactattcacaatagcaaaaacatggaatcaacctgggttcccatcaatggtgaactggataaagaaaatatggtacatatacaccacggaatactatacagccataaaaatgaatgaaatcttgtcctttgcagcaacacagatacagctggagactatcatccaaagcaaattaacaaaggaacagaaaaccaaataccaataccacatgttctcacttgtaagtgggagctaaacactgactacatatggacataaagatgggaacaatagaactggggactaccagagaggggagaggatgagggggaaagggctcaaaaacttcctattaggcactatgctcagtatctaggtgacggaatctttattaccccaaagttctgcctcagcatcatgcaatacacctgtgtaacaaatctacacatgtaacccctgaatctaaaataaaacttgaaattattttttaaaaaaagaaaagttaagtagaataaagtattacaagtagtgaaaagagaaaataatttggaaacttttttttacactgactttaatttgtgcttttgatgaaaatacatttcactttttacattttgaatacaattgcattttaattctgtgtgttattattaatggaaaacaaacatgtaaaaagcttctttacaagagtatagtgattttgctaaattgaaaaaaaatgtggctgggtgcagtggctcatgcctgtaatcccagtactttgggagtctgaggtaggtagatcacttgaggtcaggagttcaagatcagcctagcccacatgacgaaaccccacctctactaaaaatagaaaaattagctgggtgtggtgatgcacacctatactcccagctattcaggaggctgaggcaggagaattgcttaaaccaaggaggcagaggttgcagtgagccaagatcgcgccactgcactccagcctggggaacagagtaagactttgtcttaaaaaagaaagaaagaaaatgccatgaaataaatatgtaataatctttaaactatatataaagtgtttcactgaataaattaaaggtaaatgggtctcctgtctctatttctttctttcacttcttcaacttctgtaaattctgatttacaaatctgaaatcaacttaaaagtatctgtatatttattatgttaattggtaccatgataataactgtgaggtatgaatgatactaataccattaattaagtatctactatgtgtcaggcattatggtaagtattttgcacattaagtttcaagttcccagatcttagtttttaaattattacattaactttttatattacttaagaaaacaataggagacggttggtccaagatggccaactaggaacagctccggtctgcagctcccagtgtgatggacgcagaagatgggtgatttctgcatttccaactgaggtacctggttcatctcactgggactggtggacagtgagtgcagcccacagagggtgagctgaagcagggcggggcatcacctcacccgggaagtgcaaggggtcggggtatttccctttcctggccaagggaagctgtaacagactacctggaaaaacaggacactcctgcccaaatactgcattttcccaaggtcttagcaaccagcaaacaaggagattctctcccatgcctggctcggtgggtcccacgcccacggagccttgctcactgctagcacagcagtctgagatcgaactgcgaggcggcaccctggcagggggaggggtgtcccccattgctgaggcttgagtaggtaaacaaaacggccaggaagctcgaactgggcggagcccactgcagctcaacaggacctactgcctctagacaccacctctgtgggtggggcatagctgaacaaaaggcagcagacaacttccgcaaacttaaacatccctgtctgacagctctgaagagagcagtggttctcccagcatagcatttgagctctgagaatggacagactgcctcctcaagtgggtccctggcacccgtgtagcataactgggagacacctctcagtaggggccaacagacacctcacataggcaagctgaccctctgggacgaagcctccagaggaaggattaggcaacaacatttgctgttctgtgacgtctgctggtgatacccaggcaaacagggtctggagtggaactcccgcaagctccaacagacctgcagctgagggaactgactgttaggaggaaaactaacaaacagaaagaaatagcagcaggatcaacaaaaaggtcacctacaccaaaaccccatctttaggtcaacaacatcaaagaccaaaggtagataaaaccaaaaagatggggagaaaccagagcagaaaagctgaaaactctaaaaatcaaagcgcctcttctcctccaaaggatggcagctcctcgccagcaatggaataaagctggacagtgaatgactctgacaagttgacagaagtaggcttcagaaggtcagtaataacaaacttctccaagctaagggatgatgttcgaacccatcgcaaggaagctaagaaccttgaaaaaagattagatgaatggctaactagaataaacagtgtagagaagaccttcaatgacctgatggagtgcaaaccatggcacgagaacttcgtgatgcatgcagaagcttcaatagctgattcaatcaagtggaagaaagggcatcagtgattgaagatcaaatgaatgaaataaaccgagaagacaaagttagagaaaaaagagcaaaaagaaacgaacaaagcctctaagaaatatgggactatgtgaaaagaccaaatctacgtctgactggtgtatctgaaagtgacagggagaatggaaccaagcaggaaaacattcttcaggatattatccagaagaacttccccaacttagcaaggcaggccaacattcaaattcaggaaatacagagaatgccacaaagacactcctcgagaagagcaactccaagacacataattttcagatgcaccaaggttgaaatgaaggaaaaagtgttaagggcaggcagagagaaaggttgagttacccacaaagggaagcccatcaaactaacagcggatctctcggcagaaaccctacaagccagaagagagagggggccaatattcaacattcttatagaaaagaattttccatccagaatttcatatccagccaaactaagcttcgtaagtgaaggagaaataaaatcctttacagacaagcaaatgctcagagatttttgtcaccaccaagcctcccttacaagagctcctgaaggaagcactaaacatggaaagaaacaaccggtatcagccactgcaaaaacaggccaaattgtaaagaccatcgatgctatgaagacactgcatcaattaacaggcaaaataaccagcgaacatcgtaatgacaggatcaaattcacacacaacaatattaaccttaaatgtaaatgagctaaatgcaccaattaaaagacacagactggcaaattggataaagagtcaagacccatcagtgtgctgtattcaggagacccatctcacgtgcaaagacgcacataggctcaaaataaacagaaggaggaagatctaccaagcaaaggtagatcaagcaaaaaaaaaaagcaggggttgaaatcctagtctctgataaaacaaactttaaaacaaagatcaaaggagacaaagaaggccatggtaaatggatcaatggcaaagggatcaattcaacaagaagacctaactaacctaaatacatatgcacccaatataggagcacccagattcataaagtaagtccttagagacctacaaagagacttagactcccacacaataatgatgggagactttaacactccactgtcaatattagacagatcaacgagacagaaggttaacaaagatatacaggacttgaactcagctctgcaacaagcagacctaatagacatctacagaactgtccaccccacatcaacagaacatacattcttctcagcaccacattgcacttattctaaaattgaccatataattgaactaaagcactcctcagcaaatgcaaaagaacagaaatcacaacaaattgtctctcagaccacagtgcaataaaattagacctcatgattaacaaactcactcaaaaccacgcaactacatggaaactgaacaacttgctcctgaatgactactgggtaaataacgaaatgaaggcagaaataaagatgttctttgaaaccaatgagaagaaagacacaatgtaccagaatctctgggacacatttacagcagtgtgtaaagggaaatttatagcactaaatgcccacaagacaaagcaggaaagatctaaaattgacaccctaacatcacaattaaaagaactagagaagcaagagcaaacacattcaaaagctagcagaaggcaagaaataactaagatcagagcagaattgaaagagatagagacacaaagaacccttcaaaaaaatcaatgaatccaggagctggttttttgaaaagatcaacaaaattgataaactgctagcaagactaataaagaatcaaatagatacaataaaaaatgataaaggggatatcgccaccgatcccacagaaatacaaactaccatcagagaatactatagacagctctatgcaaataaactgcaaaatctaggagaaatggataaattcctggacaaatacaccctcccaagactaaaccaggaagaagttgaatctctgaatagaccaataacaggttctgaaattgaggcaataattaatagcctaccaaccaaaaaaagtccaggaccagatggattcacagctgaattctaccagaggtacaaagaggaactggtaccattccttctgaaactattccaatcaatagaaaaagagggaatcctccctaactcattttatgaggccagcatcatcctgataccaaagcctggaagagacacaacaaaaaagagaattttagaccaatatccctgatgaacattgatgcgaaaatcctcaataaaatactggcaaaccaaatccagcagcacatcaaaaagcttatccaccatgatcaagcgggcttcatccctgggatgcaaggctggttcaacatatgcaaatcaataaacataatccagcatataaacagaaccaaagacaaaaaccacatgattatctcaatagatgcagaaaagacctttgacaaaattcaacagaacttcatgctaaaagctctcaataaactaggtattgatggaacgtatctcaaaataataaaagctatttatgacaaacccacagccaatatcatactgaatgggcaaaaactggaagcatttcctttaaaaaccagcacaagacaaggatgccctttctcaccactcatattcaacagtgttggacgttctggccagggcaaccagacaagagaaagaaataaagggtattcaattaggaaatgaggaagtcaaattgtccctgtttgcagatgatatgattgtatatttagaaaactccatcatctcagccccaaatctccttaagctgataagcaacttcagcaaagtctcaggatacaaaatcaatgggcaaaaatcacaagcattcctatacaccattaacggacaaacagagagccaaatcatgagtgaactcccattcacaattgctacaaagagaataaaatacttaggaatccaacttacaagggatgtgaaggacctcttcaaggagaactacaaaccactgctcaacgaaataaaagaggacacaaacaaatggaaaaacattccatgcttatggataggaagaatcaatatcgtgaaaatggccatactgcccaaggtaatttagattcaatgccatccccatcaagctaccaatgactttcttcacagaattggaaaaaactactttaaagttcatatggaaccaaaaaagagcctgcattgccaagacaatcctaagccaaaagaacaaagctggaggcatcacgctacctgacttctaactatactacaaggctacagcaactaaaacagcttttggtactggtaccaaaacagagatatagaccaatggaacagaacagaggcctcagaaataataccacacatctacaaccatctgatatttgatacacctgataaaaacaagcaatggagaaaggattccctatttaataaatggtgctgggaaaactggctagccatatgtagaaagctgaaactggatcccttccttacaccttgtaaaaaaattaattcaagatggattaaagacttaaatgttagacctaaaaccataaaaaccctagaagaaaacctaggcaataccattcaggacataggcatgggcaaggacttcatgactaaaacaccaaaagcaatggcaacaaaagccaaaattgacaaatgggatctaatttaactaaagagcttctgcatggcaaaagaaattaccatcagagtgaacacgcaacctacagaatggaagaaaatttttacaatctactcatctgacaaagggctaatatccagaatctacaaagaactcaaagttacaagaaaaaaacaaacaactccatcaaaaagtgggcaaaggatatgaacagacacttctcaaaagaagacatctatgcagacaacagccacatgtaaaaatgctcatcatcactggtcatcagagaaatgcaaatcaaaaccacaatgagataccatctcacgccagttagaatagcaatcattaaaaagtcaggaaacaacagatgctggagaggatgtagagaaataggaatgctttacactgttggtgggagtgtaaattagttcaaccactgtggaagacagtgtggcaatccctcaaggatctagaactagaaataccatttgatccagcaatcccattattgggtacatacccaaaggattataaattatgctactataaagacacatcacacactggggcctgtcagggggtgggggcctgggggagggatagcattaggagaaatacctaatgtaaatgatgagttgatgggtgcagcaacccgacatggcacatgtatacctatgtatcaaacctacacgttgtgcacatgtaccctagaacttaaagtataataaaaaaaaatcagacatatgaaaaagtaacaaattaaaaaaaaaaataatcactattatgatgagtttcctctttttcccttttatgtactataatttatttttcctaaattaatgatggcatgttttatacaaaaatattttgtcattccttacatgaagaaaatatcacttaaattacttacatacttaaagttcatattttggctgggtgtggtgactcgggacgcctgtaatcccaacactgtgggaggccaaggtgggcagatcatgaggtcaggagatcaagaccatcctgcctaacacagtgaaaccccgtctctactaaaaacacaaaaaaattagccaggcatggtgggtgcctgtagtcccagctactcgggaggctgaggcaggagaatggcatgaacccagaaggcagagcttgcagtgagccaagatggcgccgctgcgctccagcctggaggacagagtgagattctgtctcaagaaaaaaaaagaagaaataaaccccagcatttccagggaaccaggggagttctctttttgccataggaactttggctcctcacctgacacataaagccaaggaagagcacaaccagtttgcgaagcatgatggaagaaactcagtgacctgtcattatggactgtcactttgatggtttttcacaggatgtagtgctcctcgtccctccctctctcctgagatcttagtattttgtctccactgaattaccattgattatttcactcagtctaccattataattacctgcgcctacaactctgtattgtcattactatttccagaaaatatgagtcctaatataataaaaacaaaatagtcccacttttgaataatgactatatatgcaacttcagcatttcacctgtatgaagtcccagacttaatatgttcttacagtcacatgaaaaagcatgacttttttttttttttttttttttttttgagacagagcctcattctgtcacccaggctggagtgcggtggcacaatcttggctcactgcaacctccacctcctgggttcaagcgattctcctgcctcagcctccagagtagctgggactacaggtgcgtgccaccacaccaggctaattttttgtatttttagtagagacggggtttcactgtgttagccaggatggtctcgatctcctgaccccgtgatccacccgcctcagcctccccaagtgctgggattacaaatatgaggcaccacacctggccaacactgtatttattcgtaagatgagatatgttctttcacatattatttcatatattctttttagtttataatatcatcagggacatgtgtattcctggagtccctctcaggaaaaactttaaaaatcttcctaaagtattcccctaagaaccaacacactaaataatattgttactttcatctgtgtaagtaaaaatgtgcaagtactgtgtaagtcctaattaacacaagaaaatccaattatttttattacatgaatcccttttacactagtttaaattgtaaaattggaagatgacaagattcagctctactttgaagttttcaaactaaatttgttgtttctataaagtatatttgaaactatttgctgtttcatgatccacaatcatctcaccaggttttactgtttttgtatatagaaaatgaagtatgaaggtgattgaacaaaagtaaatccacaattatacactcagtaatactgctcctacataatcaattgggaagtaaaatgaaagaaacttcagtcttatttttccaccctctactaattatggcttcttaacttgcagtttatcttcagattcttaagactatcataaaacatcacatatgaaaattaatgatggccagatgtggtagctcaccacctgtaatccctgaactttgagaggttgaggtgggaggatcacttgaggtcaggaatttgagaccagcctggccaacatggtgaaaccccatctctactaaaaatacaataattagccaggcatggtggcacctgcctgaatcccagctactcgggaaactgaggcaggagaatcacttgaacctgggaggcagaggctgcagtaagccgagattgcatcactgcaccccagcctgggcgacagagcaagactccatctcaaaaataataataataataatgataaattaatgactataccaaccccttaaaaattttaatgagaatcacttagtccttcataagtgaaaaatagattagtcatcagatttcgaatgcaggtttcactatttcaaaaacaacaaaactaagaaactagagaatacaaataatccttaccagataagtatcatcattagattttaaaaggaaagtacaaaataaagcaccactatatgaaaccttagggttttctcttcaatatactaaatcttcgttttaggctagaaatctttatcattcctattttccacaaatttttacatgcaattcctttaagtctatcataattatggattcaaaacccttcataccacatgtagtgtatatattaccagctatttaacaaaattgcagttgctggatggcccataatcagagtggcaacttcaaactgccggtcaccttcgaatgggtaaggtccaggttttgtgttgaccacacactgtcgagactcaggtatagggcatatagaatacgagtggtggactggtttgtgggtttgagggtctgggtggaagattacaaattcttctttgtgcaaagtgtaggagtacaacattgaacatggacttagcatatgtatggtctcccccactccttcttaagccgaagctggagagaatgggcattttgtaaatgttatggcatatgcaaatataatataatggcattaaataaaaacaataagggaactgactaaaacaaaacaggctgtgggctgggagttggtatatctgagttctactataacctggctgctgacattctctgagactttgaacaattcatgttgtgggaagtcagggaccccaaatggagggaccggctggagtcatggcagaggaacataaattatgaagatttcattttaatatggacatttatcagttcccaaattaatacttttatcatttcttatgcctgtcttacttcaatctcttaatcctgttatcttcataagctgaggatgtacatcacctcaggaccactataactgtgttaactgtacaaatttgattgtaaaacgtgtgtttgaacaatatgaaatcagtgcaccttgaaaaagaatagaataacagcgattttcagggaacaagggaagacaaccataaggtctgactgcctgcggggtcagacaaaatagagccatatttttcttcttgcagagagcctataaacagacatgcaataaggaagatatcgctaaattcttttcctggcaaggaatattaataattaataccctggggaaggaatgcattcctggggggaggtctataaacggctgctctgggagtgtctgtcttatgcggttgagataaggactgaaatacaccctggtctcctgcagtaccctcaggcttattaagattgggaaaccccaccctggtaaatttggggtcagaccagttctctgctctcgaactctgttttctgttgtttaagatgtttatcaagacaatacatgcaccactgaacatagagccttatcagtaattctgcttttgccctttgccttgtgatctttgtttctgccctttgccttttgatctttgttctcctttttgccctttgaagcatgtgatctttttgtgacctactccctgttcttatgccccctccccttttgaaatccttaataaatcttgctggctttgaggctcaggtgggcatcacagtcctaccaatatgtgacggcacccccaggggccgagctgtaaaattcctctctttgtactctttatttctcagccggccaacacttacagaaaatagaaagaacctacattgaaatattgggggtgggttcccccaataaattcacttatcttgtgccttagtttattcatttaaaatgaagaaaataagggctgggcacgatagtctatgcctctaattccagcactttgagaggctgaggcaggaggatcacttgaggccagtagtccgagatcagctggggcaacatagcaaggccccatctctacaagagtttttgtattttttgtttatttgtttgttttattagccaggtgaggtagtacatgcctgtggtcctagctacttgggtacctgaggcaggaggatcacttgagctgaagttatagtgagttattattgcgccactgcattccagcctgggccacagagcaagacctcctcttgatcaatcaatcaaagaaaataagacagtctagccccatctcactgactattgtaatagaagtgagataatatgtgaataaagcacttaaagccttaaagctataaagagttttttttaatgtgaaaaactattataaatatttatagtgttctggtactacactgtcaatggacacaaatgttccaaggttcatatagcttcttacagatgaaacactcatggcactttgctcactaataagaataaatcagtccgatccaaatagaacagttttagtttttattagatgcctagaacactgtaaatatttagtaattggtaaaggaaggtaagtatattttaactcttaattctaaataaagacaatgcaataaatttaaaatgtagatatgtttgtaaacagaatatttcacataactatagataccaacctattttttatgaatatggcaggataaaattagtattcctctctttcaatttgaaaaatattccaaaagcaacacgaccaatgaaaaacagaaaccccattttgggcaaaactaggagacaaaccacaaaacgagtagaaaggctgccaaaagcaatggagatgaagtgggaatgtatgctgtaggcagcataaagagaacattccagttgcaaatggcagaaaaaaacaaagtctatttcttgaagttgatgggtacactttaaggtataaaccccttgtttatatcaaagtgcacaggctgacagctagtgctttcccatatgtggtttggttccaagaagcagaaagaacaatgctaagtaaggaatcacactaactatatttgcagagagaagtccatctctgtggctacataagacaaaagactttgtacaatgaaactccccaaagttgtctatctccattggctggacaaaataaaggataaatagaatttaaaagatctacacccaaaacagaactttcacaaaaaaactgttgatacgaagctgatgaaaatcatgatgaatactccaccattaatgaataaaactatacaatcgactctaatttgaaatttttaaaaatatataattataaaattgtgttgaccagaacaataacaaagaaactcgtataatcaatcacttacctctgattcatattttatttttccttcatctaaaatacgtgcatactcttccttctggtgttcaaattctgacttgagaaatgtatgttcatagcgaagcttattatatacagctctatacttttctacctcctaaagggagaatgcatttatcatagatttataaacaaaattcgtactcactccaatagtcacttttacaaatataattttaaattacattataatgatagccactctaaaagtaaaaaataaatttaacagaaatacaaatgaatttggaaaggtcttcataacaagtatcctacatacagaagtagtacattcctgaaaagatatccaaaaagtaaattaccattcaattaatcttatttcttcactggttctcattatgataaagtgtatagtatgaggaaagtgttgatctctggacttaaataaaataacatgtaagaatgtagcacacctttcaaaatatagattttttaaatgtataatttagtataagtaaaacaaattcaaaagagatgtaaggttattgtaatatttagtacagcattttaacatctaattaaatattacaatgatagtttaactcaacagaccaacctgaagaatacgtgcagcatcatctctactgactaaccaggaacacatgcaattccctggagtgttctcatcctgcttcctaacagtactctatgaaagctgctggcattctgaatacccaacaagaaactcaggccacaaagcagaaagatacaggagacactaacaggaaattcgataacaaggaaagcatgtctcctaaaatacccagctcaccataaatctttagttcaaagatttctaagccagtttgtaaaccaagaaaatgggtttcattattttactgcagatatactttgctttgatttaaaaaaaaaagtttttattgaacttggtcacttatcttgggtctgatcttgtttatttacaaaaattaaacctactcccaaaccataatggcttgccattaggactgtattagaaagatcatattatcaagccagtaagccattataaaagacgattctacaactgttttgggcaattaccgcatcactagactacagctctccaaaggggcccattttgaaggggacaataatcatttgtatgtataaggccaggtatatttgttaaataaggtaacatatataaaatgtctaccaagtatctaatatacttgttatctgcagtcttatcctgtcccctttattaagcatttagtcatattatatcaacacttcaccaaaggagactagtctcaacctgaagtaaaactgtaacagatttttacttttatgaagtggcatgaaactcattctctctttcaacaaatattaattgagcacctactgtataccaaaatctgttctaggaacttggaatataacaatgaacaaaacaggtaaaggttcctcctctcatgcaacttccattctagaggtggtaaaacagaaaataaacacaataaataagcaaattatacagcacagtagaaggtatgtataccagaaaaaaaaataaaaaacagagcaaggtaagggggtctaaaggtctaagcagtaatgggaaaggcaggttgcagtattaaataggtagatgggagcagtcaaagtaggccccattgagaaagtgacattttagcagacttacaagagatgaagtttgccacgacgtatctggagggagagtattcaaggcaaaagagatgtgccaattaggctgggcatggtggctcaggcctgtaatcccaacactttgggaggccgaggcgggcagatcacttgagatcaggagttcaaaaccagctggccaatatggtgaaaccccgtttctactaaaaatacaaaaattagccaggtacggtggtgcgtgcctgtaatcccagctacttgggaggctgaagcaagagaatcgcttgaacccgagaggcggaggttgaagtgagccgagatcacgccactgcactccaggctgggcaacagagccagactctgtcgcaaaaaaattaaaaaagaaataaaattaaaaataaaaataaagaaacgcaccaattctggaatgccaaagaaacatcagtaggccaatgtggaaaaaggaaaggagatcagagaggtaatgggagttcaatcctgtgaagccttagaggccactgcaatgactgagtaaaagggggaactactgcagggttttggggtaggggaatgatgcttttcatcaagactttgatcccatgaggataaatgcatagtaaacaacataagttacttacttcatctagattcctaaaacgttctctcattggagtttctaattcttgttgtatttgggctcttagcaattccaatttttgtggagttaatatctaatatgtagagaaatgcaaacaatataaaatcacattaaaatcaagaattctccatatttcaaagcctctctcctaattatgacaatggaattcatgaaagtttttgcaatatagtttttttacagtgatcactatacaaatagaatcatcatttgaaataatactttaagaatctcaatttcaggctcttggagatgtcaaaaattccattaacatgaagtaaagacaattactgattattattgctattgttaggaataactatgttggcagctaagactatcatgttgtatacaatggctaatagtctagttattttccaaagcaggcaaaataaaggtgtaacaatttgttataccaaagagaacctttcagacttattttcaattagaaaaggctcatttttactctcacactgtacctaatttaggcttctccttgtcacactcttttatagaactcgtattttaataagtaattaaatatttatgtaagtcccatgtgggaaaacacagtctttattcaccgttgtattcccaatacctcccaccaatgtctggcacataggaaccactcaactatttcatgaatgaaggaggaacaaatactagttgtaaaaaaaaaaaaaaaaaatctaaagtttgcatgtatattaatttctataaaaatgataatgttcagtttccttttttatgaagagtccaaatattgtattcaaaatattacattttactgaatggagagcttactatatataaagcattgtacaatgcactgtaacctacataccatcctgttctaagcacattatatgcattactttatttaattcctacaacaatgccacagtatagctatgctgaggcacacaaggtatctaaataactttataaagatcacaaaaactcacatgaagcacatatctccccataaaaacttcaaactctggtgttaaaaataactcatacacacaaataactataaaagtaggcaatacaggcttaccagacaggtaaaaaagagaaaacacatttaggatagaaggcatgacacgtcaaaggaatgggaaaactaaagcttatatagaacccttatatagaaagcttatagaacccaaactcaagccaggtaacattttaatttgcctgggtgtcagagactgtatgggagaaaagtgattctcaaaggtgagttaaagccattttgaatgggaccacattaagtactacagaaaatttaaaattgtgggaccctatatgcacactggtagaaatatctaaacactgtaacatttccaaatgccaccttggagggctgcactctggctggaaacaaaaggaaaattaggttgcagccaaagagtgaaaggttcctgaataccaggtttagactcttattatttattcagtattcaatagtatttactttaaaaatttattttatttaaaatgaatatatacaattacataaataaaataattcaaacaaaagactaaaaagtcttctcacttcagtaatccaatttccttttattgaagcaatcattgtcaataacttatgtacccttcctaaaacaatctacagatacacaagcatgtatatcacttttgatttctatacaaaaaggatattgtacatatatttttctgtaccttatttattgaaggtttttaagcttaagagtgacactaccatatctatattttacgaagaagcaagatgaatcaaaagctttagtgggagagtagctgtagctgtgggaagaagaggcagtaaatggagccaaagaaaccagacagaaagctcatgtcataatctggtttacggtatcaagtatcaagtctgggtgacaacatcaagagtccaaactaagatgaggtagcaattaaaaggaagagattaataggtaaagcttacatggctcctgtttcaaatgatctaacttcaaaactaggcaagcaaaaccatgggaaaattaagaaaatctgaacaaaggtgggatattaaaaggtattaatgaataagtattttaaatatggcaaaggtattgtgattatgcttttaagacagactgcactgatttgttatagagatatatactcaattatttgttgaaagaatattatttgattcaaaataatccagaaacattgaggaaaaaagtggaagtgggtgggagaaagtagtagataaaacaagcctggctcagaatgaataattattaatgctggatgatgggtacatgggaatgcattacatgtttgagatttccaaaaccaaaagttaaactgaaagtaaaaagccttccactttcagccaagatagaataagagcccagattcgctctcttgcctgaaacaaacaaaagaacagacaaaaattaaacagtttgcaagacactagacataagaaagcaaaaggcagatccctgagagacacaaaacatagaagataagctttgagagttttcaggacctggcaccggaaaggatacctatgcagtcatgagggactccctgagttgaggagatgaaactgagcatccaaggacagtggggtggttagagtcctaagacagggtagcagagaaaagagggcacagaaagacaactatgaagacctacaaaaagtcttgactcattcagtagagtactgattaacacatgtgtgcaaggaaactacctaaggctaggcaaatacacacctgaaaggattagaaggatgaatacgcagagctcacaaagacctaagaatagtttctgttccccaaaaacagattaaaatcctttgtttcataaagaaattgttatactactcagaagagtcttgcctcagtggtgggaaataattagcactacactaaatactactctgctcccacttaaatcttaaaagcaagacccagaaagataaaactgtttccaaataatttaactgtgtcccaaaataaagctcaagaacatgtatcagaatataaaaatattgggaggtggagattgcagtgagctgagatcactccattgcactccagcctgtgcaacaagagtaaaactccgtctcaaaaacaaaacaaaacaaaacaaaaacaacaacaacaacaacaacaacaaaaatccagcattttaaaaacaaagttcacagtatctaacatccaataaaaatttaccaggcatgcagagaagcatgagagagagagagagagtgagagtgagtgtgtgtgtgtgtggtgggggcaggggggataaacttaaaacaggcccagaaatgacacagatgtcattaaaactttattgtacagttattgtaactgaattccatatgttcaaagaactagagaaaagactgaacatgttggatagagataaaaagaccaaggccgggcaaggtggctcacgcctgtaatcccagcactttgggaggccgaggcaggcagatcacgagctcaggagattgagaccatcctggctaacatggtgaaaccccatgtctactaacaataaaaaatttaaaaattaaccaggcgtggtggcgggcacctatagtcccagctactcaggaggctaaggcagtagaatggtatgaacacaggaggcggagcttgcagtgagccaagatcgcgccactgcactccagcctgggcgacacagagagactctgtctcaaaacaaaaaaaaaaaaacaaaattgagcttccagagacgaaaactacaatttctgagatgaaaattacactgcatggaattaatggcaggttagatactgcagaagaaaaaatcaatcaatctgaaaacatggcaacagaaactaaccaaaatgaagcacagagacaaaaaatactaaaaataaattaataaacaacatcagcaagctatggcagaactttaagtggtctaatattagaatgtaattaagagtctccaaaggaggtgaaagaggagaaagaaaatatttttagaagtaatctccaaaaattttcagtttgataaaaactgtaaacccatagacctatggaactcaataaaccccaagcactacagatataaaaaaaactgcaaagtatgtcaatcaaattgcttaaaaccagcaataaagagaacagcagccaaaaaaccagacaaagtgcactgcaaagaacaaagataacctgtgctcactaccctgtagagtgatgtagctgcacaatatccatgcagcttctagcattatatgttcaattacatcacagatgcctcttggaaacaacagtgctttaaatcctgtaatggtgtgcacctcaccactggcctgtgcaatctaatagcatacaacagtttaggggtcttctgatctgaggtctctgacaaagcatctctaactttttcttacctcctaggaatcttattaaaaacaaatacacacataataaattctctcttcctctgtctctccccatctctccctctcctatcccctatacctccaaagcacacataaaccaagacaccgactgaattagaggatttttcccatcccattttaggaaaaaatattctctcttaggctactttttgtttgtttgtttgttttggagagagaaagagtctcgctctgtcgcccaggctggggtgcagtggcacgatcttggctcactgcaacctccgcctccaggttcaaacaattctcatgcctcaccctcctgagcagctgggaagacaagcatgtaccactacacccagctaatatttgtattttcaatggagacagggtttcaccatgttggccaggctggtctcgaactcctgacctcaggtgatccacacaactcggcctcccaaagatctgggattagtcatgagccactgcacccagcagtgtcttagacttctaatggaatattgccactacttgtctccaaagaaacataagaatgctttatcatacaacagtctaggtgtcattacctattttaaatctataaaaacaaatctttaacactgcagtacttgccatttaataatctaaaataggccaatcttttacaaagaatactttaaggcggcaaatactgctatgccaaaaattcttaataaattaatgactgaaactgagtattatactttgatctgagcttcccagcagccaaaacaaaatgggaacctgtatactaggttatacagttttcattagcacaaaaagagtatattaatcattggtaaagtaatttccgttttattagaatatatcaaatgatccccatatttaaaaaggttttgctaacatggtacatagtaacacaataacaacatgtactgaccacttactagatcaaagtaccatactaatacttttttttgagtcagggtctcgcgctgttgcccagggtaaagtgtggtggtgtaaccatggctccctgaagcctcaaactcctaggctcaaacaagtctcctgactcagcctctctagtagctgggactacaggtgcatgccactatgtcaggctaacttattttactttactttttagagacagagttacccagttacgttacccaggctggtttcaaactcctagcctcaagtgatcctcctgcctcctgaagttctcaaggtgggagccaccatgctcagcctgaactaacactttctatgcactgtctcatttcatccttacagtcatcctatgagctaggcactattatcattaccattcactactgatgcagaaatgttctttaaatgaatatctcttatatctttttcctataaaagccaaagagatgacattaaatcttagaaaaagcatttttgtaggcagactagataatgcacgtatattttaaaaataatcatctttcataaaccttcattgaaatatttcttgatctttgttgaatttacttttctaaacttacaatttgcgcaaattgcaagcatccattaaacaaatagctaaattgcttcaaaatgtgtgtttatatgtatacatgatgtttctttagcttatttttgccaaataaatatcacacagaaactagatatgtttatcttaaaaaacagaagccttactagatatgtttatcttaaaaaacagaagccttactagataaattatatttgtgagcaaacatttgggaagttttcacatggaggaacatccaaagttaccaacagggaggctatagggtagatgacttcattttaataggagagagaaaatgtttaacatactttaatctataaatacaattggatcactttaaaaagttcaccaggttctctagcactgaaagcactgaagcagaaaatgaagagagtcctgtctgaaagatgttctaaaaaggattctgctttggacagtgtattcgtttcctaggttgccataataaaataccagaaacgacgcagctttaaataacagaagtttgttctttcacagttttggaggctattagtctgaaatcaaggtgtgttgacaggccttgctccccctaaaatctgcagggaagaaactttccttgcctctttctagcttctggagcacttaaatctctgcctccaccatcacatagtgctcctctctaccccatctgtctccatctctcttctcctctttttttaaggacaccagtaatattgagttaaaggctcatcatactccaatatgacctcatcagcttaactaattacatctgtaatgaacctacatccaaataaggtcaccttctgaggtactaggagttaggacttcaacatatcctggttggggatacaactcaacccataatagattcaaagaaaaactagatgattaccaactctaagatgctgaggctgtaggtatgtttgacacagacagtgcaatatatgaacaacaatcccaattcattcatttatttcaatttttcacgtcattcattcaacaaatagatgtttactaggcattatcctaaacactgaagacacactgaaaaaaagttcctgccttcatggagcctgaattcaaataaacatgtcataatctatgaatatttactatgtggaaagtatggcagtaaaaatgtagatgttatctcattagtcctcacaactcttgttaagcagaaacttttatccgctttaccacatgagaaaactaggcatagagacatagttacttgttgaagttatcatcttctggaagaactgtcccttttttttcattataaacatcctttttatctttagtgatactctttgtctggaagtctcttttatctgaattaatataactactccagccttctggatgtgctttacttactttctggatgtgcttggtacaaataatcacatttagatgtcactctcatgaaacagaataattaaatttgcaatacctgaagaatctctcaaatatcttgggttcagcattcacagcttccactcatacagggctctaaatttttgcaaaacaaattaatgcattgattctacaggcttaaattacatttccctcttcgatttacatttctgaggtttatatttgtatatttaaatgtcctaaatatacctaggaatgaaacagtgagcatagtggaggctccaagccaggcttagtggtgttcccagcaatggtagatttgaaaaagttattgaatgacaaacttacaaggcttctgtcaaaggatatctaagagttgggtgatatgccagactaggtgacttgaaagatgccttcttactctatgaacttctgactctaatattaataataccttattatttgtaccaatcagattgttaggcagaaataaatagctggtgctcttcagagattaaataaatatgggaaaatattattcgtgagaacctactaatctgaaatttacaggaaatttgactggagtttaaagtctggctttgctcaattttccagacaaatgaaaaaatgaatagcgtgaaaatgatctaaagaaactgtacttcagcactttggagacaactatcttttgctttacaaacccatttgtgttacaatgtacacataaattatgttcacatactgtttttacagtctcttttaagaagctctttaagaatagctgtccttttttagctttcagttataatgcatatacaaatactagtaactcttttaaaaaaattctttaattctgaatttttatcaattcaaactcactttttccctaattattcttaatggttaaatattatttatatcagaataggcaatataataccaatttacataaaataacagtttcatggctcccttacatggtagctaacattctaaaatatatgaaagaagattaaattgtaccacttggagatacagcaaagtaatcattaaggatatagacagaaattgccatattcaccaaaactacttacttccactacgtatctgactgcttttatactaactcaaaactcaaatatattttctcacctgcagtttcatttcttctaaatctttagttttctctactaattctcctcttagttcttcaagcaggagctgaagtttttcctgctgagtttgcttttcattaaacaggtgcttgagttcattttgtaactttacatgttcattctgcaacctggttttttttaaagagaattcaattttgagtaaatcctttctttctaattgcattactttatgtaaagtcaatcaacaccacagaaaaacaagaccaatatcacacattcctttaaacccacaagtatcttttatttacagagtttcatttaattattaacactgtagttttggaatgcaattttactttggtgggagatggggaacacatttagccatctggatacatttaatcttatacgtcctgctactttcaaaataaggcttataaattcataacccacttgatatcatacttagtttggaacaaagtaattttaaagtaaaaattttactatattaaaaaagttttaaatgtatacattgcaaaataacaaaattatactatattctatagcaaacattcagccaagataatgccaataactttttaaaaccaaaccccacttctagatttaagtaatttaccttgtgtgttcagccttcagtgtctgataattagctttatgatgctcacatcgtaacctttcatcaattaacattttctggaactccgactgagaacctgtcaatccactgtctccaccaggaggaaaattattgggaaaagtgtccatatcggtaaatgtgctgacaaccatgtaaaaataagttttggctttcttactgttttagttttctttccaagggtatttcccactcctttcttgctaaggcagaatctcaggaagccaaattatacctgcacagagaaataaacataattacataatttgcgatcagtaaacgtaagcctcctttaatgttacatatttttatcacttttattattcttttttttttcttttttttttttttttgagaggagtctgctctgttgcccaggctagagtgcaatggtgtgatctcggctcactgcaacctccactcccaagttcaagcaattctcctgcctcagcttcctgaatagctgggattacaggcgcctgccaccatacccggctaatttttttttttttttgagacggagtctcgctcgttcgcccaggctggagtacagtggcgctatctcgactcactgcaacctccgcctcccgggttcacgccattctcctgcctcagcctcccgagtagctgggactacaggagcccgccaccacgctcggctaattttttgtatttttagtagagacagggtttcaccatgctggctaagctggtctcgaactcctgacatcaggcattctgcctgcctcggcctcccaaagtgctgggattacaggcgtgagccaccacgctcagcctctccttatcatttttattacaaagcccaattctcagattttaatttgttcataaaacaaaatgcaaatataaagctgaatcacaccttgaacaattttctttacctccatgcagcttctatgcttctatgaccatcaaaatcacatcttcaagtattaacctagctccactagaagcagactttcccagtttaggtagtcttaaattcacaaaccagagtcatgtttcctgaagctaccacagtaagcttcaagtatagatcctggtataaaatccatactcccaaatcagaggaaaagctatttggaacttggtaactggctagggagaatcaaggtcttcaaaaggtgaccttcagcaagtaactatgcctatgattaatgctttgaagggtcttttacttgacacaaggcaagctgcacccagactacagattcacatgagaaatttgtcaacacataaatattgatcaactcctatgtgttatacactgtgttaagaaaactaaatctcacctatctccaaaagcactgactcagtattacaaacgtcactgtttatttcatctagaaataaaaaatgatgtttcaaagtgttcttataactaagaacaaaaattttaattaaaatagttgtctcctttaatttctttctctagtcccataatacatacacacacacacacacacacacacacacacacacacacacatacatacatatttttttcctgatagaatcttccttagccatgggttattacaaatcacttcttataacaaaaaaaaatctttgtcctatgcaaaccgaccattaaattattcagccttgcttgaattataccatctctgataaattagtgtgatatctacgtattacttaagacaatctttaaactataattgcagttgttttggtttcctctgaaattatattttaatacagagggaaaagtccctcaagaacactatactccttactcttagatttaacacgcactgggattcaatctttgtaaatacagaatgcgctatctgtagcagctaccacaaaattatcctgccaaaagtacacatttgccaaggaattaatgaattgcatcataaaactggcattcaatttttactctactgtgggtaaaatgctatcaaatagaatctcatgctccaaagaaatctttcatgaaaggaagagtcaactgatgtggcaaacttcactgttgtctcattttaagaaactgctacagccatcccaaccttcagcaaccatctaaatagttagcagccatcagcagaaaggccagacccttcacctgctaatagatgattactcactgaaggctcaggtgatcaatagcattttttagcaacaaagtactttccaattaaggtatctacattttaaagacataattatattgtaaacttaacagactacagtatactgtaaacataacttttccatgcactgagaaaccagaaaattcttgtgacttgttttattgcagtagcaatccaaataagttaaaataaggaaacactaattcctaaatgtaagtttagatttactcttgacttctaaagctttacaggaagaaaaaatatttgggggttaataaatatgtttggttccacattaaaaattattctgtggaaaaaatacatttttaaagattataaaatgtgtctttataaaatgttgatatgtgacagctcaaaattgcttacttcctaggttttcactaaaagttaagattactaagatttaactaaaaattaagattgctaagagttaaaattctagttaatacatagaattctgtatgcaaagggtacaagaaaaaaacaaaatttgtttttggtgaaaaaagtgttttaaatggcataaaaatgtgtttttatttaaaaagtaatttgtctaattcagaagttattgaaagattatttcaaaatatgaatttggaaaaacatgaaaacaaggcagaaaggaacaagtgaaaaacagacacaaaaaactatgagaatgtatttttggtaagaaaagagaatgacagtaatttttgtataaaaaaacttatgtggttgaaatgatagaaaaaaagggaagtaaatttttgtcctaaggtaaaatgattgtttcagtataaacaagagaaatataagacaaaactaaaggactgagcaagctgtagaaggtctgggcaaattatgaaaggtttgtgagagatgaatcttatgaaagaaattttatttgtgaacaaattggctaaaatgaaaagtaaattgtttataggtttgtcttaaaattgagtcctcatatcaaaagtacactgatacaacactaaaatttgatcttctcttttaaaacaagattttcttattgattgctctcaatgaaaaaataataaaagtagattttaaaaggcaaaaaacccccactatttaaaatggagagagaaattaataatgataaaggttaaatacaccagaaagatgtgacaattttaaatttacatgcacttactatggccactaaatagtaaggcagaagttgtcaaaactataaggagaaatagacaaattcacaatgataggaggagaatttcaccactattcttggtaactaatgggacaagaagatttaaaaaaataatcagtaagaacacagataatttaaacaacacaattaaccatgctgacctaactgacatatggaagactataccctgtaactacagaatacacactcctcacaagtatacacataacatttataaatgttgaccacatgccaggtatttaaaaaaaatttcaaacattttaaaagaccaagatcatacaagataccttctctgaccacaatgctattaaactaaactcaatacaaaaaataatcagaaaagccacatatgcttacaaagtaagaaatacatttctaaataacttatgaatcaaagaaaaggtcaaaatagaaattagaaaatatgtagtactaaatgaaaattgatactccattttaaaacttatggaataaaggtttctactttgaggaagatggaacagatatacattttccttttatactcattaatataactaagagtcctggatttaggtatatgacaaacgtaagactctgaataatggagactagaaggctgactagctatggacctgagaatgtaaggacaaatacagtggtgagtttatttccctgggttttctttttcatatatctcagacacagagctgaagaaactggcaaccaggaaacaccaattaattcagacaaataagtcttgaacaaaaaagcctactctctagccaaaggaacaaaaaagagggagcctagcaagataatatgtagacaattacaatctactctatccaaataccatacacacacacacacacacacacaaaaaaaaaaaaactgtagttccacccccatccacacaagcaaagattaggtggaagccaagctaggctgtaataaaataccctaatactgggccaagatggtgcacaagaaggctcaccagaaaacagaaacttccattgcttcctgaaccgtaataaagctcaatgatcctgcaatgtcagaggagaccacatggaaaacctaaactttcaccccccaccaagagtaacaaagaggacctccctcaccccactgaaatgctggcacagaaggcctagtggagacttatgacaggcagaaccaccaacagtaatgaggctaccctctccagggtatcagggaagatcacatggggagccagaactacagctacctggcaataacaaagacccctcccgcaacccccctcccaaaaaaaactaaggtgtcaacagaggccatcttagaaacctcgacttgctaggcactatggcttgtgactgcaaatcccagccactcagaaagtgaggtgggaggattggttgagaccaggagttcgagaccagcctgggcaacacagtgagaccttgtctcaaaaacaaacaaaaaaaagtcattagctaggcatggtggcatgtgcctatatgcccaggtacttgggaggctaaggtaggaggattgcttaagcccagttcaaggctgcagtgagctatgattatgccaccacactctagcccaggcaacaaagcaagattcccacctcttaaaaaaaaacaaaaacacaaacaaaaaaaccttgtacttccatctccacctggcaaaaacaaggtagtatgccctctttcctctaccagaaaagtgtcagaaaaagccagctaaaacaaaaagtttagatagaatccacaatattataatatcccaaatgtccaagtttcgatagagaaccactggtcggccaggcacagtggcttacacctgtaatcccagcactttgggaggccgaggcaggtggatcacctgaggtcaggagttcgagaccagcctggccaacatggcaaaaccccatctctactaaaaatacaaaaattagcagggtgtggtggtgcacgtctgtcatctcagctactcaggaggctgaggcaggagaacgcttgaacccaggaggcaggggttgcagtgagctgtgatcacaccacagcactcccgcctgggcaacagaggaagactccatctcaaaaatacatacatacatacatacatacatacattaaaaaaagaaatccactgatcatatcaagaatgaagatttcaaactgaatgaaaaaagataacaagccaacactatgatgacaggaatgttatggttatctgacaaagactttaaagcactgatgataaaaatgcttaaacaaacaatgacaaacaagcttgaaataaatgaaaagagggtcacagcaaagaaatacaagtctcagaaaagaaggtaaaaagaagaaccaagtggaaattttaaaactgaaaaatacggctaagcctggtggctcatgcctgtaatcctagcactttgggaggctgaggcaggtgggttacttgaggccaggagttcgagatcagcctggccaacatggtgaaaccctgtctctactaaaaacacaaaaattagccaggtgatgtggcatgcgcctgtagtccagctactcaggaggctgaggcaggagaactgcttgaatctgggaggcagaggctgcagtgagccaagattgtgtcactgcactccagcctgggtgacagactgagactctgtctttaaaaagaaaagaaaaaaatacaatgaccaaaataaaaatattagatgagctcatcagcagaaatagagaggaagaggaaaagaattaatgcactgggaagatacaactacagaaattactcggctgaacaatagacagaaaatagacatacaaaataaataagcagctcagggactgtcagaactaacaaaaaatacctaccattcctgtgcttggtgtatgattccatttatatgaaatatccagaatagataaatacatagaaggtaggctgatgatttccagggactaagggaatggggaaatgggagttgactgcttaatggttacaaggttttctttgatgtggtaaaatgttttggaactagataatggtagttgttacgcaatgctgtgaatgtaataaatgccactaaattatatactttaaaatagttaatgttatgctatattaatttcacctcaataaaaaaagagaaaaataaacctagcaaactagaaacttaaaagtgcatcaatctcatcaaaggtgtatataaaaagagtattttaaaacaccacacctgactttaaaatcttaaaacatctttttctgagagtgtgatcaaaacaagaaagtccattattgctacttttattcaatattgtattgaagaactagaacaaaacaaaggaatagaaggtataaaaactaaaaaaaaaaaatctttatatacacatgttctgattgtgtatgtagaaaatctaaacaaatttacagaaaaataattagaaaaagcaagttagcaagattggcagatagagcaatatacaaaaattaattgcattccatatgccagcaacaaaatattttttatttttttcaatagtgatattctttaacaacaatgtatgtttaaagacattcttaataatataaaaaatatcaaaaacctaggtaaaaagatgtgcaaactatttattataggaaaactgtggctagctactgaaacaaactaaaaaagacctaatagagatatggactaggtgtatggattagaaaacattctaaagagacaaattctccccaatctacagatgatgtgatatcaattaatatccaaatgagtgtgtctctatgtgtgagaaacttaacatgctgattcaaaaatttatgtggaaatacaaaagacaggccaacaacagtggaaatgattttaaagaaaaaaatgagaagactttactatatatcagtacttactacaaatatacagtaattaagatggtatagtatgccattggcttaattatagacaaagagaccaataaaacaggacacagcccataaactgacctacccatataagataatttagaacaaaggtggttttgctgaaccgtaaggagaagagagtcttcaataaaggccactgggacaactagataaccttgtagaaaaaaagaaacttgcgcctttctttttattacacactaaaattaattctagttggactgaagatctaaatgtgaaaagcagaagcacaaagttgccacaatataggaaaaaatattcagtaactcaaggcaggaaaaatagcacgtctaaaatctaaaaggtgattcccagataaataatgagaccgagcaccttttctttgtttactggccatttagatatcttcttttataaaatatccatttgcatcttttgcccaattttttctattgaattgtcttttcaattactaatttgtaaaaattattcataatatttaaatctcaatgagaaaaccaaaaagactgacgataagtctggagaggagaggaagcaaaggttgtagtgtaaactggcatattcactttgggaaaaaaactagcattatctactaaggttaaaaaaaaatacatatactatgactcagtaattcctctcctgggcatatatccacttgaaatgtggtatacacaggtccacaaaaagatttatatgatactgttcatagcagtattattcctaacaactgaaacctagaaacaaatccaatgaccatcaacagttgaagaaacgaatagtggtataatggaactagcactatactgcaataaaaataagctatagatcaagtttgtccaacctgtagcccatgggccacatacagcctatgatggctttgaacgcagcccaatacaaattcataaactttcttaaaaccttatgagagtttgttttgcatggttttttttgttttgttttgttttttagttcatcagctttcgttactgttagtgtattttatgtgtggcccaagataattcttcttccagtgtggcccagggaagccgaaagactggacacccctgctatagatactctatatatatagggtgaatattacagacatattgtccagaagaagccaaacataaaagaatatacactaaattattacaaatagattattacaaatatataaagtttaaaaattaaatacaagcactatagtatataggggatacatgcttaggtataagcatgtataaagaaaggaactatattatcattaaagtcaggaaaatattacttgatgaggctagtaacgttctacttcttgatttttgtggatatatggaggtttgctttgtaacttgctttgtaaatcactcagctgtacattgttgtgtacttttctatatgtatattataattcataattttttttgagacattctcattctgtcatccacgctggagtgcaatggcatgatcacagcttactgcaccatcaatctcccaagctcaagtcacctcagtctcccaagtagctggtactacaggcacatgtcattaggcctggctttttaaattttttttatttattttaatttttatttttattttgtagagacaaggtcccactatgttgcccaggcttggcttgaactcccacactcaagccatcctcccaccttgacctgctaaaatgttaggattacaggaatgagccactgcaaccaaccttataattcacaattttttaaaaagggacttagaagggagagtaattcaaaaattgggctcagcatcatgtcaaggactgtagtccttttcatttttcttccaacaaatcctgttggcttaattctcctcatggttgtgaggctaccacatggatatgtaatattcattttttaaaaatttattctactatttctcctttattcatgtgcttgtttatagtcctttaagtaaaatttacacataatgaaatgcacaaatattatctccatgcatcacttaacaaggatatgctctgataaactcattgttaagtaatttcattgttgtgtgaacatcaaagaatgtacggtacttacacaaacctagatgatatcgcctattatacacctaagatatatggtatatagcctattgcttgtaggctacaaacctgtacaacatgttactgtactaaatattggaggcaactgtacaaaatgaagtagaggttcctcttcaaagggactttccttccagtctaattgagaataaatagtagcctctcttagaagcaaaatttactcaaagacctgtggtaatattcttaaatatctgctagccataataaagaaaccaatatgctttgtgtgcttagcccccaccttttggcctagatatttgccctggcatgcctatataggcccaagcaagcattaggttatagcctgtttctcttccttatttggaggtgttttggcctttctcagcattccacaagttacttcctcctttcctttgttctcccctacctttacctcttttgggaggttctaagttgctagccaatcaggacaagaacagaatgtgaagtcccgttccagccaatggaaactggacacagccatagcatggacgcattagattataaatgaccctgtctcctttgtttgtatgtgctctcatggcaagactgctagtgagtggcaccctttctgcagaaagtaaattagccttgctgggagatcctttatcatagtgttgatttccgcgacactgaatacccatttccaacagcaactgtaacacaaatcactaggcaatagaaattttttagctccattataatcttatggtaccactgttgtgtatgtggttatatgcagcacatgaatgcacacaatttcatgagttcacaaaaggaagaattcaagaaagcctcaatttcatcaagatataaaacagtcccatcactccagaaagttccttcatactccttccccatcaccccacccacaagaggcaaccacttttgtggttattctcaccatagctccacctgatccagaacatattaaagtgaaatcatacagtacgtactctcatgtatttgccttgtttcacccaaatagctgtgagattcacctatgtttttgtgtatctcagtagtctgttcctttttaaggctaaatagcatttcatcatttaaatataacacatattgtttatccattctcctgctgatgcgcatttggttgtttctggttacaatgaatatagctgctatgaatattcttgtacaagactttctgtggacacattttcagtttgggggtgggtggtggtaaacatttaagagtggaattgctgggtcatggagcaggtttatatttaactttgtgtaagaaactgccaaatctttttccaacgtggttgtaccattttctattccaaccaaaaacatatgagaatttttttttttttctgagatggagtttcactcttgttgcccaggctggagtgcaatggcgcaatctcagttcatcacagcctctgcctcctaggttcaagtgattctcctgcctccacctcccaagtagctgggattacaggcatgtgccagcacacccggctgattttgtatttttagtagagatggggtttctccatgttggtcaggctggtcttgaattcccgacatcaagtgatccgcccatctcagcctcccaaagtactgggattacaggtgtgagccaccatgtccagccaacatattgagaattctgtttgcgccacatttttcccaataccttgtagctgcaccagaccaatctggttcaactttttttttttttttttgcaaaagaaaaaaagtttttttgatctccttgaatgtagcacacaaaaaaagtgatggctcccccaggctccatcagcaacagtaaagggcaggaacatagagatttctttttccaggcccaggcctgtgaaaaacgatggctaagtgttagtccttagcagggccgacggatggtctccattcctggttaaccctctggaatttgggagcatgagtatctccaagaattcatttctactcagtaaagatggggaggggaatcccactgttacttgttgaactggaaagaatagaccccatgctctgagggtgtgtccactgccacttggttctgttggccgctgctctcctcgactgaaacactggaaggaaggcacaggggtgtactgggagatgtaagctccttgcatagctgcagccgtcagcatatacatgcctgtgctgctgaggcagagatggcccagttgctgggtaaggggtcccatcatggaggcaggctggagagaaatgggatggtccatccctggtgtcagaactgaacctgaaggctgcatgaggtatgaatggtggtgcatccaggatgggttaggtacttgtagaggagatgtctgagtcactctctgatacgaagacacaggagaggaaaggtatggggagagtgcagaccgagcaagcatcctgttgggggtgatgttataaggggctgggtaaaacccattctgaagagctgtggtggggtcataggtcaaggccatgatgcccatgtctccattccttggccaagcccgtccattttgcacaaatattccttggttctgtcgtttctttggcccgccatcagcaaatttgcaaagcaagggatcggatggggctggtactccagggggtgtcttaatatattttccattaaagtgggtgatgatggcttcacacttctctgtggactccatccttgcaaagccaacacctctgctggtcccactggtatctcgaaggatacgggtggagataacctggccaaagggcttcagcatcccctccagttcctgctcatccattgacagtgggaggtttgagatgtataaatttgtggggtcctgttcctgttgctttaccatctgtgcctgtacaccactggccttcagtgctgttacagctttctgtgctgctgaagggctgtcaaaatctacaaagccatagcctttacatttgtttgtggtcttgtccagtacggccttagtggaaacaatcttgccatatggctgacacagcttgacaagatcttggtcagtagtgcctggttgcaatcctcggatgtataggttggttttgctcagctggtcatttccattgcttccactactgctgttaggtgtactgttgcttgggctaggtggtgccatctgctgagccaatgacacatatggcttcttgttgtttctattgtagccaaaagtagaaatcccgggcctggaagtcacggatagcagcattttctctttaatgttagggaacgagtgagagagagagagagagagaaagggagggggtaagaaagacggggagggagggaggaggggatcgagggaaagggggagagggagggaggaaaaaagggagggggaggagaaaggaggagaaaaggagcaggaggagagagatgaaggggggctgcctctggttcaacttttatgtaataaattgtgagttatttttcagctgccatggaccctcagctcacataacctgagcatgctcagatgagccaagactgcaatctcaggaggaacctaagtgcttggaccaagaaatggggactgaattaagaagcagacattgcatggcaggatccaggatccaatcagatcaagctctggcatcatcccatggagggatcctgtcagatcatgcctccagtaccacctcattgcaagatccaatcagatcatgccttgttatcctacacttataaaacctgactcaggcccctgctttaggaactatccccatgttctccttacttgttgcaagtaataaaatcctcatgctaaatcctctttggttgtgagcactgagttgatgatacctgccaagcaaccaaacccatctgtcgtgtgggtaataatgtgatgttgtgagtccctttaattgtagcccttctaggaggcataaagtggtatctccttatgattttaatttacgttttcctgaagcactttttcatgtatttaatggctgttcacagaccgtcttaatctatgaaaagatttttgctttaagaaccatcacagcaaagaatatttatgctgtagctggcaaaatgggagattttaatagctaatgtgtatataagaaatgaaaacaggccagtgcggtggctcacgcctgtaatcccagcactttgggaggccaaggtgggcggatcacgaggtcaggagcttgagaccatcctggctaacacagtgaaaccccatctctactaaaaatacaaaaaaaattagctgggcgtggtgacaggcgcctgtagtcccagctactcgggaggctgaggcaggagaatggtgtgaacctgggaggtggagcttgcagtgagccaagatcacaccactgcactccagcctgggtgacagagcgaaactccgtctcaaaaaaaaaaaaaagaaatgaaaacaaatctaaaatttgtctcattgcactaattaccatttagcttcctgagcacatactgctgttttctaccgccatggctttgtaaatgctaatttccttgctcagaaggctttttccatctctttgtattctgatctagtgaattcctattcagccttcaaaacccagctcaggaatgcattacttcctccatgaagtaaagaccctcccaaatagttcattattctgtgttttatcttgcattttagtatatacaacacatggaatgtaactttgtccatgacaagaaacatgtcttactcatgttcataatcccaacacctaaaaaaccacaggcacatattaagagctcaaaaataacaaatgaacaaataatgtgctcaccattctaatgctactttagcctcgattcacttttctcctccaaattcagaaacagtcttccaaacaatagtgggctgaatgctagccctcaaaatatgtcatttcctaatctctggatgctatgaatattaccttatatacttttaaaaaaagggtggggtgattaaattaaggatcttaagaggagaggcttatgctggattatgtatccaaaacaatcacatgtatccttctaagagagaaggagagggagtttgagactgaagaggaagaggcaatgtgaccacggagacagagactggaaagatgtagccataagccaaggaaaacctacagccacaaaaagctggaaaaggcaaggaaaagattctaacccagagccttcagagggaacgtggcttggccaacaacttgatttctgacttctaatctctaaaatgttgaaagaataatttttttgttgttttgagacacctattatatggtaatttgtaacagcagccacaagtaactaatacaatggctttctcttgtatttatatttacttataaaaaggtttatcaaactcaaaatttctaacacaattttaaattcctaccatggttagacttctttgatttcaatcagtcaatacacagctatcaattatctgcaagacacttacacatacattagatgcttgaaatacacaataaaacgtctcctactgtgcagtttactaaatacagaaattcatattgaaaattttttaaagtaaagtacagagttcaaacagcaataagtgaaaaaaagtgaaacattatctcgattggcctgttaatcagtgagcacttgttgggctagtctcagtgaaaggcagtttttaaaagactagtacaacctttttccaaattcttcatcttctctttgcaaccattacaaatacataatcacatccacgtgtccttcctaccacttcttttgactagtcccagctttacagacctccatatgacattttattttgcataggcactgtattttttaagcagtgagtagtacaatgtctgccccaaagtatggtaattcaaaatattcaaaaaagcacagctgctgatgctcatggaaagcttccaaaacacattccattaaaagcacatgctatgcctttgaatatttcaaaacaatgttttaaatactacatgccctcaaagtgaatgatgttttttaaaaaacaacattaaaagtctagggaggacctacaccaggcatttactttacttataaacaaaacattagaaatgaatttcttcaaaatccagagataatcctgcactagtcacccaaacagcctttggatagccatccaggatgtcttgcgtacaaaaaaaaagtcacaacttgacgccctgccagaacctgaagtgcagctgggagcagacccttcaaagccctggtaaggtgccaggctctgtaattgtgatttagaaagaaacaagggagagcaaggaatgagaaaaggaagaagatatgtattcaagtggttagcaatcaaccaccaagcactctaaattaaaatgttattctatttttacgattgtactgtctgcctctgcacagcttaattcacacaaaagaatctagaaagtaggacatagtaatgactcaacctcaaatgcttagtgtaaattaccaaagtctctgaaagttgtgatctgaaaggcaaagatgattcttgtccaaattcattttaacatttcttaatgtaaggtctgttacaataacatggggactttccagaagatttatgagcacttagcacctctgtgtgagttgtatattcttctttgctcacagtcccacctttcttctgaaatagaaaaggctacccataatatggctgctaatacacaataaagattatctactgatgcaacagcatatcctgaaaattgttttttaaataaatcctgatttaattttacttctatgagatttatgccgtaatctgaaaagttaaagagaaattgatacttaaaactgagtttaactgatattttactgcagttaacacaaacattctcttcattattttgaatctgtcacaaagcaagtataaaatttttcacagccagaaaaaggagataaataaaagccatcctcaagacacacaggttaatgttaaaaccatatactttaaaaaactgattaaacaaccaatatttattaagtgactgctataccacatttactgaatggtctacttacagtaaaagggttttgagagatataaaaaatatacagaccatcaagtcaagcacacttctcatgaggaaagaagagcctgcccatattcagagtactccatggatattttctaagtacctttaatatgctagacactttgttggatacaggaatacagaaataaataaaagaaaatccttgtcctcaaggagtttatgatggtcagtggaatatacttgttaaccaacaattgctgactgaataaggatgagagaaaatggactatttaaactttctggacttaaaatttttttaccatgtgcacatattacctatacaaagtcataaattcaggaagtttttaaattgtaaaacattaaggaattcaacaaagaggtgacaggaaacacctaaatcaaggaaagagagagaagtgaggcagcctgcttatccgagattagctaagagcctggagagaattcccagtcaggggaaagggtaaatgagagatgcccaggggtccacattcccaccatggatacttgcaatcctagccacagtagaggccctggaccctcacaggccctgaaactaacaaagggaactgcatgaagagtgcacaacagcattgctccagagagggagctcacgctggggcacaccaacctctccactccccatcccagtcctgcagctatagtaagacaccattttgagaactcagtcccaacagactgcaccttgtgcttgggcttaacagcacctgtctcttcacatccctggagtcccactgacatacccagcccacagctaccaccatgcctggttcctgatgctggggccaaagtgcacgcctctggctccaatctcagccactgcttccagcagtggagccaccactcattttcatgtgcccagagtccctcacccacagctgccatcactgtgctaccaggactaaggaataagcaaagcatgagcttccactgcccaggctaaagcacaagccaagcatgagctgccaccaccaggactaaaatgtgagtgaaacacaggctgcaccaccaggactgaaacacaagccaagtatggtctgccaccaccagggctaaaatgcaagtgaaatgcatgttcctaatacttgcctgcatatagctggtatcactgaaagcaactctgccctccccagcagtagggctgcagcacagacactgcctctcacaacatgaacattgtgctgggggcctaaggatcaccccaccccttcctaacacagccagcacctatacgcaccactggggagtctaaagacaagcccacctggcctcacccaccccccatgccagagcacacaatccagaggcctggagatcacacaactcagccaccattggcaactaaggactcttcccaggaacctgagattgggctcacccacccagctactaacatcacagcaagaaaatatcatacctccaaaggaacataataattctccagcaacaaatcccaatcaaaaataaattcacaaaattctggaaaaagaatttaaaatattgattttaaagaagctcagtgagatacaagagaatactgaaaaataacataaagaaatcagaaaaacaattcctagaatatgaatgagaaatttatgaaaaagataggtatcattaaaaaaaaagaatcaaattctggaactgaagacttcactgagtgaaatacaaaatacatttgaaagcttcaacaacagactagatcaagcagaagaaagaatctcagaacctgaagataggtctttcaaataacccaatcagacaaaaggtaaagaataaaaaacagtgagcaaagcctttgtgacatatgggcaccacaaggcaactaaatattctcattttcagagtctcataaggcaaagagaaaataaaatgcatagaaaacctacttaatgaaataacagataaaaacttccgaagtctagcaagggatttaaacatccagatacaagaggctcagagattcccaaatacagtgcagaaaggtcttccacaaagcacgttatagtcaaactgtcaacaatcaaagacaaaaagagaattccaaaaacagcgaaattcatttcacctataacaacacatagactgaaagtaaagggatggaaaaagacattctatgcaaacagaaactaaaagggagcaggagtaggagtagctatacatatatctgttaaaacaggctttaagtcaaaaacagtaaaaagagacaaaggtcatgatataatagtaagaggatcaattcagcaagaggataacaattctaaacatatatgcacccaacacaagagcacccagatatacaaaggaaacattattacacccagaaagaaatccacaaatagccatctaattttgacaaaggcactaaggacatacatttgggaaagaatgtccccttcaataaatggtgctgggaaaactgaatatccatatgcagaaaaattaaattggatccctacctctcacatatacaaaaatcaactcaagatggatcaaagatacaaacgtaagacccaagactataaaattactagaagaaaacatagggaaaacacttcaggacattggtctcagcaaaaatagtatggctaacacttcaaaagcacagaaaacaagaacaaaaatagacaagtgggactatattaaactaaaaagcttcaacacagcaaaggaaacaatcaacagagtgaagaaaaaacccactgaatgggagaaaatatttgcaaaccattcacctgacaagggactaatacctagaatatacaagaaaatcaaaacttaacggtaaaaaaaaaaaagcctcattaaaaagtgggtaaaggccacaaacatttctcaaaagaatacatacaaacgaccaatgggtatatgaaaaaattctcaacatcattaattaccagggaaatgcaaatcaaaaccacagcaacatatcatcttatcccaattagaatggctactataaaaaaataacaacagatgctggcaaggatgtggagaaaaagggaactcttatatgctgctggtaggaatgtaaattagtacagctactatgaaaaacagcacgaagatttctcaaaaaactaaaaatagaactagtatacaatctagtaatcccacaatggggtatttattcaaaggaaaagatatcagcatgtcaaagggatacctggactcaggttattgcagcactattcacaatagcaaagatacagaatcgacataagtgtccattaatggattaactttttcttttttttttttttgagacggagtctcgctctgtagcccaggctggagtgcagtggcgcgatctcagctcactgcaagctctgcctcccaggttcacaccattctcctgcctcagcctcctgagtagctgggactacaggcacccaccaccacgcccagctaattttttttttttttgtatttttagtagagacagggtttcaccgttttagccaggacagtctcaacctcctggcctcgtgatccgcccacctcggcctcccaaagtactgggattacaggcatcagccaccacccctggcctgaactgttttttttaaatgtggtatatatacatggtgaaatactattcagctatgagaaagaatgaaatcatgtcatttgtagcaatatggataaagatggagatcattacaataagtgaaataagccaggcacaaaaagacaaatatcacatgtactcatgtgggagcttaaaaaaagttgatctcatggaggtagagaataaaatgatatcaaaggccaggaagtatgtgtgtgggggaaggtgggataaagggaggttgcttaatgaatacagatatccagttagatagacaatacaagttctaatgtcgcagagcagagtacagttaataattaatttgaatcatatatatttcaaagtagctacaagagaggactttaaatgttcccaacataaatgataaatactcaaggtgatgaataccccaagtaccctgacttgatcattacacattctatgcatgtaacaaatacacatgtacctcataaatatgtaaactatgtgccaatttaaaaagagaggaacttcaaaaaaattataaaatattataacatatttaccagtagtatgaatggacaagggagagaaccctaattctgctagtgaagctgccagggaaaacttcacaaagcagcagctaaaattaacaaagggatgcaaggaagaaacatcaagtgcaaaataatggagattaaggagaagaacattagtggtggagggcagaggagaggagaacaccctggggaggtaaggtagggcctagaaggccacatgcagaagactggaatttattccatggtcttggagagccagtgaaagattttaaacttttagatggatagaagacattacggggtagactcacatttacatttcagaaaaataagtcgtttatttgcagaggatagatttgaggaggaagaatagaagaaagagaaaaagaaaaggagatcaaaggtccaggaaagtaataatgagggccttaactaagacagtagcagcaggtagtcaataatcttgaaaattaatttgaagccaggcgcagtggctcatacctataatcctagcactttaggaggtcaaggcaggcagatgccttgagctcaggagttcaagaacagcctgggcaacatggtgaaagcctgtttctaagaaaaatacaaaaattagcccggtgtggtagcatgtgcctatggtcccagctactcaggtggctgaggtgggaagatcgcttgagcccaggagggtcgaggctgcagtgagccaagatcgcaccactgcactccagcctgggtgacgaggtgagaccctgtctcaaaaaaaaaaaagaaaagaaaagaaaattaatttgggggcagcaagagcaggagttaataattagatacctatacccatcccccagcaaaaagtattttaatgtcactagttaaaaggcctatcaggaaaccaagataggaaagcaaagaataaacactaaaatggaatccagttaaagtgaaagaaaggttgtttcaaagattacaattacttcaagcactaatcctacataagaatgaggaatcctgtacactgacctttggcaaatgaatcttagtaaactgcaaataccatcactgtaaaacactcagaataactaccttttttccatagggatttcataagcagaggggcaaactctaaagctggctctgtcgggaacaaagacataaaataaggattttgttccttaaatgtccacctgctgctactcctcctcattctttccttcaaacaaatcatctctatagcaacacactcttaaagaatttgtgggtggaaagcatatgtttgtgcaaaaatatgagaactcaagaacatgagctattttattttttcctttaatacaagagatacacaatctattaggatacaactaaaaaataagagatatgaaacaaaaaaatgtttatacacaaaaaaatgtaaaaattgtacaaatgataacgcaaatgtttacatggaaattctttttataggttacaatgacaccttgtggtaagacttttcaagttatacaaattatcttagaaaatattttttacagcagagacgtaagaaaaccggtttagaaaataggaaagctcaaaaccatagtaatgagttaatgtgtacaagtataataatacatttgaaaagttaaggttgaaaaatcaaacttttaaaaatgtcacaatattaggtaggcaaaagcactttactaactgtaaatacaagttgaatatcccttatgtaaaatgcctgggaccagaaggatttcagattttgaattttttcagattttagaatatttgcatgtacataatgagtatcttggggatgggacgcaagtctaaacataaaattcatttatgttccatatataccttatacatacacatagcctgaaggtaattttatttttcccttgaaggtgcttaataaactgcgtgttgtatgcctgcattttgactgcaacccatcacatgaggtcaggtttgaaattttccacacggtgtcatgttggtgttcaaaaagtttcagatttcagagcattctggattatgggattagggatcctcaacctgtataaagcattatactagtcccttcacttgaactgaaattattaaatactcttccttattctctggtcccttattcccatcttgtaagaaaagtcaagctgcacctctcaaagcttcatctattactttatctgaatgacactgaaatttgcaccctagttcctaacctctctctgcttatgaatccccctctacttacatgttctctctataacagaagctcaaagatgggatttaagacagactacccaaaatatggcaccttggcatttgagaaaaaagcagaagcaagaaggtttatctcaccttcctctaaagtaggtcataagatcctcaatccagaggtgtcctccctatacctgtaggagagaagacacaaagaggaatctgaacaaacaggacttactaagtttcccccagtttgttactgctagagcatacccatttgtcctctaacgatacttctgcatgactgtccacaaaaaaacagagagacagaccctttgaaaaaagcagtttactgctgcaaatgccacaagacagccaaaaaactccaaagacaaaagacatgaactctcgggagctctatgggcctgtccatcatctgagaaaccccagtacttatcctgccaatgcagggcaagattatatcccccttctactaccgcagctgctcctctcttgaaattgccacttcctgactggaggccaaccaactcaagccatttcagcaactcctaacagaacaactctgttccaacggagaaaacagcagctaattcaactgcctgcaactccctggctaatcagaggtcctgagtctgtccacatgacaacttcaaccgctagcctaaccagcattcactctcctgccacctccactacagcaggtgctggtatccacagctgggagacctgaagacagattatatcacaagacaacttgcagacattcgccagcaccagcctggagcccagtaaccctgctgggtggctagacccagaacggtaataacaatcacctcagtctggctcctaggaagccccatccctaggggaagggggtgactccacatcaaggaatcaccctgtgggacaaaaaaaaaaaatctgaacagcagtccttcagttctagatctttccactgaaacatacaaataaaaaggaaccaggaaagtaattctggtaatatggcaaaacgaagtttgataacacccccaaaagatcacactagctctccagcaatggatccaaaacaagaacaaatctctgaattgccagataaagaatttggaaggttgattattaagctactcaagggggcactagagaaaagtgaaaaacaacttgaacaaataaaaaaaaaaataaaaaacaggatatggatgaaaaagtctccagagaaatatacatcataaaaaaaagacaaccacaacttctggaaattaaatacacacttagagaaatgcaaaatgcactgaaaagttccaacaacagaactgaacaagtagaagaattttagagcccaaagacagggctctcgaattaacccaatctgacaaagacaaagaaaaaataattttggctgggagcagtggctcagcttataatcccagcacctcaggaggctgaggcaggtggaccacaaggtcaggagatcaagaccatcctggctaacatggtgaaatcccatctccactaaaaatacaaaaattagccaggcacagtggcgtgcacctgtagtcccagctactcgggaggctgaggcaggagaatcacttgaacccggaggaggttgcagtgagccaagatcacgccattgcactccagcctgggcaacagggggagactccatctcaaaaaaaaaaaaaagaaagaaggaaagaaaaagaaaagaaaagagaagaaaaaattattttagaaaatgaataaagcctccaagaaacttgggacgttaaaagacccaacataagaataattgctgtccctaaggaagaagagaaatccaaaagtttaggaaactatttgagggaataattgaggaaaacttccccggttttgatagatatctagacatccaaatacaagcagcttggccaggcgtggtggctcatgcctgtaatccagcacttcgggaggccaaggcaggaggatcactcaaggtcaggagtttgagaccagcctggccaaaatggtgaaaccccaactaaactaaaaaaaaaaaaaaattacctaggcatggtggtgtgggcctgtagtcccagctactaggaggctgaggcaggacaatcacctgaacctggcaggtggaggctgcaatgagccaagatcgtgccactgcactccagcctgggcaacagggcaagacttggtctaaaacacatacacacacacaaacaaatacaagaagctcaaagaacacccaggaaattcatcacaaaaagatcacctaggcacacagtcatcaggttatctaaagtcaagacaaagaaaagaatcttaacagctgtgaggcaaaagcattaggtaacctacaaaggaaaacctaacagattaacagcagatttctcagcagaaaccctacaagctagaaggaattgggtcctatcttcagtctctttaaacaaaaaattatcagccaataattccatatctagcaaaactaaattttataatgaaagagcaatagagtctttttcatacaaacgaatgctcagagaattcaccactgccaagccagcactacaagaactgctaaaaggagttctgactcttgaaacaatctcaaaacatcaaaatagaacctttcttaaagcataaatctcacaagacctacagaacaataacacaatgcaaacaaaaaaaggtaattaggcagcaactagtatgatgaataaaatagtatctcacatctcaatactgatgttgaatgtaaattgcctaaatgttccactgaaaagatacagaggccagcacagtggctcacacctgtaatcccagcactttgggaggccaaggtgggcagatcacctgaggtcaggagttcaagaccagcctggccaacacggcaaaagcccatctctactaaaaatacaaaaaaattacccaggcatggtggcaggtgcctgtaaacccagctactcgggaggcagaggcacgagaatcgcttgaacccagggagcagaggttgcagtgagccgagatcatgtcattgcactctagcctgggtgactgagtgagactgtcccaattaaaaaaaagaaaaaaaaaaaagatgcagaacagcagaatggataaaaatctaccaagtatctgctgccttcaagagactcacctaatacataaggactcatataaacttataaggtaaaggggtggaaaaagatattccacgcaaatggaaaccaaacgtgagcaggaacagctattcttatatcagacaaaacaaactttaaagcaacatcagtttaaaaaggcaaagatagacattatataatgataaaaggattagtccaacaggaaaatatcacaatcccaaaaacatatgcacctaacactggagctccgaaatttataaaacaattactactagacctaagaaatgagatacatggcaacaaaacagtgagagacttcaatactccactaacagcactagacaagtcattaagacagaaagtcaacaaggaaacaacagactataccctaaaacaaatggacttaacagatatttacagaacattctacccaacaattgcagaatatattcttttcatcaacacatggaacattctccaagatagaccacaaaacaagtctcaataaatttaagaaaatcaaaattatatcaaatattctctaagatcacagcagaataaaactagaaattaactccaaaggaagcttcaaaactatacaaatatatggaaatttaaacctgctcctgaatgacctctgggtcaacaatgaaatcaagatggaaattttaaaattctttgaactgaacgataacagtgacacaacctatcaaccctctgcaatacagcaaaaacagtggtgctaagaggaaagttcatagcaatcactgtctacaacaaaaattctgaaaaagcacaaatagattatctaacctcacaactcacagaattagagaaacaagaacagaccaaaccaaaacccagcagaagaaaagaaataacaaagatcagaactaaatgaaattgaaacacaacaacaagaacaacaacaaaatacaaaagataaattagacaaaaagctggctctttgaaaagacaaaatcgacagaccattagcgagattatcaagagaagagagtagatccaaacagctcaattagaaacaaaataggagatatcaaaagtgataccacagaaatacaaaagattgtgcttttgtatggctactatgaacatctttatgcacacaaactagaaaacctagaggagatggataaattcctgaaaagatacaaccctcctagattaaactaggaagaaatagaaacaaactgaacaggtcaataacaagtagcaagattgaaacagtaataaacaaaaaaaatgccaacaaaaaaaaaaaaagtccaggacctgatggattcacagctgaattctatcagacattcaaagaagaattggtatgaatcctactgaagctattccaaaacacagaaaaagagggaatcctccctaaatcattctatgaagccagtattatcctaatagcaaaaccaggaaaggacataacaaaaaaagaaaaccacacaccaatatccctgatgaacatagatgcaaaaatcctcaacaaaatactagctaaccaagtccaacagcatgtcaaaaagaaaatacaccatgaacaagtgggttttataccagggatgcagggttggcttaacaaatggaagtcaataaatgtaatacaccatataaacagaattaaaaacaaaaaccacatcatctcaacagacgcagaaaaagcatgacaaaattcagatccctttatgattaaaaccgtctgcaacatcggcatagaagggacataccttaagataataaaagccctctatgacaaacccacagccaacattacactgaacagagaaaagtttaaagcattccccctgagaactagaacaagacaaggatgtccactttcaccacttctattcaacacactactggaagtcctagccagaacaatcagacaagagaaagaaatcaagagcatccaaagtggtaaagatgaagtcaaagtgttgcagtttgctgatgatatgatcatatacctagaaaaccctaaaaactcatccaaaaagctcctataactggtaaatgaattcggcaaagttttaggatacaaaattgatgtacacagatgagtagctctgctgtataccaacagccaccaagctgagaaccaaatcaagaactcaaccccttttacaatagctgcaaaaaataaaataaaatacttaggaatatacctaaccaaggaggcgaaaagacctctacaaggaaaactacaaaaaaaaaaagctgaaagaaatcacagatgacacaaatggaaatatatcccatgcgcatggatgggtagaatcaatattgtgaaaatgaccatactgccaagagcaatctacaaattcaatgcaattcccatcaaaataccaccatcgttcttcacagatctagaaaaaaaatcctaaaattcatatgaaaccaaaaaagggcctgcaaagcaatactaagcacaaagaacagatctggaggtatcacattacccaacttcaaactataccaaggctatagttaccaaaacagcatggtactggcataaaaacaggcacatagatcaatggaacagaacagagaacccagaaacaaagccaagtacttacagccaactgatatttgacaaagcaaacaaaaacataaagtagagaaacgacaacctattcaacaaatggtgctgggacaattgacaagccacatgtaaaagaatgaaagtggaatctcaactctcaccttacacaaaaatcaactcaagatggattaaagacttaaatctaagacctgaaaccataaaaattctagaaaataatatcagaaaaactcttctagacattggcttaggcaaagagttcacgaccaagaaccaaatgcaacaaaaatgaaataaatggatgggacttaatgaaactaaaaagcttctgcacagcaaaagaaataatcagcagagtgaacaggcaacccacagagtgggagaaaatattcacaaactatgcatcccacaaaggactaatatccagaatctacgaggaactcaaacaaatctgcaagaaaaaaaccaaatattcccatcaaaaattagggaaaggacatgaatagacaattctcaaaagatatacaaatggccaacagacatatgaaaaaatgttcaacatcactatcagggaaatgcaaatcaaaaccacaatgcactaccaccttactcctgcaagaatggccataatttaaaaatcaaaaaataatagatggtgacaaggatgtagtgaaaagggaacacttttacactgctggtgggaaggtaaactagtacaaccactatagaaaacagtgtggagattccttaacgaatgaaaagtaggctgggcgttgtggctcacgcctgtaatcccagcactttgggaggccgaggcgggtggatcacaaggccaggagatcaagaccatcttgactaacatggtaaaaccccgtctctactaaaaatacaaaaaattagctgggtgtggtggtgggcacctgtagccccagctactcgggaggctgaggcaggagaatggtgtgaacccaggaggcagagcttgcagtgagccgagatcgcaccactgcactccagcctgggcgacagagcgagactccgtctcaaaaaaaaaaaaaaaaaaaaaaactaaaagtagaactaccatttgatccagcaatctcactattgggtatctacccagaggaaaagaagtcattatatgaaaaagacacttgaacatgcatgtttatagcagcacatttgcaactgcaaaaatatggaaccagactaaatgcccatcaaccaatgagtagataaagaaaatgtggtaggtatatatatatataatgcaatactactcagccataaaaaggaatgaaataatggcattcacagcaactgagatggcattggaggccattattcacagcaaccgagatggaattggaggccattattctaactgaagtaactcaggaatggaaaaccaaacaccgtatcttctcacaagtggaagctaagctatgagaatgcaaaggcataagactgatataatggactctggggacctggggggaaggagggaggggggtgagggttaaaagactacacaccgggtgcagtgtacactgctcaagtgatgggtgcaggaaaatctcagaaatcaccactaaataagttatccatgtaaccaaacaccacctgttcccccaaaactattgaaataatgattttttttttagaaaaaacacggaaagaaaggtttccctgtttctttcagtcttcacttctgaagactcatataaagtaaaggtttcattaaataaatgtgtatgctttcctcttgataatctgtcttttgttataggggtctcagtcatgaatctagtaataggtgaggaaaagttatcacattttatccgctacatcaacttaacaaaaattcagttcattaggttcaaattttctacttgtctccttaaaaaagtcagttaccactatcctcctctcatttcctaaccactacccatcctctatcctctatttataacaaattaatcctactgattcttcttcatctgtttgttgaatttaatcattcttccccatttctagagccatcacactccagtgccgaatcttaaatattttacacttaacagaagcctcctagacagtgtcccagactttagtattttctcattcttacatagcctacaaatatcaccaaaacaatctttctcatacattgccttcgtcactataactcctatgataatccttattctttcctgactcaaatctaaatttcccagctaaactcacagccccgtattagccagctccctatacaaattcaaacattttgctgccccacaggacccctttgctagagtcaattaagtttacagacccccaggacccctttgctagagtcaattaagtttacagaccctcaaacacatttctctttgccttcacaactttgttcatacagttatgccaaattaaaataccttcttaaaccttgtctattaatccacaaatcacagagtcaaacctgaaaccctacagtctgcaaaatcacaaaactattttcggagttttagttgctctaaaagtgaacagaaagagtagcttttgtccatgtgctttataggttcctgccttccttgtgcttgccccaggatatttattctatataaacatatatttttttgagacagaacctcaccctgtcacccaggctagagtacaatggcgcaatctcagctcactgcaacctccgtcccgcgggttcaagtgattctcctgcctcagcctcccgagtggctgggattacaggcatgcaccacgcccggctattttttgtatttttagagatagggtttcaccatgttggcaaggctggtctcgaactcctgacttcaagtgatccacccaccttggcctcgcaaagtgctgggattacaggcatgagccactgtgcccggcctaatttattctatattctataatgtctgcacttttcccctccagatgctttataactatataaactacgttttccaaagaaactataaattcctcaaaggaaaaactacatataatcttctactgttttgttcatcttcatagttcccaattccagtaaactgttaatgacagtaaagtgatccacaaaatttctatgatgtgaatcctactctcccataggcttgtaatgtaatttcagagaaaccttggggaaggatgtcaccaagaacactgtttgctaaccaattatgcatgcgttatagttagttatcaagaaatttctacctcaggccgggcgtggtggctcacgcccgtaattccagtactttgggagaccgaggtgggcagatcacctgaggtcagaaattcaagatcagcctggccaacgtggtgaaaccctttctcaactaaagatacaaaaattagccaggcatggtggcaagcacctgtaatcccagtactcaggaggctgagagaggataatcacttgaacgtgggatgcagaggttccagtgagccgagatcaggccattgtactccagcctgggcaacaagaacaaaactccaactccgaaaagaaaagaaaagaaatttctacctcaaaagttaaaaattctggaggacagtctactaagcaaaagctttcaaaatgaatatatcttttcatttagtaattctaattttaggaattaatcctgagaaactaattagagatgcacaaacatttatgttcaagaatcttcttttatttgtcattcagtaaatgtttactgagtgcatcctaaattccaggtaggaatggaggatagaatcagttcttatcctcatggtactaacttaatagtggtgtttacaatggaaaaagagactattaaaaaagcaggtcatggccaggtgtggtggctcatgcccgtaatctcagcattttgggaggtcgaggtgggaggctcacttcaccccaggagttcaagatcagcctgggcaacatagtgagactctatatctattttataattgtttttaaaaagcaggttacaatagcaagaaatgccatatttgtggatcagaaaattcaatattgttaagatgttaatttctcccaaattcaatgcagtgtcattcaaaataccaagttttcatagaaattaacaagctgattctaaaattcatatggaaacacaagggacccagaagagccaaaaaaaaaactttgaaaaagaacaaagttagaagacttgcattacctgacttcacttattaaagtgccatagaaatgaaaactatgtagtattaaatcagtcacaaaaatccattaaacaaaaaagactgtccagaaatagagtcaaatagaaacagtcaattgatttctgacaaaaatgcagtcaattcagtgaagaaaggatagtcttttcaacaaatggtcctggaacaattgccttttccatacacacacacacacacacacaaagaacttcaagttgctccccacgccatatacaaaaataggatcaaaataaatcagaggcctgaattaaaaacctaaactataaacctcctaaaaaaaaatacaggagaaaatcattttgatcttgggttaagacttctcagatataacaccaaaagcacagtccataaaagaaaaaactgacaaactggatttcatcaaaatgaagaacttcaaaatccactactcttcaaaatccactgttacataaatgacaagatataccagactcaggggaaaaactgcaaatcataaatcttataaagcacttgcatccagaataaagaactctcaaaactaaatgataggaaaataaacaatcaaaatttttttaatgggcaaaacattcaaatggacacttcaccaaaaaagattaagtaaacatttgtttgtattttccaagtactccagtttcctcttctcatatcctaaagatgtgcacattagattcactgggagattgaaattgtcccagtaggaatgagtatgggtgtgtatttaagtgcaccacgcaatggaatgtcatcctgtccagggttggttctgtgccaggataggctctagccaccagaaagcctgaaccctagagcaggctggaaaatgaatgaatgaatgaatacaaattattgtaaaatgaaatttcaaataaagtatataatcatgtaaatgcatgacaatactatgtagtacaaaagcactcttatcaagcctgccatatttgtgattatttttgaactgcatgatagtaagaggtgtcccttatattttttgctttgcaaacatttatttcttgggttaacccaccaccactatgaccattgtcactcactggttcaccaaaaattaggtaagtaactatcttacttgttttttttactaatctttcttaaacattatagctcacatttatttcaacgtttaatgttggaagtgtcttgggtctttatttagaagtttgatgatgttttttgaccagagatatgccataggaatttaactattgtttttatcaattagtctagggtaaagttggtttcatgatacatcatttcacttaaagtcagtttccaagaacctatcaataatgttaagtgacggccgggcgtggtggctcatgcctgtaatcccagcactttgggagggcaaggcaggcagatcatgaggtcaggagatcgagaccatcctggccaacagggtgaaaccccatctctactaaaattacaaaaattagccgggtgtggtggtgcgcacctatagtcccagctacttggaaggctgaggcaagagaatcgcttgaacctgagaggtggaagctgcactaagctgagatcatgccactgcactccaccctggcaagagagcaagaccccacctcaaagaaaaagaaaaataaaaaataatgttaagtgacgacatactgtacacgaaatatgcagtgggagttctagaaggtcagtaaagagagaaagaggcagaaaagaagttttgaagaaataatcgccaaaaacttccctaatttaatgaaaaacattaattgacacatctaaacagcccaacaaatccaaagaaacctgcaaatgctgaaacacaaagaggaaatctttaaaaaggagcgagagaaaaatgacttcacatacagggcaacaacaatattattaacgttgatttctcatcagaaatgacatggaaaaaacaaatttttttaaagaaacacaaaaaactcaccactaaaaattctatattcagcaaaactgcccttcaaaaatgaagatgaaataaagacattttcagatagataaccaaagacgaagacaagtcgctgctgtgagacatgccttatgagaaataacaatggaagtccctcaggataaaaggaagtcacaccataaagtttaatctaggctgggcacagtggctcatgcctgtaatcccagcactttgagaggccaaggtgggtggctcacttgagcccagaagttcgagaccagcctgggcaacatggcaaaaccccatctctacaaaaaatagccaggtgtggtggcacgtgcctgtagttccagctacttgagaggctgaggcaggaggattgcttgaactgggtaagcggtggctgcagtgagccaagatcgcactattgcactccagcctggaaaacaggagaacctgtctggaaaaaaaagaaaaataatactctacaggagaatgaagctcattggaaactgtaattacatcagtaaatattaaagactctaaaaatataattattttcacttcatctcgtttaaagacataagactacataaaggaataattatagtactgtgtcgctgagtttgtaatacatacagctgtaatatatataataataatagcaccaaaaagagaaaaaacagataacactggaggaaagtttctataatttatcagaatttagtattattctgaaggagactgtaattaagttaaaaggcatattgtaatccctaacaatatagcaaaagaaatcaacagaaataaaaagatacactaaagaatatttaacacagaaagatggtaaagaaaagaggaaaaagcaaaaaacaaatgagacaaatagaaaacaaatatgaaaaatgcagatgtaaatccaataatatcaacaattacattacatgtgaatgaactaaacactctattcaaaggggggattatattacaatggattacaaaacctaactataggctgtcaacaagagataaatcttcaattcaaagacataaacaggttaaaattaaaaggatttttttaaaaaaatacaccatagaaacagtaaccacaaaaaaaactagagtggctatagtaccaagaaaaatagattttaagataagaaatattacagacaaaggaggccatttcataatgaaaacagggtcactatatcaggaagatataacaataactgtccatctaaccaaagaaccccaaaatacatgaagcaaaaaaagagataattaaaaagagaaataggtaattcaacagaaacagctgaagactgcaatgactgatagaaaaagacagaaaatctgcaaggatatagaagtcttgactaacctcatcaataaacttgacataactgacagaaaataccacccaatgattgcagaatatacaacctttttacaaacacaaggaaaattttccaggatacaccacatactggggcacaagacaagtctcaataaaatttaaaagattgaactcataaaaaatgtgtgatctgatcacaatggaattagtcatccgaacaaaaataaatctaggaacacctcaattattggtaaattttaaaacatacctctaaataacccattgatcaaagaagaaattgcaaggaaaaattttaaaatatatttcgaattgaatgaaaacaaaacacagcaaaccaaaatgtacagaatgcaactaaagcagtgcttagaaggaaatgtatagttttaaacatttatatgagaaaagaaaaaaggtctcaaaccaataatctaagcttccatcttaggaaactagaaaaataaggagcagaggggatattaaacccaaaacaagcagaaaaataataattttgtagtgtggaaatcagtgaaatagaaaatatagatatgaaaaataatcagtgaaataaaaggttggttctttggaaagatcaacaaaatcgaaaaaaaaaaaaaaacttcactatactgaccaagaaaataagagatacaaattaccaaaatcaagaatgaaagagggaaaattattgccaaccttaaattattaaaggatttcttaatacaaacttcgtatcaacaaattagataatttatatgaaatggactacacttcctagaacatacaaattaccaaaactctagaagaaagagaaaatctgaatagacctataacaagaagtgaagaaactgaaccaataattttaaatattcccacaaagaaatggccaggcccccacaactgcactaatgaatgctatcaaacatttaaagcagtaagagcaagatcacgagcaaccaacagactaatatccctcaggaacatatacccaaaattccttaataataatcagacaaaccatattcaacaacatataacagagattatacagcacggactgggcatggtggcttaagcctgtagtcccagcactttgggaggccacgcaggtaaatcgcttgagccaaggagttcaagaacagcccaggcaacatggcaaaaccctgtctctacaaaaaataccgaaaaaaaaaaaaaaagaaaaatagccaggtgtggtggcatgagcctgtagccccagccacttgggaggcggaagccggagaatcgcatgagcccaggagtttgaggctgcagtgagccaaaatcacaccactgcacttcagcctgggtcacagagcaagagtctgtctcaaacaataaaaaaaaaaaaaaaaaaaaaaaaaaaaagattttacagcatgaccaagtgtgatctgtcccaggaatacagggtgggtttaatctccaacaatcaattaatatatagcatactaacaataaaaatcatataaccatatcatcagatgcaggaaaaaacatgacaaaatctaacacccactcatgattaaaaacttgcaacaaactaggaacataagggagcttccttaaccttcttcaaagggcatctatagaaaatctacagctaacattatacctgatggcaaaaatctgcatgttttccccctaagactgggagtaatgcaatgcacattcaacacttctcttcaacatcttactggagggtctaacccaagaattaaagcaaaaatgaagaaataaataacattgagattggaaagaaaaagtatcgttttgagacatgatcatctatgtacaaacaatatgcaaaaattggttgcatttttttttagacagattctcgctctgtcttctaggctggagtgcagtggcacaatctcagctcactgcaagctccgcctcccgggttcacgccattctcctgcctcagcctcccgagtagctgggactacaggtgcccgccaccactcccagctaacttttttgtatttttagtagagacggggtttcaccgtgttagccaagatggtctcgatctcctgacctcgtgatccacctgccttggatcccaaagtgctgggattacaggcgtgagccaccaagcctggacgattgcatttttttgtgctaacaatgaacaatttgaaatcaaatcatgaaaactccatttccaagagcatcaaaattataacagtcttaggaataaatttaaccaaataagtgcacgatttgtacactgaaaagtaaaaaacattattaagagaaatgaaagatctaagtaaatggagagatattacatgttcatggattggaagactcaagatggttaagttagtgattcttcccatattgatggatagattcaatgcaaatcctacaaacatcagatgtgtttttgtagaaattaacaagctgatcctaaattgtatatggaaatggaaagagcatagaaccaattttgaaaaagaagaaaatgttacactacttattttgaaacttactataaaactgcagtaatcaagacagaatagtgttggagtaaggataggtttatagacatgagtcttggaataaattcttacattatagtcaactgatattttacaaagatgccaatacaattgaagggaaaagaacagtctttttaacaaatggtactggataatttggcattcacatttttaaaaaatgaacttagatcctcttcttacatcaaatgcacggttaattcaatatgaatcttatatttaaaggaaagagctcaaagaagacctttgggagctcaaagaaaaatctttgggaccttggattaggcaaaaagttcgtatacataacatgaaagtacgtgccacacacacaaaagaaatgacttcattaaaaacttttgcacttcaaaagacaacagtaaaaatatgaaaagccaagacaccaactgggagaaatatttgcaaatcttatctctgatattaaaaacaatacaaactttcatccagcatatataaagaactcttacaactcagtaagaccaaaaaaaaaaaaaaaaaaacccagctaaaaaatgggcaaatgccttaaacagatattccaccaaatggccaataaccacagaaaaaggtgtccaacattactgtgcagggaaatgcaaattaaaattacaatgggatactactagatactaactagaatggctataattaaaaagataataccaactgttggtgaggatgtggagaaactggaatcatcatacattgctggtaggatgtaattggtacagctactttggaaaacattttgacagtttctttaaaagttaaaaataagcttaccatataattcaacaattccactcctaggaatttacccaaaacaaatgaatacatatgctcacacaaggaattacagacaaatcttcatagcagcattattcataacagccaaaaactggaaaccatccaatgtctatcacctagtgaatgggaaatactattcactggttaccagtaaatgggaaatactattcaccaatactattcaactggtgaatggaaaatacacacgaatactatgcaacaattaaaaagaacaaaacattgatatacatacattaaataaacctcaaaagcatgaagttaaagaagccagatgcaaaagactactgtattgattccatttatatgaaatatgtagaaaagacaaatttatagtgatagaaagtagatcagtggttctctggggctgtgggaaggagttaccttaaatgcaaataagcttgagagaatctaggagactgataaaatgtcagaaattgccttgtgatgacagtcgcacaactctataaagttgctaaaaaccattaaattgtacacttacaatgagtggtttttatggtaggtaaaatatatctcaataaagctgtttaaaaagggctaggtagaagaaagaagttatctcttccaaactttggaaaatttgttgatagttgtagtaatcaaggctgagttcaaaggatgaccaagcaaaaagaatccaggttcttaaagattatcactaagccacttaattgacaatcttagaaccacctatctccagacttcttacatgtgagataatacaatttccttcttaaggctttaaaaaagaaaaagaaaaaagaataacgttgctaattctaagggacacaggacatgttcattccattacagaaaatttgtaatatcatccatagaggaagatatcaaagaaaaggcaggaattttggtggatcttgaaggatgaaagaatatgacgggggatggggaaggaaaagaagggtatgtagttcagaagagtcattaataatggcaaggataaaaatcaacaatgcccactaaaagtcaagtttacagcttaccttattttaatccatacattaaggaccaaaaaattaagtaactggttcaaaaagttacgcagctagtaatctaaccttcactctcaggatccaggctccaaagtacatactctttcctctgttacgctgctaaacaaggacttaaactacccccatttgcaagttcagatctttgtagagggcatctttatttagataggtttacatttataggactacacactcaatgtttcttgagcaacaatttccatttaatcaataaactaaatgtgatgtgcattctttctttggtttccaaaacgttaccctactctggttttcctaccttctttctcccccttcctattacatgctggtgttcacaagctctcttctgattctacacaactctcactaggaacctcatctatacctggtatttcaactaccactaacgttgatgactcttctctctctccaacttcaagaattgttttcctagttttctttgactaacttcctccgggccaagttgaatactgctctgtacaccctacaactacacttacaagattctaaagagacattcctcaatttttgtgtattctttctagttctaggccaggtattcttcctacatgccccaaaacacattcttatctatccttatagcatttaacatgctttattacaaattactaattactttgtccatttctcccatcagagaataaggtgcttgagacttagcactatgtcttattcacaatctccccagtgcctagcatagcatgagacacataataggcactcaaatattgattaaacccatatataagagaaataaaatttgctttaaattggaagcataccatttctgaaggaaactttcagagatttatgttttcaaatgagaaaataggccatgaaaggtgaagtgactcacccagtcaagccttggtctcctgaatcacaattctcttcccacaaaattacagtgcctaggccgggcgcagtggctcacacctgtaatcccagcactttgggaggccaaggcaggtgggtcataaggtcaggagatcaagaccatcctggctaacatagtgaaattccgtctctcttaaaaatcaaaaaattagctgggcatggttgcatgtgcctgtagtcccagctacttgggaggctaaggcaggagaatcgcttgaacccaggaggcagaggttgcagtgagctgagatcacaccactgcactctagcctgctgacagagtaagactatgtctcaaaaaaaaaaaaaaaaattagagtacctattaaattgtgcttagtgatctcagctttctatgaagctctagaagtaatacaaaaatgttataaagaaccatttcaacttcatccactccagctctggctggctatatcagttgtagagaagtctgttattacataatactttttctgcccagaataatctttaattgaaccagtattttcacgtgtccttcacacaaaaaataattcaatacatacttattgagacatgaagccagctgggattctgggtccggtgtggacttggagaacttttctgtctagctaaaggattgcaaatgcaccaatcagcgctctgtgtctaactaaaggtttgtaaacgcaccaatcagcactctgtaaaaacggaccaatcagcactctgtaaaatggaccaatcagctctctgtaaaatggaccaattagcaggatgtgggtggggccaaataagggaagaagagctaggcacctgagccagcagcagcaacccacacgggtccccttccatgccgtggaagctctgttcttttgctcttcgcaataaatcttgctgctgctcactctttgggtccacactgcctttatgagctgtaacactcaccacgaaggtccgcagcttcactcctgaagccagcgagaccacgaacccaccgggaggaatgaacaatgccggacgcgccacctttaagagctgtaacactcactgcgaaagtctgcagcttcactcctgaagccagcaataccacgaacccaccgggaggaatgaacaactccggacgcgccacctttaagagctgtagcactcactgcaaaagtctgcagcctcactcctgaagtcagcaagaccatgaacccaccagaaggaagaaactccggacacatctgaacatctgaaggaacaaactccggacacaccatctttaagaactgcaacattcaccacgagggtccgcagcttcattcttgaagtcagcgagaccaagaacccaccagaatgaaccaattccggacacattatcatgcatctctatgtggaaaacaatgtgaaagaagttataattcatcagtactctaaaaaatatccttaagagcatatattgcatgccccttaagtttaacaatatctgaaatagctgccttaaaacaaaatgcaatcacacttgagagaggctgaatatgaacatcagagataggcaatgcaacttcatcaggaaaatccctatagtccaatgctactgttttcaagggttgctatattatactgcaattgtgttactgggcaacaactcagaagctagaatggcaaattcactcaagaagtaactgaatcaaacgaatatttatgaaagcattctgagactcaacttcactttctatatcttcaactgaagtaactctttgttataagcattagatacaggatttttggtgagactgtaaaaactacatggacattttatagacatattttgagacagaagataggtgctttccaaaagggaatggccaggtttaggttcctactaactctgaattttaatccaaaagcaatctgaagtcacaatatacagaaggcaaataactgggcatttccttaatttcttccatcctggattatagctcagttaaaagaaatagtaggccgggcgcattggctcacacctacaatcccagcactttgggaggccaaggtgggtgaatcacttgaggccaggagttccgagaccagcctggccaatgtggtgaaaccctgtctctattcaaaatacaaaaaaaaagccaggtgtggtggcatgcacctgttagccccagccacttgggaggctgaggcaggagaatcacgtgaacccacgagttcaaggttgcagtgaacaaagattgcaccactacgctccagcctgggcgacagagcaaaactccatctcaaaaaaaaaaaaaagaaaaaagaaatagtactagacttgacagtcagtgatctctccatgacctagagagggcagtcctgatgaaaaaaatataattaataaactgatattctactaggaaccaggaaattgaccaaactccccaagcccactgaagaatagtgccagcattcctgagagtccttactgctggtattgccatgggaaattctcaaatactcactttctaggaacagaatctttatttctgattccgtgaattcccactcttcaatcttttttatagtttactgttgccatttccccttcacttactctcttctctcaacaaccttactttcatgatacttacaaaagtgggggaaagtagaaatgcctatctgtcattgtattagtccattttcatattgctataaagaactgcctgagattgggtaatttataaaggaaagaggtttaattgattcacagttccacatggctggagaggcgtcagaaaacttacaatcatggcagaaggtgaaggggaagcaaggcaccttcttcacaaggtagcaggaaggagaatgaatgcaggaggaactaccaaacacttataaaaccaccagatctcatgagaactcactgtcacgaggaacagtatgggggaaaccgccgccatgatccaattccctccacctggtctcttccctgacacatggggattatggggattataattcaaggtgagatttgggtggggacacaaagcctaatcatatcagtcatctttaagaaacatttattcagcaacttgtatttggaaaagactaaggatacagctcatcgagatctgaagtcctgcccttaataagcttacaatctagttaggaagtcaagaaagctaaaataatacaataaaaagtataagtatcaaataaatttaactcacaaatacatactattcctatgtatgtatgtatgaggtcatggtggagttgaaccttatagaaaaggtacaatttagattttaagaaagaagggaataagatcaggtcacgggggatagaaagatatgcagactaatatggaaaggataaagtacagagcaggtttaggggatagtgaagaaaccaatctgggcagagacaccttttccataaagaacatacacttgaaaaggcaaggtgagaggatttcaaataattcaccttaagtcaagaaacatgaacttgggttaaaaggaagttttttacacagatttacacacattccctaaaagcacataggttaaacaatgtgggcaatttacttatggaacctaatatgtatgacaaaattaaaagcaagctcatctacttttaggcaaagagacagtacctgggggtggggaaattctgacaattcactaaaattcactaatctttctgttaagatttcactctaagcttcttgaattagaacatcccatgacataatgctgatttctgattactaaggattatacgagtcattcttgatttgtctcctccatcttgcccaacttttgaatatttcattacttcaacatcagcatatagaaaaaaggaggagagaactaaaattaagtccatggattttagcaatacataagggtatctgacataaagaacattaaacttcaagttccaattcccattattaatagatttcaaagaagtcatttagtctcatcatgtctcaaattttctcacatacttgcttacttgaaaggttattgattgaaaagatcattcaaaaagtgctctaaaaactaacaacttgccataaaaattttatcattaagggttcaataagaggagacagtgaggtgactggtaaaccaaggattaaaaactacctgtgaataggccaggcacgctggctcacacctgtaatcccagcactttgggaggtcaaggtgggcagatcgcctgaagtcaggagttcgtgaccagcctgggcaatatggtgaaaccccatctctactaaaaatacaaaaattagcagggcatggtggcatgcacctgtaaccccagctactcgggaggctgagaggagagaatcacttgaaactgggaggcggaagttgcagtgagctgagatcccaccactgcactccagcctgagcgacaagaatgaaactctgtctcaaaaaaagaaaaaaaaaaaaactacctgtgaataatcagtgtttcattctcccagtgctgcatggaattctaaattgtatttcactattatttgagaatgttctaaatacagtccgcgcacttcatctgatctggaaagaaaacactcaaagtaaggggaatacccagcatactctgtcctaaataaccaaaggacaactcaaaaccatttgcaactctcaggagagtcctgtgtgacacttataatttaaagcattctggcctggtgcggtggctcacacctgtaatcccagcactttgggaggccgaggtgggcggatcacctgaggtcgggagtttgagaccagcctggccaacatggtgaaaccccatctctactaaaataaaaaaattagccgggcatggtggcacgcacctgtaatcccagctactcgggaggctgaggcaggagaatcgcttgaacccaggaggcggaggttgcagtgagccgagatcgcgctactgcactccagcctgggcgacagagtgagactcagtcataaataaataaataaagcattctaacaattctgaacaaactgagtttgaaatcaaacctcaatacaaaaggtgagtattaattctaaccacttacaggctaaattcataaatatggaaaattctaaatccaggtaactgtaggatagatacctttaattgtgttttagttaaatgtcagacttgtttacagacatgttgcttggtaacagaagcactgctttaacaacccactctgttttagagctgcttaaagtctgaacagattatgaagtatatatcatatacacgaaattcagacaagtctttccttatcctagagatctgtaagatttgaaagagcttcctcatttcagctaactaaaggctttacaaatacttagcagtggatattcttaagagcaaaatgcccattgattatggtcaaaagttggacactgaggattaaccaaagtatttaaacccagcatatgctaacatattttaggtgtttatctcagtaatgacagtcgacatcactgttcattcaaattgtcttcaaagccaaggaaaatggtagcatagctttttcatcgtaaattaagctggaggtacttaaacgtctggccaattaccaaactggctacacaaccaccaagccagagtgcatccaaaagctccatgaagagtttcacgtgcgtctctctgcctacttttctagcacgagcttccactactttaacaggaaaataaaaaaaggattcaagggcagtttgtggagggacaaaatgagtattccaaaatacaaacaagacaccgtccccagaaagagaggttacataccagacgcacgcacgctccttgcaacccgcacacggaaaacttaagtgaccgcagttctggccgcgctcgccaccggggacacctccacagctccaaccacaggcacccactcaactccgcttacggaggcattgggactaagggttacggtcctacagcggggtgtcggcccagcgagaggaagagggccgaacggacccctcgggctcccgtccctagggaaatgtgaagtatcccgggagaggtccgagggcggcggcggcggcggtgaaaagccccactcctccgcgtggaccgggatcctcaggggtgcggcgccaccccacgtgctgacgtatggcccagaagccgcctcatcgcaccgccccaccagcctggaggagcgggctctgtcccttggcccagcggcacgcgaagcaggaagtcccaccccccacgccgacgtcacccacgccaccgacgccggttgctgccggagccgttagagggaggagacaaacgaaccgaggcgggagcggccacgggtgacagcggcagcggcggggccgggctgcgctcccgaaggcgttcctggagggccctgggatggactcagagatccccagagccccaggggacggaaaatctagccccgggcacttgccttggagtctgagtgatgcgcgtcgttggagcgcgaagccggtctccctagcctccgcccgacacagcgtctccaggggttttcctccttttcgcgcctctccttccctcttccccacaccatttgagagcctcaaatggtagtcctgccgccacctctctcccttcgccagcctgccatcgtccccatgggtgcagatatgcgctcccgaagccgcctgcctgccgcgtctgcctcgggcatcagcccacgagtggggagtcggctcagcttgccacgagggaacctcgggttaggaccaatcgcccgggagagagccctcctcgcccccgcacctcctgctccaagtctcctgtcctggttatcccaagttcagggcccacctggggtcacatggggaactacttgtcttaaggctgtaaacaatagttggaagaggagttgctagcttttgagaacttccatgatcatccaaagtctgaaacaaagtaggcggtcagcctttcaaaatacgtgttggaagaaacagacaccttcccatccccagcgtttgttcagtgccttggttgggctttgattctcactgctttgtgaagtacagcttatttttacccccaagattatgattttcaggctgtagttattattggacaactgagaggtgattttgttgttgttgaaatgagggaaaacgggccattagaaaggaccgtgtctcttaagaggagggaaaaaaaggacagcgagttggtaatggaatgttgctggatggattacatagatgagacatgggagatagaatagagaatccagaaattctcatgtatgtgtgcgtgtttagtataataacagtagctcacatttgctgagcatttgtgtggcaagtactggagtactttttcaggttatcttatttaactctaacatttctgtaaggtaggtgcaattgttatctccatttcacagagttgcccaaaaccattacttttaaacgctggagccagacaactccagaaatctctgtggtagccagtaaactatacatgacaaattattggtcagtaggaaaaagatcattcgggaaatggcggtggctcacgcctgtaatcccagcacgctgggaggccaaggcaggtggatcacctgaggtcaggagttcgagacgaccctggccaacatggtgaaatcccatctattaaaaatacaaaaagccaagaaaaacaaatattcaattaacaaacggaaagttgtcccacttccaaacagttgttttttgtctatcattgttgataggggtgtgggatacaattactgtcaggcatttttggtgtgaaggtgaaattggtacaaccctatttaccaaaatttaacatatgcattagcctttgccccacagctgtctcatttccgaggcatataccctaaggaaaataagggattcataaggatactatttgccaccttttttaaaaataatgcttctagaaacaagtgtccatcactaggacactagttaagaaaattatgattggtacatgcaatggaatactcttgacccattaaaaactgatggaaagttctttatttgcattaaagtatgtccaaaaaatatagtttcccctcaggaaaaaaaaagcagaatgtagtttagcaagtacagtgctgtcctaatgtgaatatatgtgtgtacatatgttaatataagtgtacaaaaatatctggaagaaggtcagtcaaaatacaagtgttttacattttgtcttttggactttttatctggttggtgttttttgtaatttattattttacaaaaacaaagttgtgttttatgttttaattaaagctgtgccagtgaaaagggagccagttgactcttgaccttcacaagtaggtaaccatgatgaagtaactatgtctggggatctgagtctcagcttttttgtgtctataaatttgattatattcatttacctatagttggacaagctaacctaccacctggacatcatagttttgactccccaaattggactgggtatccattctatgtgttctctgtgtgcctgtcatggtatttgtcacactgtactgtaattccctctgtgccagtagattgtttgctcctgccatacatatacacatgcacatacatactttttctgctatatgttacacatttcttttgatttattatttgtcatctacatttgtatacagaagttttaattttcattagccaaaatgctaatgaaatcacatagatattaaagggatacttggaacaactttatgccaataaattcagtaacttaagcaaaatggacaaattcctaaaaaaataaataaataaattaccaaaaatgacacaaaagaaggaaaagaaaatctaaatgtttcagtgtctgttaaaaaaattgaatttataagcaaaacacttgccacaaagaaaactccgggcagatgactgcaccagtgaattttatcagacatttaagggggacaaagtaccaatcctacaccatttcaggaaacagagcagggagaaatacttctatactcattttatgaggcaagcataatcatgccaaattatttttcctgataccaaaatttgacattttgcaagaaaattatagactgatagtcctcatgaatatatatatatatataaattcttaagtattagcagattgaacttgcaatatagaggattacataccatgaccaaggagagtgaacttaacattgaaaaatcagtgtaattcatcacattaacagaacaaaagagaaaaaaaattgtttcaataaatgcagaaaaaggatttgacaaaattcaaagcccattaatgttttagaaaaaaaaaaaaaaaccaactctaagcagcctaggaatagaagggaatttcctcaatgatttgaaaaagttaatggtgaaatattaaatcattttctcctaagatcaggaataacaaatgtaagacaagaattttctgctctcaccgcttctatttaggaaattggaggccctaatcaatgcaaaaaagcaataagaaaaagcgtaaagactgggaagactcagatatcctgatttcagaacttgctatgaagctacagtaatcaagatagtactatactcttataaagataggagtacagatcaatggaatataattgagtccagaaataaagccttatatttatggtcagatgactttcagcaaaacaccaatacaactcaattggagaaagagtagtcttttcaacaaatggaactggtaaaactggatagccacatgaggaaaaaaattaaattggaactctacctcacaccatttatgactattaagatgaaccaaagatccgaacacaagagctaaaattataaaactcttagaaaaaaatataactaaatccttatcaccttgaattaggcagtggcttctttgatgtgacaaaaagcacaaccaagggaaaaatgaatgcattaaaattaaaacatcaaaatcaaaacctttatgcttcaggctgggcgccatggctcatgcctgtaatcccagcactttgggaggtcaaggcaggtggatcacctgaagtcaggagttcaagaccagcctggtcaacatggcgaaaccccgtctctactaaaaatacaaaaattagccaggtataatggcgtgcacctgtgatcccagctactcgggaggctgaggcaggagaattgcttgaacccaggaggcagaagttgcagtgagccaagattgtgccactgtcctccagcctgggtgacagagcaagactccatctcaaaaaaaaaaaaaaatgcttcaaagaacagtatcaagaaagtgaacagacaacccacagaatgggagaaaatattctgaaaatcatatatctggtaagggtgcactgttcagaatataaagaactcataattcaacaataaaaatccaatttaaaaatggacaaaggatttcaataaacatcaaagaagatatacaaatggccataagcacatgaaaagatgctcaatgtaattagtcattagggaaatacacatcaaaaccaggtgataccacttcactaggatggctgtaatttttttaacgaatggacaagaacaagtgttaggacatggagaaattggaaccctcatactctggtgatgggaattaaaaatgttgccactactttgggaatagtttggcagttcctcaagaggttaaacataagtttaccatatgacccagcaatttcactcttagatatatacctatgtaaattggaaaatacattcactcaaaaacttgtgcacaaacgttcatagcaacattattcataatgaccaaaagtagaaacaacacaaatgcccatcaactggtgaatgaatgaacagactatggtgtatccatacaatggaatactattcagccattaaaaggaatgaactactgattcatgctacaaattgatgaaccttaaacacattatatgctaagtgaaagccacattttatataattccatttatatgaaatgtcaataatgggcaaatccatagggaaagaaaatagattaataggggctggggactgggacagtggagattgactgctagtaagtatggagtttatatttggaatgatgaagatatcctgaagtaaaatagtggtgatggttgtacaactttctgaatatgctaaaaatcaccaaattatatgccttaaaagtgaattttatggcatgtgaatcaaatctcaatttttaaaatgggaaggaataagtacagttgttcccccttatctgctggggatacattccaagacccccagtggaaacctgaaacaatggattgtgccaaaccctatatacactctattttttttctatgtatacatacctatgataaagtttaatttataaattaggcccagtaagagactaacaacaataatgaaatagaacagttataacaatatgctgtaataaaaggtatgtgactggtctcccaagatactgtactattcttgcaataatgtgaggtgataaaatacctacatgacaagaggaagtaaagtgaatgaggtaggcattgtgacatagttttaggctactatggaccttgaacaccagcatcataataatgatgatcttataaccaagttggctactaagtgactaacaggtgggtagcatatacagcatggatatactagacaaagagatgattccaggcacgatggaacagagtagcatgagatttcatcatgctactcaggacagcccgcaatttaaaacatgaattatttctagaattttccatttagtatttttggaccaaggttgaccacaggtaactgaaaccacagaaaccgaaactgcaggtaaggggagactattgtaaaattatattcacagacaatatgattgtgtgcatacaaaaccctatggaatatataaaaaaggtaagagaggccaggtgtggggtgcggtggctcacgcctgtaatcccagcactttgggaggccgaggcgggcagatcacctgaggtcaggagtttgagaccagcctgaccaacatggagaaaccctgtctctaccaaaattacagaaaattagctgggcgtggtggtgcatgcctgtaatcccagctacttgggaggctgaggcaaaagaatcgcttgaactcgggaggtggaggttgcagtgagccgagatcatgccattgcactacagcttgggcagcaagagcaaaactctgtctaaaaaaaaaaaaaaaaaagtacaagaaatagtaacttcatttaacaagtgataagatacatgctcagtatagcaaaaatcaattctatatactagcaatagaaagtggaattgtaaacaataccatttataatgtatccagaaacatctgaaaccttggaataaacttaacacaagatgtgcaagatctctgtattgaaaaacaataaaatgagtccgggtgcagtgggtcatgcctataattccagcactttgggaggctgaggcaggtggactgcttgaggtcaggagtttgagacagcctggccaacatggcaaaaccccgtctctactaaaaatacaaaaattaaccgagtgtggtggtgtgcacctgtgatcccagctactctggaggctgaggcacaagaatcacttgaacccaggaggtgaaggctgcagtgagctgagatcgtgcaactgcactccagcctgggtgacagagtgagaccctgtctcaaaaaaaaaaaaagagcaaacacaaaacatggatagaagataattaaagaagacttaaataatagagaaatattttatattcatggatgggaacactcagtaatattatcctgtctattcttcctaaattgatttgtggattttccatatcagaattccagcaggttaaggaataaaaaactatgcattgagtacagtgtatactactaggttgatggttgcaccaaaatctaataaatcaccactaaagaacttatccatgtaacaaaaaccacctttttccaaaaactattgaaataaaaatacaaaattatctcacaaaaaaaaatccagcaggcttttttttttaggacaaaatccaaaatttatgtgaaaaaatgaaggatctagaatagccaaaataatctttaaaaagaacaaaattggaagacatactacctgatttcaagccttttataaagttatagtaatcaagactgttatttccaaaggataaactagtagttaaatagaacagattaaagtctaaaaatagatctatacatataaagtcatttcatttttgaccaaggcatcaaagcaattcaataagaaaaaaaattgattaataaatattactaaaacaactgtataactatttagggaaaacaaaaagaacttcaacctttcatctccatacccagaaattcaagatgcctcctaggcctaacataaaaccaagatccataaaacttctaaaagaaaacagaagaatctcttaataaccttggagtaggcagatatttattgcatgagacataaaaaacactaaccataaaaagaaaaaaattgaaagattggagtttattgaaatacttgctcttcaaagttaccattaagctacagactgggaaatattcactacatatgtatctggcaaaggacttctacaagctaacaataaaaatagttattaacaataactcatttaagctaatagcaaagacatgaactttcccttcatgaaagatatacaaatggttaataaatacatttaaaaattcctgaatatctgtcacagatgataagatcttgaagaaaatcctaaagatttcacaaaacagaactaatgaatgaattcagaaagtagcaggatacaaagtcaacacacaaaaatcagctcttactatttatacactaacaacaatctgaaaagaaaattccaaaagtatcattttgatgtatgataacatcaaaaagaataaaatgcttaggaattaaccaaggaggtgaaagacttacacatgcaagctacaaaacattgcaaaataaattaaagaagatataaataaatggaaacacatctatgttcatggattggagcagtattaaaatgtcaatactgtatgaaacaatcaacacattatgcaatccttattaaaatcccaatgacaatttttgcagaaatggaaaaatcatcctaaaattcatatggaatctcaagggaactgaaatagtcaaaacaatcttgaaaaaagaacaaggctcaagtactcacacttactgatttcaaaacttactacaaagctatagtaattaaaacagtgtagtattggtgtaaagacagacatagaccaatgaaatagaatggagagcctaaaaataaactccctcatttatgatcaaatagtttttgataagggtgccaagaccattcaatggggaaaggacagtcttttcaacaaatagtgctgggaaaaccagacccagaatgaagttgaacccttacccaacaccatatacaaaaattaactcaaaatggataaaagacataaacataagacttaaaactataaaactcttagaagaaaacacagaacaaaagcttcatagcattggatttgacattgatttcttggatattaaaccaaaggcctaggcaacaaaagaaaaaatagacaaatttcactttatgaaaattttaaaattttgtatatcagatgacactatcaacagagtaaaaaggcaagccacagaacaggagaaaatattttcaagtcatatctgataagtgattgatattcagaatatatagagaactcctaacaaagaatacaattttaaaatgggcaaaggaggccgggcatggtggctgatgcctgtaatcccagcactttaggagaccaaggggggcagatcagttgaactcaagagttcaagaccagcctggacaatatggtaaaaccccatctctaccaaaaatacaaaaaattagccaggcatggtggtgcttgcctataatcccagctactcaggaggctgagatgggaggatcacttgagcctgggaggcagaggctgcagtgagccaagatcacaccactgcactccaccctaggtgacagagcaagactccatctctaaataagtaaatagatggcaagggacacgaatagacatttctccaaagaaaatatacaaatggccaataagcatatgaaaaaatgcccaatttaactaatcattaggatgcaaatcaaaagtataatgagacaccacctcacactcattagggtggctactatttaaaaaaaatattagcaaggatgtggaaaaattggaatccttgtgcactgttgatgggaattaaaatagtagagccattacagaaaacagtatggaggctcctcaaaaaattaaaaatagagttatataatctagcaattccatttatgggtatatacctaaaataattgaaaatacgtctctccatactcagaaatggagctagaaaaaaaagagatttgcacacccatgttcacaaccagcattattcacaatagctaaaatgtggaaacatcacaagtctccatccacagataaatgaatgagcaatatagtatatacatacaatagaacagtggtccccaacctttttggcaccagtttcgtggaagacaatttttccacagattgatgggtgggggggtggtttcaggatgattcgggcacattacatttgtgtattttatttctattatgacactgtaatatgaaataattatacaactcaccataatgtagaatcagtgggagccctgagcttgttttcctgtaactagatggtcccatctgggggtgatggaagacagtgacagatcatgattctcataaggagcatacaacctcgatccctcacatgcacagttcacaacagggttcgcactcctatgagaatctaatgccgccgctgatctgacaggacgcagcgc

SEQ ID NO: 499 - DNA, 248978 bp, Homo sapiens
tgcattggttgagccttatgaaattgccgacatgcagtaatttctaacctatgagaatggcaatttcatatggttcaactttttacgtacgtatgcttgaaatcttcattgctggatacttcataatggtattagtgagtttagagggcaggtataggaatttttattttccaccatattcccttctttctgatttattttattttataggactgctcagctaatcaactccccttgctccgattccacactcaccatttaacttctggatgtaattttgcctacatgcagagaaaatgatcaccagcaaacgtgatcatcttgtgctcctgacaactatatttctcgctgtaaaaaatataaaaaggatgtttttaaaaaaggatttggatcatgaaaaccaaatagacattcattttaattaattttccgtttgtaaaccccaggttgagtactattattggataaaggcagtggaagctaccaagtaaagtgagtcagaaaggaaagtttctggtgttcatgagggcgccaactgaatcaatgggttataatttcactgtaattttcctctcgttccacccttgttgaggtgactcacaagctataaacattcttggacaattatttcaggatggctttgttgttagcattgaaagaaaacatctttattttttcttttaaaaatcagctttattgaggtatattccacatccggtaaaatccaccagtttaaaatgttcagtttgatgagttttgaaaaatatatatgatcatgtaaccgtgactaccatcaggatatcattttccatctctctagaaagtttccttgtgcccttttgcagttaaacctataaccttgctaaatttattcattctagtagccttttttttttttttttttggtagagcctttggagtttctacatagacactcatactgtctttgaataaagagagacttgccaggtgtggcggctcacacctgtaatcccagcactttgggaggccgaggtgggcagatcacttgaggtcaggagtttgagaccagcctggccaacatggtaaaacctcgtctctactaaaaatacaaaaattagccgggcatggtggcacatgcttgtaatcccagctacttgggggctgaggtagattgcctgaacccgggaggtggaagttgcagtgagccaagatcttgctactgcactccagcctgggtaacagagtgagactccatctcaaaaaaaaaaaaaaaaaaaaaaaaaagagagagagagagactttacttcccttctaatctgtatgttttttgttttcttgcttattgcattagctagcacctccagtacagtgtcgaatagaagtggtgaaagctgacattcttgccttgttcttgatcttaggaggaaagtactctgagcttatcaaagtgtggggtcaatattgtaccaggtcatacttcacacctcacatcttttactttacacttagtacttttcatttcacagttagtatttttcacatcccacttactgaccaattctttcttgaatccaatctaatcaggcttctacttctaccacctaatcaagatttcttttcaaggttgctcatcttctctatgttgcttaatcagttgccccttattttccttgacctatcagcagcatttgtcacaacaatgactctctcctcctcaaaagattttttttcacttggatttccagacactatgctcaccttctgcttctcgtaaagtccacttagtctctgttgcatattttccttcgtctcctgggatataaacactggggcactgtagagcttggcatataaacactggggcactgtagagcttggttctgggatctttcctttttttttttttttttttttttttgagacggagtttcactcttgttgcccaggctggagtgcaatgtcatgatcttggctcactacaacctccgcctcccgagttcaagcaattctcctgcctcagcctccctagtagttgggattataggcaggcgccaccacgcttggctaattttgtatttttagtagagatgggatttctccatgttggtcaggctggtcttgaactcctgaccttaggtgatccgcctgcctcggcctcccaaaatgctgggatttcaggcatgagccaacgcacccagccgggatctcttctttttatagacactttctttcttgttgatctcatccaatctctagctttatatgccatccatacactgacaacttcaaaacttttatttccaatctagaccacttccttggaatctagactcatgcctctaactgcctagtcaacatcctcacttcagtgtctcatatgagctcaagcttaacatgtccagtgtccaactcccaatattctccctaaaaccaggtcctcctacattcttcccatctcagtaaatggcaacttgatctttccacctgcttaagccaaaaacttcagagacatcctcacttttttttttttagacaaagtctcactctgtcatccaggctggagtgcaatgctgtgatctcagctcactgcaacctccgcctccagggttcaagtgattcttgtgcctcagcctcccaagtagctagaattacaggcgcccgccaccacatctggctaatttttgtattttttcttattagtagatgggctttcacatgttgaccaggctgatttcaaactcctgacctcaggtgatccacctacctcggcctcccaaagtgctgggattacaggcgtgagccaccacgcccagcccatccacgcttcttctctttcaatgccatgtctaatttataagcacctactataacctttaccttcaaaacatcttacatcttgttgtctccattgttttcactttgatcaaagctaccattatctctcatctggattattacaacagcctcctaacccaggctccccgcttacatctttgccaccctaaagtattttctcaatagagcagtcacagtggctttacaaacagatcatatgtcacgactgtgcttcttgccttccggcagtttcccatcttattcagagtaaataccaaagtctttgcattggccaagaagcccctccaagatatgcttctcctgccactaacttccctggaatatctcctttctttctcttgcagttaattgctgctacactggcccccttgctgttctttggacatggcaggcatgctcctgccttaaggcattagcacctgttgttttcttcatcactaatacacctagattcctcttctctgtaagtcctttgatctagtgtcaccttctctatgaggccttcactgatctcctcgtttaaaattgcacccccatgacactttatattcctttcctcatttcttcccacacatgtatctaacatcctagtttactataattatttatttgttgcccctcactagaaaacaagctccataaaaacaagacattttgtgtattttgtttactgccacatccccagtgcctaaggacagtgcctggcacatcactgtgctcaataaatatttactaaatgaatcaatgactagtttcactgccatattgactggtctgtttgtacctgtacccactgtctttgcctgccctcccattaatccttttctctctcaaatccagctcttcctcttgttctcctgggcccttcctctccctcttctcattacctttgcttctgctgttattgcttctttttcaccctcaatctctctgtttccacaatggactgtcttccatctcagaaaacaagaattctcctttgataccacatcctccctgagctctacctccatttctctgttctgctttatgattcagcttctcaaacaggctgtctacattctctacctctctaacctcatctctgaccactcctcccccgactgactatgctctaggctcactgatgtcttttctacataccaagccttcctaccttgaagctttcagctgctttcccctgagcaccccacctagctgccttagtctcattcttcatgcctcaactcttttgacagggccttttctgacaccagtttcccatcttccagcagtttcccatcttattcagagtaaataccaaagtctttgcattggccaatgcaagtactttctaccttatagcaattttagcacttatcataatgtaattatcctatgcaaatatttatgttagctccatgagagcaagcaccttgttttgttcactactgtatttctagggtttgctggtgcctggaacagaagttcattaagtgttgaatgaatgaatgtatgagtttccagtgatgagatgacttaaagctagctgctgacatatgcaaataaatataaatgcatgcgcagtactgcccttagaagcactgtttctttcttcttcttcttttttttttttttttttttttttgagactgggtctcactctgtcaactaggctggagtgcagtggcacaatcatgacttactacttggaccttcctggctcaagccatcctcccacctcagtctcagggtccatgccaccgtgcctggctttttttttgtattttttgtagtgacggggtttcaccatgttcccaggctggtctcaaacccctgggcttggcctcccaaagtgctgggattataggcgtgggccaccgcaccctccttagaagcattgtttctaacagtaaaaaattggatatatggtggggagaaatacctatcaataggggattgggtaagtaaattatagtacatttacacaatggcacactattcagctgtaagagaagttaatgtagatttatatgtattgcaatgacgaattgtccaagatcttctgtaaagcaacacacaacactcaaaacacaagttattgaatggggtgtacagccagcccatcatcatagcgtaaaatttcattcctgtatcttacatgtatctgtacaaagctaggtatctagaaattatttatcaaaatattagcagtgattttctccaggttgtggagtttcaggtaatattaatttttttcttagtagtttttgtattctttaaatattttatggtaagtatgtgatgattttatttcagcagttacatttcagtcacttggccactggaaattcatcactaatccattcaatactattgaacctctactctgtttaggcaccactagaccctagagcatgcactgatatttctttcctatgtgtttatatacaacttcatttcagaactttttggggctgaccacaccatctacttattctcactttggaggtaagaatgacttgatgaaataagatagtttgtatggcatgtaccaaattggcacttggggagttcactggatgtcaattgcttcccttctcctccagggcactatttttgctgcatccacagttaaataacactgtatcacaatgcaatccaaggagcaggagggagggtctattattacaaaccatcactgttgaaccaatgaactactgggtgcctcttgatgcttctgcctccttgtatcggatgctctttgaaagccgacaccagttgtagacatccagtgaatatgggtaaacttgactttctttatcacagaatagttgtcattttcaaatgaagaatcctggagaccagaggaggtacagcatttagaacaacagacccctttccaaacaagtgccaatgtgttctcttggctgctgtggtgcttctcaaaattttccacaggagagggaattgtatcaaggggcatctagtggtatcctccaatgcagttattaaagtcaaatagtatctttgaagttatctgtatttttttcatttttataaaaatgggtttatttaaaaataaatctataaaagtagaaatacattgccttaagaatctgaattttgcattctattccacagagtctcactctgtctcccaggctggagtacagtggtgtgatctcagctcactgcagcctctgcctcccgggttgaagtgatcctcctgcctcaatctcctaagcagctgagattacaaacatgcaccaccatgcctggctaatttttgtatttttagtagagactgggtttcaccacactgcagagcaaacatggcatcctgggacccatccctaccattaagagtgtttccctacagaacaggaggtgcaaattgggctgacattccaaagggcaaaatcagcggcaaacagctactaggttcttaatgtaatgtaatgtaatgtaatgtaatgtaatgtaatgtaatgtaatgtaatgtaatgtaatgtatagtaggttctgagtgagtaatacagagataactgaaggagctgttcatacatagcttcaaaaaaaaaaaaaaaaaaaggtccagtaggccagacgcggtgccgcaagcctgtaatcccagcactttgagaggccgaggggagtggattacctgaggttaggagtttgcaaccagcctgactaacatggtgaaacccaatctctactaaatacacaaaaaattagccaggtgtggtggtgcatgcctgtaatccgagctacttgggaggctgagacaggagaattacttgtacctgggaggcggaagttgcagtgagccgagatcgcgccacttcactccagcctaagcaataagagcgaaattccatctcaaaaataaataaataaataaataaaataaaaaataaagaaaatggtccaatcaaacctggttgtagatgcctatggtttgtggaaacatgtatcattatgactgacccctttataaaccacaagtttttgatatcttaataaagatcaaattcttgaccctttatattacctcatgaatattttttaaagagttttaaaatttaaaatttaaagtttaaaaatctaaatggttatgatccagatatttgagggccactgtcccaggcacagtctcaccagcctcctgggcatggtggctcatgccagcacttagggaggccaaggcaggaggatcacctgaccccaagagtttgagaccagcctaggcaacatagtgagaccctgtctctacaaataagaataataataattagccaggagtggtggttcctgcctgtagtcccagatacttggggggtgagattgtgccactgcactttagtctacgtgcagagtaagatcctgcctcaaaaataaataaataaataaaatttaaatgcaatttaggacctataaaaaaataaaggcaagtcctaatgggagcttctagggaattctggaagtccaatttaaatacagtatacctgatattatatacgaagagaggaatatatgtatcagtgacaatgatcccccttttggtttattgtgtagtatctcgggagctgcttgatctattcctccctctgcctccagtacatacatagttgaacaaaaattaacagaaataatctccttctttaaagtccttctgtggttccaagctcctttacatggcctatatgaccttacctcctgactctccttcacatacccgcctcttttatcaataattttcaaactgtaagtcatggcctattcatgtgattgtgaaatcagctttagtcactagttattttcagagtagtagataacaaaacagaaaagagaatgtgtggaccacatagcatcattttgtaaaatgtaagtttgaacaaatatggccttccgggagccatccacataaggagttcttccctagacaacaggaaatgtaaattgggatgacagtccagagggtaaaatcaatggcaaaaggctactaggcttttttaatgcaatgtggtcctaagtgagtaccaaataccagagataaccaaaggagctgtttgtacacagcttcaaagaaaatgatccagcatatatgtgtgtgtgtgtatgtgtgtgtatgtgtgtaccagctcatgctggcagattctatttctttctctaggttatgatccagatatttgaaggccactgtcccaggcacagtctcaccagcctcctcaccttccctgcctgctctttcataaaactacaggcctctacatgggcaaagtatttctcctcatgaaactggaaatcattgctctttgtttttgagtccccttaagcatgatttccaaggtgaaaactttgctcatctccaggtgattagcaattagttacacaaacctttttcacagccccttctcttcctgtaagctcctgaaaggactgtccattgccttactcatttttgtaacttcagtgcttagcacagtcaactaatgagggttcaataaatacagtcatgcactgcataatgatgaactgaatatataacggtggtctggtaagattatagtggagctgaaaaattcctattgcctagtgatgtcacagtgtaacacatgactcacatttgtgataatgataaatggctgttactgatttatgtatttactatactatacttttaatcattgctacagagtgtacgcctacttataaaaaaagttaactgtaaaacagccggaggcatgtccttcaggaagtatttcagaaggcactatcacaggagatgacagctccatgtgtgttattgccccctgaagtccttcccgtgggacaagatatggaggtagaagacaatgatattgataaccctgaccctgtgtaggcctaggctaatgtgtgtgtttgcatgttagtttttaatgaaacagtttaaaaattaaaaaaaaaactaaaaatagaaaaaatcttatagaataaagaaaatatttttgtatagctgtgcaatgtgtttgtgtttaaaaataaagtgttattataaaagagtcaatcatgcccctgaaatcccagctacttgggggtaggggactgaagtgggaggataggttgagcctgggaggtggaggctgcagtgagccatgattgtgccactgtactccagcgtaggtgacagagtgagaccctgtctcaaaaaaaaaaaaaaaaagtcaaaaagttaaaaaaattaaagtttataaactaaaaaatttacagtaagccaaggttaatttattattaaagaaaaaatttaaaataaatttagtgtgacctaagtgtacagtaaagtctacagtagtgtaatgtcctaggccttcacattcactcaccactcactgacttatcctgagaaacttccagtcctgaaagctccattcagtgtaagtgccctttgcaggtgtaccattttttatcttttataccatattttgactgtaccttttctatgtttagatacacaaatacttaacaatgtgttacaattgcctacggtattcaatactatacaggtttgtagcctaggaggcttaggctacaccatctagtctaggtgtgtatttgtgtaagtacactctatgatgttctcacaacgatgaaatcccctaacaatgcatctctcagactgtatctcagtcattaagcaacgcatgattgttgaatgagttcttttttttttttgagatggagtcttgctctgttgcttaggcaggagtgcagtggcgccatcttaggtcactgcaacctccacttcccaggttcaagtgattctcctgcctcagtctcctgagtagctgggattacaggcgcgtgccaccatgcccggctagttttcatgtatttttagtagacacagggtttcaccacgttggccagcctggtcttgaactcctgacctctggtgatctgcctgcctcggcctcccaaagtactgggattaaaggcatgagccaccgtgcccggccaattgttgaatgagttctaagctcacttagctgttatttactttttaaacactagaagcctgaaaaggaatctcttaaagtaaaactttaaaacacattctttctaccacatggccaggttgcaaataagaagcaccaaaaaaaaaaaaaaaaaaaaaaaaagaaagaaaaaaaacacattctgctaaaacttggaatttaatgaattttactcactacagttatactcattttacattaaagtaaaaaagaaaatagccaggagagtaattcatctccagaaagcagtttaaagttattgtttttattatttttatttgctaccaatatttttattgtaagaaatacaaaaggtattacaaatatacaaactatttgctctttttgcctcattcaatttagctttcacataagtgaacacattggacagtgatatttcaacaccaattttgaaaaaaacaatgaacttcatcatctgacaataaatacctacattttcattctagcacccagtaagacatccagtttccaaaggattattggtatgcaaccctctgaattttctgacatgttacctttgccactgcaacagaaacaccactgcagttctccctttcccaataagtcagagtaaggggcaggtaagaatggctatctgacttcagaaaccctgggtcacaaagcatcccttacttgagctacttttaaaaccagatttttaatgatagggtacttaaagttttggtggtccttgaatgacatattttacgttacatatttaccctacttttctattctcctcctcagataggaagggtatagataaactggctatattttcatctgcctcttgggaaaggagcaagagcattcagctcagagcattctgaagacagtagccttagagataagctttctttctttcttcttcttttgcttcaagagggctttctgtgtgtaatggagggatggttgctagagtgagacagcccttcccctcttgctatgtctataccatacctgaggccatttttcttagagggcaaaaacgttagaataggtaggaaggttcttgctttcagagagctgtgctgcacccacagggtggacccgacaggccactgtggtaactctcaatctgtgtacagagaaaagagaagcaacatctgatacaaagtcacctgccaacattcttataagactgtgtcccaggcagtgaatttccacactgcttcttgggtctgcagaactcaaagcaccaaaacagagcattctgtagcaatataagcaaacggaataagaataattatgcacctttaaggaacatgcacccttataagtctgtaccctgatatgaaaatagcagaatgaatttcaagtatgaagaaatacagtaaaagtgtggcctgtagatggagagaaaacagcagcctggaatgtggtttatattcttgattagtttttctcttggtaccacagccaaaactgaatgctctgtacaatgacttggtttaaaaatcaagatgcatacaaagatgctagaggcatttctaatgggtgccatgagcacagtctgtgcccagcatcaggaaccatctctagatgaatgtggctaggtcaagttgggagtggtggccaggcctagacaggcacacctgtggtccatgatgtggaggaagatggagagcaccatgtggacaagccaggatggtagcagggaacactttagtggtagaaaggaagagatacaggggacagagatgtagaggtgtggggatgttggtcatcttgggctggttcacacagcctagatgagtatctgatatacacaatttctacatttctagaaccatgatttcaaacacagaaactaacaagtcaaatttccaaattagattttttttttttactttcaaaacattttctattataagtcagaaggaaaaaagcttactgtatgtgacagtcttcctgaaacctaagagaaagttttaaccaggccctatggcaatgcagaaacactaatacattttacagtgaaaacctactttaacacatctcaaaatgataatcgtataaaactttctagttctaatttgcactctacgtgaaccaatatttttcttttcttaacacatactgctcttctataccaaacacttgccctttaaccttcagataaaaacctcaaataccaaaaaatgcaacaagcttttgaggtgttgggaattgttggttgttaaaatcccttttattttataataaattatacaggcaatccttgctttttattaccacactggattgcttctgtacacagctaagttgcctgaagcatggaaacttggacttctccatctgacacgttctggaagcctcaaggcacaagctgacagttctgcttctacagaaaaactctcacactgctctcctctcaacagtactgcctgttcccactactccacatgacacctacgagggcactacatcacgtgagggaagcttcttcatgagggcagacaagaggaggcaccacccaggcactggtctctgcctggcatctattccgagggccacctggcacagtttctaaattaaggcatatctaaaatgcttttctacctttagtttttatttttgctatatttttgcactctactatatgcatatttaataaaaacaactacaaagtcctttactttaattcctttacataatgataaaacacctagatacccaaaatactacatctatatattcaaatctactaatcatgttacaaatgcatgcagcttatttgggggcttagtctaatttttattttcttaggtccatcaataccatgataatgaacattagatgcaaaatcctaacactttctgccttcagttgtactttcacaggactagtgtgattcagaaataaataacatacatgaataataatagaaataatttatgcaaatgtagaacaacttgaaaaaaaatcccccgcctgtcaggtgctgttcctgggggtagctgatgctataaattccatgtactaactaatatatttactacaggtaataggaaaacaaatgaataaaaagtgaggaactatgatatacatgtgtatatttttgcaaacacaggatcagaatgaaaagatatatcatgcactgtgaggtttaagaaatgtattactgctgggatttgttttattattcagactttaagatcaaactgagagttgttggtgatcacagaaatattgctagctgatacatattattgcatttcataaaacttaagattagaaactttcaagtaagggtacaacgggtatcttcagaactttaacctaagcacatcaacggaatttttctagggaccacagagagttagaaattaaataattgtgtggctctatgtgtgctgattagtgctacagtcatagttcttggcagtcaatatgtagttatatgccccctttgagaaaaacctacatttgacaatccaaactcctaaaattgagaaagggttatttgtgtgaccaaacaactcacacggaagattcctctcaacatgaaaatcccctgctacatgagataatttgtttacatacctttaattacctaacaaagaaaaagagagaaaagaaactggaagctaaagaattgagagcttttgccaactgaagacgaagcagaaaataaacttttcaaaacaaaacttttccaggcatatctttcaccatcacatatatagaatgatggaaaataaaaaaataaaaaaaaattcctgcaattatacatcttttctttaaaaaaacaaaaacaaaaacaaaaactgagcttagcgcctgagagatgcggggtagacagcttcacacagggcagctgctaccgcatctctttttacccgaactttcggagaattgtgttgtacttatttatgcacagaagacacccgtttgctactagggacatttttcttcctaagatttgcagaacagatgcctctgagacagcagcagggcactctgacctcggaaagcagcccgcggggccgcacataatttcaggcaccggcaggtgagtgggaggcggggccccagcccggcctcgcccactgcctctctcctgccaaaggggcggggcaacgaggcagcgcgcccggaaggctttcaagtgggaatcaagttttgagcacgagcaaatggggttcagactggccactgttataacaaaccctggggtggaattcggcctttcgcataggggctttaactggactctagttcctgggagcagaggggcgaatgaggcgggggatttctcagccagtttctgactgcccctagtgtatgtggcattttggttcagtatgaattactgagactcatctgcttgccactcaggaggaaagttgggcaggcaccgtcgagtgtctgccactcaaaaggaataagctgctttctgtggtgctgtgctaaggaaactgaaaaatactgcaatatccttccctactaaatttcaagtgacactgctgtgagaaaggtgacctctaaaattaacttaatcatttggggtataagaagtctttaagtagacttgtaaatttaaaaaaagtatataaagttgccaaaaaacttcaaaagttaagtatgtagacacactcctaagttgttatgctcatatacttcagactttttttttttaattagagcttcttatgaatttacatttgtgattccacaaatgttaaaattacctggtcttttggtattttagggctctgtttcaatacagcaatttttcagacaaaagttttgtctactgaattactgatgtgctactcattttgctcacctgatctttaaattaggattttaaaatttaatcaatgttgaaaggccaccatgctagggaatttgaaagcagcagagagggtatgtgtgttttaactggggccactaaaggagttttatacttctaacgaaactatcctgttcacagatgaggactgcctttttagtaactaagcctgttttaatctagaaaagtaaggtaactgggtacttcaaaaattttttcttgactgaatgaatgactaggctttctttacttaaatgatcaaaatgggtgtattatccatccttaagaacaatttatttgcagacaattgttcagaacctaggtaacaagtaaaatattgaagttacagaacattatagagactattaatcatcccaaaaaacaagtgctaggaaagagttaaatatgcgcagaaaaataaagttagaatgaaatctcttttagaagtacctctttagtcttcatcagatttgtttttctctaaaagtgccaccttgtggaatataccggaataaaacaagaaagctcatctcttaggacagtgtgaatgtttagaaagacttttgcaagaaaagtcaccttcctttcctaccacatcaacttcaaattgctgtaacagtatttcagcagatgctcgaaaagagcctgtatttattttcaggtggctcttgttttcttcctaaggctagacaaggtaacaatatgttgaaggaagtccacttctactcatttagctaaacgttatcacttcctggaaatgctgagaaatagaaaacattttgaaaagctgattggcacttcattaagaaaataaaaatccccagaaaggctacttgagaaaaaaacgtgtaaaaattggaccccttctgtttttacatttctgttgcttacaaaggtcagaagatagagagaccaaaggattatttttggtttattttctgaaaaagtacaagatagaaatgcttgagatatagggatgtattaaaattgggttgtgaattgcattgatatagaaagggagtaaataagaaatgaaaatgctagtttctcatgcttttgaggaaaacagcatttctaattactctaaggacttacatttcttggcacactttggtagcctcaataagtttttccactgtggagatggaacatgtaaatatcttcctaattatatacccaaatatacttaatggacatgataaatggttttgggtaaggttcacaatttttcaaaagtattggtggcataggaaacacatgccttttaaaaatttattttttcaatgaacgttcttaggcatgtgtaagaagtattgcttcatgtggttgcctcttcccttgaaatgggaaaaaagtacaggtaatttagtttgcttgggacagcttctccataacatttgttttcgaccatattaatcccacagttaccagatgaccttagtataaatttttacaatatatttgttcataaagaatatatccttcaaaatatatatagctttgaaactaccctttaaataccttcattttctccagaatttcctttatctattgcccactgttttatgaataatttttaaagccttagaaatcatacatctttatctgtcacaatgtgaaacatgcattcttttgaattatataaatatctaagagtttataataacattccaatattttctttccagggtaaatattctgtagtttctatactaacataattaagtaattatggtggcatattcacttttaacattattttttcctagactcaactatgcaattaaagcctgcttttggaaaatgtaagacactctcatgtgcttatcataagaatagtcaaattgtcacttaaaagaaaagcaatattttagaagaattttaatatgtttatgatattaggaagcttacataatttaatttccacaatggaacaataatggccattactgactttaataggcaccacttgtaaaagaagcagctacagtttcttaaacactcactttaaatacataatttaaagttcaaaatgtttggtactatttaagagttttctcatcaagatggatagtacattctggagagtcaaactatacatttctctatagaaaagaaacatgctttatttaagataggaacatctcatgccttctaaagctttcatttttatttaacacaatgctgagattctattcttaggtgaataattttcaactatttttagtaagtcacctggggctaaatgaaaagtctgccattcacagtgtgtgcttcctgagagaaaatcatgagaatacagggggctgaaatggccccaagctttcttccaaaacaggttctttgcaccttgagttcccatccacttcaaaggagggacaaagtgggaggctccaacccactgggttcttacaagtgcttagaaattgtatttttaagattaggtcctttttattaccctttgccatgggatttcttatgaaagctaaatggacaagtttctctttttctctttttatatgtaggttgttttgactccaccctgtgcaacagttcccaaaatgcctgagccgccagaaccaaacatcaaacagaaactagcagggacattcttgtactggtcctactatgaaattcaaacatgatttcaaatctgtcacaatattttaacttgctatgagctgcttcagtgtaaccttggggcaatatgcccttttcagttcaccactgcttagcttttggcaaagatgtttgaaaccatatgttacagaagaataagctgtagtcactaagttcttactctactatctgcttcaaaatgccctaacggcaagactgcttgtgttggatctggatttcagaaatggcgaatctggacataaaatacataaatcaagagagtattcactcaaatgcaacaactacaccgatggaagaactggggacagatttttacaaagttcagagaggctgagatgccctttcattctgtgtcatcagaagataatctgccaacgattgaatgccagaatgtttgtgctttaatttttcttcataagcactgcctagaaatgagtcaaaagcagatgctaggaataaaagttgagctctctactcatttaaaattctaaagaatgctgaaaaattccagttcagaacagctgcatttttcttgagtgaacttatgaaaacacttttacaacagcaaaaactaaagctatgttcactctagccatgaatactaaccaaaaagctcagatgaatcagtgcagtgagtttttaaattcaatttgtaggccctagcaaaaatgtctttgtattttgaccctcgatcaaaggaaaggcagaactcacttttccatgtgagactttgagtagacctgaccttgaatgctgtggattcattatatctcaagcatttatagtactgacaacacctaatcaatgttgtcacaacgaaagtagaaaacatttgtatggcccatctcctttattatcttgctctagaaaacaatgttcctgttcctcaagctactgaattagaacaatgttaagtagtacagcaattaaaaaagaatagttcccaaccccaaaagctcttcaggagaaacatctcctagttttttctcttgttcaagatagtcatatatcacattaagctgcaaagaattcagtacaacttaataatgcataaacatgatctgaattattttctgagtgcagcaacctccattctttgaaaatcctaaccctaaacataatctaactgttgcatgatctaactgttgcatgcactctgagtcagaaagcacaggtggctaaactttccaaaagatactttctgtgtcctctggttactagagccaactgagcactaaaccacttataaggcagagatggtatgaaatataaaggactgtagagaaaacagtaagagaaaaaggaaaagctgtttacaatgcccaggccaggctggctctgtagagagcaggagtgagcacaaggcactagaaataagcacagcctgggggatggagaaaagatcatttgatagagtaaatgtatggccctaaaacatagctaaagacataccctcaggtaaagacactgaaaatatcttctataaaaatgtaattcacaaagtaacagtttatagcaatctgtgtgctggtgataaaacaaaacaagatcctactcattatttaggtaacaaaagtaaacaccaggtagaaggactgcattagagaacatatgtgaccctgttaggtttgcagaatcgaggccataaaccataagctgagactgcgaatttatgaaaggttcattgaaagcaagcaaacaggtggtgcatgggaacagcttaagcaatctgttattagttatacaatggtagcaatatatttcagaagtgccgggagatagacaagatggatactttgccaacaaggcagtgtgtggcagaaagtacagtgtaatagatgaggaaaatttcaaggccactcctgtctctagttagagagaactactctccaaaccaaaacaggaaagagtttctgacaaattcctaaaaacaaaaacaaaataacaacaacaaacaacaataacaacaacaaaaaaagggaagaaaggaatttcaaaccaggaaataaaggctttctattcttttttttaaaatctatctgaggtacactccctaaacctatagcaagtaataaaaagcttacaggctattttccaaaagaaatgataaagcatgatgtcatacagaaggttaaaatagacttacaacaagtaaattcagcattctgaagactaaatagaatgcatgcacatctcttaaaatatactagaattttttctcctttttgctgtgtgtataaaacttcatcttttactgctagcaaatttactgcttttggccagaaaagaaatgctgaggacatggggttaactttctaatttgagaagactattttggtgaatcaccttcagtgaacaaatgcctgttatttactgaccaccttgagtctttaaaattgaattattcttgtcgtttacaaaaagtaacactttaaaagatcacagaatctctcacatacacacacacacacacacacacacacacacacatgcacacacacactcaaaagtaccaaatcaggcccggcagctgcagagagattacatcataactcagctgtgcctggattacccactccacactggcagcattcaaggttagaaaaatcaaatggcagcacaattggtcagcagcttctcttcttctggaatttttccaggttcttgaaacaaacagacaaacaaacaaacaaatgaacataaagctgcaatcactcttgcattgatttcaaaacagtaaactaggcggtttccttggagaagcagagcctgtccagaagacagcagctggaaggcctccagatagcaatcctccacagctctgtagggcttgctgagggggacccataagccaccaagggtgttctccgcaggatcagcttaaggcggctgctgaggcctcaggctgtattcagctccgaggtgttctggctgggcggcaggtgggaatccaggttttctttgcacctttccaggtcctggaagtatgggtgagacagggcactgtaggcagatattcttttggctgggttaaatgtcaaacacttctgtaataaagaaaaaaataattggttgatatacaatacatcaatgtaaataatgtacttacagagttatccctttattcactgtcatatgttaagcgcatctacagtgggaatgagtatttatttaaagggacactaaataatatggagacagtactcatatatatccctaatgtataaaatgtccctcaggagaagacccttttgggtgcctatggactgtttcctgcccaggatttctcactaagccattaaagtatgcatataactttatttagtaattcttccagtgctagcaaacttagtgctacagtcggagacttcaccgtaacttattatcctgcctcaaggctacaccactcagaggcagggctatcttccttttaattaataccaaggtgccacatggctagcagtagctctctcaggggaccattagattcagttcgagtcactaaactctattccaggctgacagctcaagtgtagggctaccaaggtgaatgagctggtgcctgcgcttaagaagctcctggtcctagtcaagtggtttgggcagtttggctgagctactgaggtagaaggtgaaaggagggaaagggaaacctttgcagtagcagcaatctctattcccaaactgtccatacctaaattagttagaatgtgtccctaatttcagtctcatttccacccctacctcaggtaatcttgttactcaaatcctcctcctctccttccatcaacgcctcctgctgggtgcctagcaggtggcaagcactaattagtgatgagtaagacctcctcattgccacaggagctcacaagtagcagggaagccacactggcttctccatcctaaagtgaactgggtatatgaaatgtctatgcattccagtcttctatgtaatttacagacttcacattatcatggttaatggaagacctcttccacttaagaggtctgcataaccatgatattaataggactcctgctcacagtcctagtcaggttccaactggattagggacctctctaatattctatcgaaggctactgacctagaaaaacaaatacaaacagaaagttctatgtgtaatttcaggcaaattcttgggtcctctgaaatctgatttatcctgagatccccatcagtccatggttgctagcctccctataggatcttctgaacatcaagagctaaagggcaagtggaagaaagagcttgtctgtagaaaggttccaactgtctctaacagcaagaaacatctctagaaaagctttgcaagggctgaattcccaaaggaccggaaagcaggggcaaaattcctgagcctgagttctcttttcccagagcccaagaaggagaaaattaggtagtggcatttaatctccaggacataggaaagaagagaaaagagctgtgggaatacattcacaatacagagacatgtctctagaggattatgtgagaggaagccctttcctcacagctacactgatggcttaaagctgggaagagggtggagagaaggagaacaccttagccaaatgtgggggtgtgggagaatctcacgttggaagtcttaatacattttgtcctatagaaatatggttaaaaaaaaggtgtttaagttctattattgctctacttcaggaacaaggttgccaggttgagggttaattaaaaaactttgtgttaataatattgtttctgcaagaaaatttagtttaattgccaaatagtttacttataaaatgagcttttggaatcacaacttagtcaagagttggatactatggtagattggataacttttagtacatattccctcttttctctcccctctcaccatagggggagcattctttcctccattcaagttggccttaggcatggaacttgctttggccaatggaacatgggcagagtggcgggtacttcttccaagtatggaccttcaggggcattgcatatttctgcttgcccttctggagcatcgataccttctatcatgagaaaaacatgccccagggagctgctgcctctctggcatgggccccagcatgagacacatggagaagacctgtgcttcacccacgggcagaagcagatatcaaaggctgttaattcaggaggtaaagcagacactcattactcactgggtttcagacatcaagaacagcccaacaggtacacttttctacctattgttctggcctccaagtataggaaattatgtatatggttgagcattaagagtctcagagcacagaagtccttattttcagtgaggtattttatatgtccctggcacactaaatacttattaaataaatcagcaactagaagaagtattgctatatagttcttttggaaaaacatctccccaaagttgtgaatgtttaagaaaaggcacgttaaaatgacaaacaaattacttaaagtagcatgaaactgtaagaaaggaaacataatatttacttctaaagaaacatatgtcaaagtgaatcgagaggcttctaaacctgcattgaaataaacattcaaagatggcagatttaaaaaaatgtggatcagaaagacattccagaatcaaaagccaccagctgctacaagtgtgaaaatgaaacctctggagggactgttgcctcctgctccatgtggctgtggcatgtgatgcctatagcagctactgaactgatatttgtgcccaccacccagtctgggtagagcaggtgtctcactggcacagtgcagacgagcttgacatcagaaaaacttaccagaagtaggtctttgcctagttcatcgatatctgttacaaacttctcaattggttgggcagattttgaatgaaaagcctgcctgggaagggcaacatctctaggccagtcttcttctcctgggagtccaatcacgctacaaaagaaccacacatggacataagcattagctactatgcagaagctgttttctcatcaatttccagagaaaggcaaaatctaagggggagacatggggggcagagtcccaggagaccttcactttatcactggcagggtctctgtttatctctgtcctactgcaatatggtggccatgggggagagggtaatctcacagaagaattgtaaaattcagtgggaggagataagagattgctctggtagcagacactaaatgtaagggatgatgtagaaatagaaaatatattaccaggcagtaagctctgacttagtgacaaagcaggacttattgtattcagaggagacccatactggtacatatcttcctttatgtccaagaatgctttttgtgttttgatcgaacaccccagtattgacatgattttatgatgctcatccaacatggtttattaacatatcaatttggttgcatttttggttaaagagcaattccctacatattaaatatatacattagaatcagaaggaaaaatgaggctaaaacgtgctagtcctgcattatacaaacatgattttataaaaggaagtctgtggtattccaaagtgagcaaacagtaaattaaaagactattatttatatttcccctgaaaaccattctgggatcagaaatgtggaaagaacagcaagtgataagcacaggcttcggaaataggcagatttgggttcaaatcctgcacctgccacttactggcaggtaaggacaaattacttaacatctatgacccttagtgtctttatgtatacaatgataataacttacagttgtaatgaggatcagttatactttatttgaatttatagtaatatataaatttataatttaaagtacaaagcacagcacctgatatacatcacacacagtcaattatcaatcaatacactgcctactattattataattagaaaatgttattaatacaagatgcataggaaatacatcactaccacacttaaaatatgaactgcttgtatctatgtataacttaagattctttaaaaaattaatgggtcaatggacttacataacttatacattgtatagatattatttatagtttacatataggtcgtaagtaggtttgaacagagaaaatcagaggatgcagggacttctttctcacacagactgtataactctgaaccaaaaataaaatcatagtttagtggacggggtacatagctattcaaatactggaacaaataattttaactacagttagaaattgtgctggcccacattagggtcttctgcttggcctctacttgttgggactaaggcccaggaagaggtgttcttatgaatgtacttccagatttcaggaagatgtggtacaggtctcaagatctgtagcacttcatttccccttccctcacctacacggagcccaggccatagacttcagctgggaagataaccctgtcatcatggcttctctgcctgggtgtctggggaagacactgtaattcggcctctatcaggcatactgagagagctacattattgaggcaaagacagattcatggacatatttactagaagcaataaatagaaatgacaatgagcaatatatagatttgttcaatagtacagcctacaatagaagtaaaaagaaaaaaaccaaaaataccactattaattatgaaaagaaatgcacgtgtaagtgtctggatacaatgggacagggcagaggagggaatgaaaaatgcttgttagagagctttaaaaatttcctttcattcctttttagttgtcaggtctatgtgtatcaatatttttgtgtatattcaccagtcagctagaaattgattatattaataactcctagaaatatttaaaatcttttttatttgtggctttgaatgtatctacatctaattacatcttgcaagtatatgatcaactgaatgccaaaagccttcagaggaacagcacatctctgtttgtatgtgtgtacatatacaaataactttatataattttatataaaattttaaacaaacacataactatatatataaaactttaagtctatcacctcctctgattcctgtaataatttcctaagacatgtaagtcaggtgttattagtctcattttatagatggggaaattgagaatgaggaataaaatgaactgccaaagtcacagatagcaagctcagtcacagagtccagagtgagttccgttctctctattccaatattttatttccatttagctatgacatcattcttaaaaatgctctaagatgtcacaggctaaaactattgtttcacttttaatacttgctattacttgaaggcttaaatcttcctaaacacagaaatgtttttccctttaagagtatgtgaacatggaccaggtggggtggctgtaatcccagcagtttggaaggccgaggcaagtggaccacttgaccccaggagttcaagaccagcctgggcaacatggtgaaactccatctctataaaaaatataaaaattagctggttgtggtgccctgtgcctgtagtcccagctacttgggaggcttagataggaggattacttgagctcggaaggccaaggcttcagtgagccaagatcgcaccactgtactccagcctggacaacagggcaagaccttgtctccaaagaaaaaaataaaaaagagtatgtgaatatggctttccttaaaaaaaatttggtttcatgtccagaatgaacttttatggcccaaatatgtgttgtgaaattctgataggtccattaaaaatgcttgcacttaattccactatttggactgctgaatataagccttaaaagttgacatttatattggcaagcccaacagggcacaaaatctataaatggcagtgatggaggagacagaaatattttttcaagtacttcagcagtgacgctagggtgcagcattgtcccttttctctggcaaggtaatgcattcagaggaaacagaacataattttgatgacacaatgccagaaaccacaaagtaaaatctaaaggcacaaaccatagaactctacagcttctttgctgttggcaacctacgattgtcaggactttgccaaaagcagaactggcttttctttggaagcaggtcaaacatgccggtcaaatgttccttctggtccatttcactggcctcatgtactaagggggcactaacaatgttaacaagattgcagacatcagtgctggaggtagacacaactgtcaggtagtataaataagggaaagaaggtgatggctttcaagtcctggcaagctgactttagtcaagattctctttccttttaacagaaggtcatcagtatgtctgctttccctagtttcctctttatgatcacatgcacacaaaatatattcaacagtcatggggaaaaatagatgggagttcatcgagtgattaaataacttgccattcagaagcaggggtaacatgaaggctttgtgttgaatttatccactgtacagagtggtcagtagtaggagcagtagcatcacctgccctggacccaggaagcccccaggcataaaaaactagcaaatgttattcaggccttaaagctactatgttctgactcagcagtagcactggcattaacagaagtctagctgcttctagtcactaaaagaacaaaatcaggttccagttttattaactgttttaagcagtcacgcttgagtagacagtgctgatatgaaaatctgttctttaggggtggtttttttttttttttcagtcttacagacttcgaatttcataaaaatcactgggattcctataaaatgtcacagaccaaagatcagggctatttttggtctagaactcccacttttttcctactccactccaatttggatgggcctttcaaacacaaaaaaccaaaaaaggatgccacactgcatgctttgtcagaagaagtgccccagttacattctagaaacatgaatgcatacatgcatgaacatgcagacatgaatgaaactatgtaaatcatcaaggagcgatgtaactgaaaccaaagaatttgagcacaagaaaggatcttatagagaatttaagtcagagtttcatttctcagatgaagttaaggaaataaaaggttaaataattaatgatgaactctaatagtaacagtaatagataactttttaaagtgcttactatgtgccaggcactgtgtaagcccttcacgaggtgttttaaatgactttctcaaagttgcagagttattttgccaaagacttagggttctcattttctattttggtgctccaaagaaaaatgagatgtgtagcataccatccttcgcccaggaaaacaaaacaaaacaacgcagaaccaacctgggtgaccaaggatactcagtggggacaggaagctcactggacaaggatgggtacttggtcaccaggcatcccatctctgatggtgggtgcttttgaaatgaccacaagcagaaaatgtatttgaactaaaagaactggagctcagccacacgaagaaagaggagcagcaaaaagatccacacaagcaacatacaagcttccagagcagagcagttagggctctgcataaaacggcacttctaccatgtctccactcaccacacaaatagtaacactgtctgcagcagctgcttgaagtaagaaagacaagagataaacacatgatatgcatgtcagaggaaagtcactgtaaatgttttaatgctatggacactggtgtaaaattataattattacttactccaagatttttcctagttgatcaacatctgaacttccacgaaaaagaggcctaaaagaataaagatacattttaaataagaaatgttctcagattacatttcaatcatatttgccattatcattgtttcacaggaagcaaaatattctttatgggttgggaagaagtaaaaaaaattgagacatttttcctttggtaagtgaaggttttccctgcatttcatgtatgggttaggatctctcatgaatacctggtggtagatgaattccatgttttacaatcacgggcattctgtttgcagtcattcttacaacagtgctaccgtcaaattcagttccaggtttcaaagatctgcttaacttcgtgataaggtggaacataccaccatcctagtctcgaaccataaataggtgagattctttgatatttctcagagcactttttccatactactctgctatcagagtacttcctcatgggtctctctcctttcatttgtcctcaatgctgcagtgaaccacctctgggtctatttttctaattataccacttttcttcctcccaatattatggcagctaaccattacaagttctaaatcttaactctgggctttagaggcaattgtgtctgcttcaaacacacagccttccttgtctacattgagcatttaactggcaattaaaaaaggtcattttgtgacatttctggcatttctccaagaagatcaagtagccccttgagggaggagacttctctaggtttccctataaatccctgccatagagctttactctgacagatgcagttactaaacattttatttcattttgcatacacctatggtacacaagtaaacgttccctgattccttcctcaacaaatgccataaacaggtaattttcaacattaatgtactaaaatagttgtagtctattatcaggtatcatatctctttttatattatatatcaaattatacagccttaaacttgacctcttaaatattttctgtgcacaataaatgaactcactatatatggccatatatggagaatcctgcagtcatagcatttcagtggttagaacacaccttaacgtttctcaaccatactttctatgaatgttactattcctgaaaataatgatttccaaatgcagtggaaaagaatttacttattgcaaggtgatgggctgaatttttttcccccaaattcatgttgaagcccaactcccaagatctccgaatttaactgtatttggagatagagcctttaaacaagtaattaaaataagatagggtgggccctaatcaaatctgactgttttccttgtaagaagaagccatttggacacaaagagacatcaggggtgcacatgcacacagagaaataaacatgtgagaaccatgagaaggtaagcctaaaagagagccctcagaagaaaccaaacctgctgacaccttcatcttggacttccagcctccagaactgtgagaaaataagcttttgttggttaagcaatccagtctggtattttgttgcagcagtcctataaaactaatataagccacctgcatatcactaatgcagccaaattcataaagaatcacgaagttgcgctctgaaagacatcttgacaggtcttaaaagatgacaaggtgagaagtccaagtttttttctaaaacttccaaaaaaaggcaaaaaatggaatcttaacaattataatttattgagcatgaatgttgtatctggcctagtgccaagtgccccaaacataatctcatttgattctcacaaaaattccaggagaaatgtagtagtacaattatccctattttcagatgaggaaactgagtactggagatgttacatggcttaattaagggcataatattcccctctccttttatttctttttagttaacatgctgatttttcaagatttttttttgactggggaaagggtctgtttggcgatggactgtcctgggagtgaatctctatttagctgtttcttcctatatgatcttaggaaagtctcttaatttctttgacttagttgcttcatttgtaaaatggaaagaatgatacttacctcataggatcaactaagtgagattatgaatatatctcatctactagaatgcccagcttatagcagagttacaattaagtggtaactaaacacacacacacacacacacacacacacacacacacacacctctcttattcctggccaatattatacagataatcatgtaaagtatttcacacagtgaagtagaaaggaaggaaccatttgccaccatgtggtgaggtccaagtcacatttaagtctaacagtctttcctctggggtcactaaatattgcttacatgttacagctcttacaactttatcaagaaaagaattttctaaaggatgaatgccacatttttcaataaggattaattaattctgaattggcaatatcacttcctgtatgcagttttgcaaaaaaaaacaaaacaaaacaaaacaaaacaaaaaaaaccaaaaacctcaccaagtatttaagtctatcagtgagataaattttctcaggtcaaattaccaaggggactaagtttcagattatatgcctttttaaaaaaacaactcaaaaatgcatagatatcatttgtaatctcagtaacagtggcaaacaacatttagaagttgggtatgttttttaacagatgagaagtgtatactggtatgtctgttatagaaaggaaatgattcatgcataacaggggatgaaagtttcatttagttacaataatttcattgtactcaaaagacaaggaagtcatgggttaacctatagaacacctttgtaacctgtatttgacctgcagctatgctttgacagctatttttcttgattagtggaagaattttccatgttcataaagtgatctttcaaaaaaatattactggagaatatctattattttatactcattaccacattctattctagagttgttatcagttaagttaaaattgttaacttatcaccttacaattaccacctattcaaataactggatgaagcagaaaatcaattaactgatctacttagtacacactaattgactgattacccagtaagtacatgcggctgtaattggtgctgggaaatactaaaaaatacacatataaaaaatataaattacatttcaaagtatataattataatgtatgtaatatacatataatgtaagtcatatgatatacatataatatgtatttatacattaatagcaggagacaaggagacaagatatacaaatgcagaatcaccgaatagaagtttacctcattttaccagtgggagacagaagtcgcggtaatcgtttcatcttaatagaatgttaggaagtggtttgattaacttacttttacagatgggaagtaaagtaacatctaaggaaacacagatgagtaagtggctaagctgatttgtctgacttcaatgaacagcaatatagaaaaagtgttttagaaagactaatttggcaggggtttactgagtcaataagaagggatggaaaccaagccaaggaggtcaactgggaagtcagtgtacaagtaagatgacaagggcctcaactaggtgggacaaggaaatggctagagatgcaaagacatttagaagaagatgatcagaacttgatggaaatgtgaacatgacttgagaggagaagcatgattttaagtttgtattatattattagtaaagtctggcagaatgagatagatggaggtggtggggagaggagattagaaggtaactgatttagttttaaatattttccttgtataataaaattatataaaacatttcactgaaattggagaatgaataatatgcaaaaaaggtagtttggcatacctatgtatatacccaaaagcattaacatacaggtccacataaaaacttgtacatgaatatttatagcagcattattcataatagccaaaaagtggaaacaatcctaacgtccatcaactgataaatggataaacagaatgtggtatggacttacaatggaatatcactgagtcataaaaagaatgatatactgagactacctggaggacccttgaaaccattatgctcagtaaaagaagccagtcacaaacaaccacacataatgtgattccatttatatagacaatgtaaatttatacgaacagaaagtagactggtggttgcctgggactaggggatttgagggaactgactgtatacagactgaaggtctgtgcccctgaaaatttcctgtgttgaaatcctaattcctaaggtgatggcattaggaactggggcctttgggaggtaattatgtcataaaaggcattagtgcccttataagagagaccctggaaggctcccttgtccctttcaccatatgaagacacagcaagatgacgatcatcaatgaatgaggaaatgaaccctctccagatactggctctgaccttggacttcccagcctccagaactgtgaggaagaactttttgctgtttataagccaatccagttcatggtattttgttagcagcccaagctgagtaagacagactgctaatgggtatggcgtttctttttggggagataaaaatgttctaaaatcgactgtggtggtagtggtacaactctgtgaatatgctaaactgaaaaaaacactgaattgtactatttatattggtgaattgtgtggttatatcaattatattttgatagagctgttaaaaaaggtggttaagaaattatatttccaagcaaacattacggattcaggaggagggtaaaaaaactgctaaatatttggaaaccatccacatacacacaaaaataaattaaaaaaaaaactgctaggaaaactgttaggtctacatatatgaaaggctttaagcatgcggtattaaagtatagtgacaaacattttaccatatattcaatcaagtacttgtctggagacatgtgctccgcaagttttgataatctattgttatgatctgaatctttccaaacacctgatttatcagattagggttaaataataaaccaaaaatgtctatgcatgcaaaaaaaggcactggtatgaaactattatcttatacttcactttggatggtgagatgatgaatgatttgctttctgcatttttctacttttctatactgcgttttatgagtgttagttttaaaatcagaagaaaaaaaaacccgacaacattgcctcttgccatacactgcacatatatgatctgttcacctcacttcttcattccctactttaatactaaggcaactctattatattcgtttacctgttgatttctacacacaaactggaagttctctgaggacagggccaaccctcacttgattctgtattcagagtactgaatttactgcccagtttggctataattggaactcaattaatacatgctgagtggttattgctcccccctgcaagaaggctttctgtcccttcttttcttcaacttcagctcctcctgtctcaaaattcacttccttggttcatctctgggtaattcaagtgcaagcaggtgtatctgcagaggtacatatatacgattagatgtatacacaccaagagccaactccaaatccaatttatattgttgtatctgtttatgctttaatctgcctgtggcaccagacaatatctgcctgcaaataatgtgtatttaaaaactggggctggctgacaattattctcctatatccaaaaccttgcgaaaaccttcacagaagcagcaagaggcaagcaggataggaactttgccctccagtgcttgcttcagccaggtatgaaggctagggatggtctccctggaagacaaagaaagagaagtgttgagaaaaagtgtagcaaaggcaaaacggtataggattaaggagagtggggaggggaaagacgcacttgaagtaaaaccggtccagaaagggagaagggctggtgggaaagagcacggaaaaaaacaatttaaagcccaagtaatgacaaggaaagaccgtggcagaaagaagaatctgagacgaagttccgtcacagagacccagactgataggaaaaaacctctgccagggaagggaggtgccacttagaggaaagacttgtgtctctaacacaagttagagagtgtgctggcatccctgtccataggagggactatgagtctggtaatttccttaaaaataaatagctgaattaatttttccttgttaccgatgtgaataatttatttatccacagagggctcatatttactggactatgagtaacttcctctagagaaagagatggagagaaagaaagagagggagagcagagggacaaaccctaccatttttcaactcaaaattgaggattaaaattaaactagaactcaccaaactacttcagatttctgaaacattacaaaactcataaattaatatatttactgagtcaactttacatatgactaaaataagactaagcggtcgttgagatgaaaaagtcatttctaatcactatgacaaaaattgaatgggtatctcccatttccaagaaatagttacttctctgaaatattcaaataatttcatttttattctcccagtgtcatctctccctgccttagtctactcaggctgcaataatggagtactgcaaactgggtggcttaaacaacagaaattaattttcttgtggttctgtagggtggaaagcctgagatcagggtgctagcatggtaactcaacaatgtagggttctggtaagatccctcttcctggcttgtacctgccttcttgctatgcactcacgtggctagagagagggtatgctctttggtgtctcttcttataatggcactaatccaatcatgggagccccatcctcatgacctcatttaatcctaataatctcccaaaagccccatctccaaatagcatcacattgggggttagggcttcaatgtaagaattttgggagggacacaaacattcagtcagtaacacgtccttcttcatattaatgaatgtaatatatcttccataattttaaaattaaaaagctgggctggcacattcttgtctactatagcagcaataaatgtgatttgtctttctgtgactaggatccaactcttcattttatatactttttgatattttttcttgccaaattacattatttatttatttatttatttatttatttcccttccaaagcctcccttatctcttgctctccaatcacactgttcagggggattcttaaggctgggaaagaaatgatgatgtatttagcactttccaagggctgggttcctaatgcattattgcattttaattctcactctaaccatgaagttaggcgactagcaagtactgaaaaactttgcaaatgaaagaaagttttagaaccaggaaaataaatctgagtcaaacttcggaagctataattcacaagggtgaagactttatattagtattattaaaaaattggaggcaagtcaaggatatggtacccccatggaatcactcctgtcactatgggcttctttaatagtcagatatcgcaggctcaacactccggggaatactgtcttctgtctcttcatataaccacagagcttggataacccttctgctcccttgtggaaattctagctttaatactcactatagtttaaattgggcttagcattgaaaaactttaatgacaacatgctggaaggtcatttggagcaagggtgatggtgtggtgtggagacagaatagatgattagagacgatcagggacacctggcaaaatgagtgccactgattaattagtgaggctctgattattaactgggctcagggcttatcaattgccttcactctgcagcagaactctgaactagagatatcactcgaccaaattagaacctcaccataccacataataaacttattctgtctcacaactcccagtcttgctttatactgtgccttcctgggagagaaggaaaagctttaccagggaattcgttcatgagtaggaaccttagcactgttgttcttcaatacctggtcatttgggtaggagagggcccaggaatagggtaaccaacgagcccagtttgcccaagattgtcccagtgtcagtactgaaaatgctgtgtcctgggaaacctctctgtcccaggcaaactgggatggttggtcaccctatccaggagactcagagcaagaggctgtagaagacagaattttttaaaaaaattaagttctttgttatttcagtggggcaggctgtttaaaaaaatcaaatgagcatacctcaaaacaatcagaatgaaagtggtccagacagacaggttttattctcttttttcctaataactcactgctactgtgtaataagggactagactggggggagtcccctcctcataccacaattcaagatgttatttctctctttcagtaaatgacttcgtaaaactatacgcaccttgcctcttttgcagggaaagagcattgcctatggttaggtctacatggttaaattaatagtctgcaggaagtgctggatctaaggaggcaaccacaactagggggtcactggggtggagctacctacacatataggatgacaaggagatttcatccagtctggttggtagcgataggctgtaagctgggttgagaatgattctgaagtgctgtgtaggtggagcaagagagagtgctacattaatcagtaacacacacctctgaaaatgaactagctaagtgagtcaagttttctctcatgataggctgacttcaaagcaacattgatacaaggaataaaaattagaaaatacaaaagtaagtctgtctaatagagacatttcaacagcaaatactacatacattacggtaactaaaatgtggctctcaaaactacttcttacttttaacctctgaatccactggttttgtcttcaatacaacattttttgccaaagggagtcttatgggctctgttgtgggtgtgtctttgagtatataattatcatcacctctatgctcacacacctttctcttgcaaaaactctaatattgacatcagccggatgtcagcaaaatgacatctttctgaggctgaaggttttcatgttgcctttgggggaaaataatcactagacattttctgaaatggaagtgtctgttggctgaagtggcttctttaaaaagaaaaaaagaagctttgctcaaaatggaaccaaaagtatcagtcataaagcattacaaatgatctaaaaatattctcaaattggattcaatcattggttaaaaatagtccaaacactgaaagactgattttctcattttttccttaaaaaattataatgtgctcaacatataaataagggctctggcccttgaatgtcagtgatgttgtctaccagtgtctagtattgtgagtttagtgtggtgattaatcaacaaaagctagcatttattttatcagaataaaattttactggcccaacagcaagtttaactttttcaaaaagcttatttactgaatttatattttgaatgattcatcatgggtactgttaaaaataacaaattattgcatacctatatcaaaacatctcatgtaccccatatatatctactatgtatccacaaaaattaaaaataaaaaatttaaaaagtaacagattatcttgattataaaatatatacgcattgtggaaaatttggaaaatagagtaaatagatgaaaataaattacacagcatcacttccattcttttctctttttatatacaaatggatatgatggtatctctaaagatctttttttttttttttttttttttccaaacaagctaagatggcaccaatcccagggcaggatctgagtcttgactatagtccttagttttgaacaagtacagggtgacaagaaagtgcataacaaagctatgactgaataaaactcaaatcttggtgaagaaaagaaatcaaggacacattaaaaaaactatgggtacacacattttcacttcttagtttatatcttatggcagggagcaggagtaatcttttctttttcctttatgaatggtaaagacaactggtatcctgtctgaatataatatgcctatccagcacactttgggtagaatccaatgatgtgtgataactcaacaatttggtacaggaaacagagcccacaacattcctcagaaatttcacagacaatctagacagaacagacctatttgaatagggttttttgttcagtaatatttgaaggatgcaatttttcacggtggacacattgggtttgtgacagatgcaaattcagatatgaataaaacacaattaaatgattcagactcttgaactgtgcttccacagacctgatttctgcatgggccaaacaaaggaaagttggtgtttgacaactgtggatgactcatcagaggaagttcttaccatgtggatgtgcttgttgaaataaagctggttaacaaagctagccttttttttttttttttccctctgtgggccagcgagggtttcattttaggaaatggaagtgtcaatgtggacaaactgttctgaagtatttatagcataatgtaatgtgttagtttccttaaactgcctttggacaaagaatatgtgaatggaaaataagatctgaatttctaatactgtcttgtgtcatctgaactgtattatgagtataaaatgatttagcactgtgatatgtacacagtgtgataggaatgtagtgtagctacagtggggtgtgctagtggctttccaattaattttaagagctcttttattcattaaggatattacacctttgtcatattcattcattttctccaagattatcacatgctttttaacttggcagtgtttttattttctgatgaacaaaagttttcaatttttatataatcaaatatattagtatttttgtttgtgacttcttaatgctttgaaaatatatctccattctagggtcacagatacttcctatagtttctttattcttttatggcttcacttttaatatgtaactctttaagccatctgtcatttgctctgtggtgaggaatagtgagaatctaatcaggttaccatttttcccccatgaaattgaccaattaccctattctcatttgttgcatatgccgttctgtcctcccagatttgtgatttatgataaattgcatcacttcctaaattagggtttcaagtctcattctctattctgttccattaatgtctgtcacttctgctggtaccacattatttttattactgtagttgcataatgtattttagtgcttggtagcaggagtttctcttcataactttttttttttggtaacaaaaaattcttggctattttcaccagtttaactcttccaaatgcatttcaggaaatcccactggaattctgactggagttgcataaacctatgaattaatttggaaaccttttatatccttacaactattcaatcttcctgttcaggaaaatggaatatttaatatctttctaataatcaaatattctctatatctaggaaagtcatttttatgtatctcaatcaagttttatagttttcttgatatgggttctacacattgacttacatccatctacatttttgatttttatactgggaatgagatggagctgctgctaactctggagaaacttactgctgatcttttatctttggacatgatcctgactgttctcctaagtgatggattatcttagatttgaaaagtataggaagtaaaggacaagagggacatgtggggggatgtagtagagtctgttttatattcatagtgagaagactctgaacctcccaggagggctctaaaggttaaaaaacatgcaaccaaaagcaccgaggattagtaaaaagaaataatgtgcagtaagtgctcagagggatgactcattgcattggatcatctttgggaaaccacctactaagcagaatttagcagctaaagcgttatttttggtgcacagtttattgctacttcctcttgggaaaaaaagattaatcctagctccctaaaacacttaagaatggtcaccctggcaaaccggcctgtcaggtaacaatgttgtttccagatcagggcagtgttaggttccctgtagggatttcttcagaacaagggagaagcactttaccacatgttatggaaaggagtatagaccaggagacagaagatccagctcttagtgctggctctgtaactgattaacaaataaatcccagagtgcaggcaggccacttaatctctgctcatctgctaaaaaacagatatcacagcttctgtcgtactccatatcatggaagaaaataacacaaaataataaaccatgtgaatgaagcagttaaaactgctgagaaataaaattaacctgctcagtaaaagtaaggctaccaatcaagaacaaatagaatgaactgttactcgttccaaagttatttatttttgcttaatactgtatttccttctcctttttctctgtcctgtggtttcttttccttgtttcattatgactaaatatgcaaggaaaattcaatgctgttattttggtcctatctttggcccaaatctctagatttaatttacccatgataccgtgctgtgctatttaaaaagatcactaagaaaactttatagatgatgaagttaggaaaatgacaaataaggggataaatgcgtttccttatttaggtgaggactatggctgagaagattctgtaacttagacatagtcagggacgtgataagagcaggagctgtaatcagttttgctaatcatgatttctaaacaatactattttatcaagtatttaaatgcaatctatccgtagcacatttaaaaaaaagttataagaaatatttttaaatttgttattattattattttttgagacaagatctcattctgttgcccaggctggggtgcagtgaagtgatctcagcttgctgaagcctccattttctgggtcaatcattcacccacctcagcctcctgagtagctgggaccacaggggcatgccaccacaccaggctaatttttgtattttttgttttgtagagacagggttttgccatgttgctcaggctggtttcgaactcctgagctcaagcgatctgctgccttagcctcgcaaagtgctgggattacaggcgtgcaccactgtgcccagccaacacaaatattaaggtcaacttctggtttcagtacaaactatttagtttatttatgaagcaaatgaacttacaagaatgagaaggctgaggggatatgattatatataagatccatttgcattatacattctctagagaggtacaactctctgtcatatttttgattttataactataagagaaaaatatcaccggcaaaggctttatgtcactcataagaaatgaaacagcatttgataaaaaacagcatgtacaggaataaataattacattttggtaaaaatatatgttaaaaaagataaaatatttatgaaatatgttttcttcttcccctgagacggagtgcccaggctggagtgcagtggcgcaatcttggctcactgcaacttctgcctcctgggttcaagcgattctcctgcctcagcctcccaagtagctgggattacaggcatgcgccaccatgctgactaatttttgtatttttagtggagatggggttttgccatgttagccaggctggtctcgaactcctgacctcaggtgatctgcccacctcggcctcccaaagtgctgggatttaggtgtgtgaaccactgcgcccagcccgattgtattttcctaaatgaaaacttcaaaaattttgctggtatattgctttttaatatgaaagtgcaataaaagttgttaaaaatgcagccacatgttgctacacttacggttttagaaagagatgaatatgtagacataaaacaaaagccttgggaggtatttcttctatactgtacttaagactatgtggccacagagggctgccaggttttacagacctacgggttaaatagcaactgactgttttactcaaaaactccttttgaatttagaaaacaatttagtcagattttggaatattaagcaaataaatgtctacttccaatataaagtttaattactgaccagttagacttcttgatcatcactcgtagtcttggcattgtaactgagggacacattttccttgaaaatgaaattcagattctttcaaactataaaataacttctgatcacttttggctagataaaaatcctgaatgaattttaaggaaatatgtaagagaatttcaccttaagatcattatttttaagaaattaagtagataaaaaccagtgtgacctaaaaagtgttgagtaaataacttttcttcaacatcaacagctaataataataataaattcaatttactgaacacttattacaggaaaggggctgctttgctttgtttcacatatgttgtctcatttactcctaataacactctgctaagtaaatatcattatcctcatttcaaagggagaaactgagacttaggttaagtcaagatcaaatatcaaatttaaaaactcaacatctactatgcaataacagccaacgacaaggccaatggtatacatacaaggtgattaccatgttttggggaagcaggaaaaaagagaacgctgagataaatttcaaaatttgatcacttgctgaaaggcattaaaaaaaaatgaaagtttgtgctgtgttcatttatcccatctaattaagtagggccctttaaagcttacaaagcattatgagtaaaagtatttaacgtattacaaataacatgttggtataatttgttaatagacattgtatgcattgctcataaaatgcaccttcagatggtataattttagctcataactaatgtatactttggattactgtggttttgcatgctaaaaaatttaaaagacattttcattttctttatatggaaatttataaattttccaaaagatatagaaaataaacttttagtatatctttggcattatttttattaacatcagtatattttgaaaataaatgatgtatttcaaaagatgaacctggaagtaggaaggccttgataccagggaggaggctgcaggctgagcatggagcagagtgactctgccaagccaatcccatgtcccacaattgaacaacgtttcactgtctcatgtcttactgacccactcatttgaggctgaacttttttggtacctttacccactcatttgggagttctgccaatgcccagatagaaggatgcttcagagcaaatcggggtctgcctcactgagtcttgctttgtgcctgctctgacaggtagcaggacaacacaccctgtgttgaccctccagactgggcaggaacctcagtccaggtctgccattgaccggctgtgaccctcgtgggcaacactaactgactcagagtctctttagtctattccagagtgggttccttgaatgccttgaaggaacatcacttacctactaaattataataaaaatgtcctcaaattaaatatgtcttcttcactagtgcttgaagatgtcttttgacccccccagagttaaacattggatgccaatgatatgctgaaaattactaacttttgcttttccaggagaaccaccatatctcatcagatctaagatgtcaccagttgactgcaattcacattttgatttttagaaataaatgtgaaaaaaatgtagatcttagaaacactgcaatgtggtagaatagttggcaaaatagcaattttcttgttggggggtgatgaaatgcttcagctacactgtgttcagattctcctgatgttatcctgggacttatatcatctgcttctttatggatccacttaatatttcattcaatgaatacagatttactgaaaatattttctcaaaatattaaaaaaaatcttggcgctttggtgaacacacgtagaaaacctgcctccttaaagttcttgaaataaagaaagtacatatgagatagattctttgctaagcacttctgagttacaatgagttatttcttgataaccaatgaacaatagcgacattattaaacgtttgttctgcaaaaggcagtaaaaaggactatggggtaaactcttttgacgtaacttggtgaccagatccttaggttcttttgcatattagtggtctgaggagcatgttaggagactgacaaaaatagtctcaattaaacgctattctcttccttcaagaaaagctttcttgctcagcagtattactggacagcatggctttggtgcttaaagccttcctgttctcactggaaaattggagtcagtgtcttaggcaccaccatgctgcggcaccctcacgcctaatgatcacatcagactgtacaggcttcaaccactttaaacaatttcctttgtctccccttccttttctgtaaatttttttgttgtttcgttgttatgggtagtgacagtttctggtttctttcatttgccaacggtttcctttaccacagcctctattcctcctgctggaagcctggcaccattggaagctggaataaaaaccacaactgaatagcctggcacttactttaacagtcatttccaaccacagattaatactgttactggatttgactaacggctctcaatcagcccaactgtcatcacttgagaacatgctagccagtgaaagccaaaaaggaaaatataagcaaattcaaattatggtataatttttctgattgctcatcttttgaatccaagggtatctatctctctaaatatcttcttctgggttctccttaataatatgtttaatgtatatatagatcaggagataatacaccacctggctgcaactagtggggaggctgaagtcaggagggaagggttgccacaggcactggctagcacaagagagcacgccgctcagctgcccatggaacgtatatgtatcctgcaccttgctctgcccacctttggcaacggcactggaaacagctggtgttaagtgtgctaagtagccagcatcaaagtgcaaatggaagggggccctcatggaggttctgtgttgataacagtgatgttcaatgctagcctatcataaacaggaaccaggtttttctctttatcatttactttgacatagtagacttcaggtccagtgcagctgataggatttttcaatagatacaaaagaaggatggtatagcacattatacggtatatgactggcttaatgaaaataagagtctatcccaacttggagcttcccgtatcaacaaaaactccattttctatgactgaaggctttgacaactcttactaatcccagcttttggtcctgacagaatctaacctacagatacagggaaaagaatttggatgactattactttctgactgacgacttctgggtctactctgggtatttcacacacatttaatcccaatcttcctccttaaaaatgtattgaatgacattcatttaatacacccctggagggaaaataaagtagaaaaatctttctggagggcaatttggctccacgtatcaaagggctcagggttttgaatatgctttgtatcactattccacttccgggagttagtcctaaaggaataatcatgagaatgaaaaaaactttacttacaccaatgtgcatcacagctttccttaaagtcttgcaaatttcattcactcaaccaatatttactacatgcctactatgtaccagggaatatttaaatacaaataaataagatccagatatatttttatataagaaaagcagattacaaaaaagcatgatctaattttacaagaaaattaaaatgttataatgcataggaaaaacagttgaaagataactattaaaccattagtaatggtcatctcttggtcactggtttatggtttatttttctttcctctttcttttcctatttttatttttaaagtaagtatcttgtaaagagccattttgacactacgtaaatctcttgatgaaatttccactcagtagttttagcatcatccattgatgattttctaactccatcattcactctgttattattgattgtcagtctactgtaagacaaagctctcttttctcccactttatttatatcagcatggactcatggattttaattttattcaggaggttataatcctttactataattatgtattttgatgcccaaattgttttatatttgtccagtggctccttcaagctaaattctgtgcctttctggtatgttcccatattttttgagcattttcttactttctggtataacaagatactatagacttatactctttactcgtattttaaaagctctacaacaaccatgtatatttttgttaaatgaaagaacataatacatactatttaaaaaataatcttacataagatgcatacattatacagatttttataagatttttaaaaaacagtccagattgctgatcctacatggttcaggaatattagaacaaatgggccttctgagctccacctgagatgggagaggatagcacctgtcttacaaaccaatatgaaaggaaattatgtctagtgagatcattaaatgcataagtcattgctctttacttgactaaaaccagtgagccggccacacagccttagataagaaaggtaacagttaaagtacattctgttcgattaattaatgtctcacagccaaatgtctctgtcttgccccttagaaaactgcatagaagaatggtgagacaccatcattttcatctgagtgactgagtttcttcctgctgactgtttggagttcccctgtgagctggcgtaaggtacttcttcctgtggctcagagtaagactctgagagccttggggactgccctctggattctgtgaggaactatggaaaacaagggaagaccaagtaggagcccccaactcctccttgtggaggagtcagctgaccccacgccttgaccccagagccctgcatagtttctttaatcttattagatgggtttccttaaactcactttcatgctcagccttttgccagactctaggaccagctctggcctttgtggtgactgtggtgggatatagggggagagatataaggagcactacaatgattagtcatcacttcactattgagtcatttggccatgccgcccagcccactgtgacctcagttcatgctgtgtaccccacgcttgaggttctgtctagaatcccagtactccaggtccttggacttttttgattctgaattcttctaatgtcttctgttacctctgagaagaagccatcctttatcctgttctagaaaagtgatacaccaaggtaatttaacattatgaacaggaagttcagtggctaagtttcactgaacatgtacaatgcaaaaagacaaaagtgaagtgctttatacatactgtttaacctcagatcaatgctatgtgggggatatatattaatatcctcattttacaattgaggaaactgaggttgagggatggttaatgataactcatcatcattgagctaagaagtgatagagacaactagatgctccaaagctggctctcatgaccacttcactacatcgcatcgtttggctatgactacggaactgctagtggacttgagactcaggctgaaaaaagaatttttttttttttttttgagacagggtctacctctgtcaccaaagctggaatacagttgtgtgatcacagctcaatgcagccttgacctcctgagctcaggtgatcctcccacttcagcctccaaggtagctgggactataggcatgtaccaccacacctgactaattttttgtagagacagggtttggccatgttgcccaggatggtctcgaactcctggactcaagtgatctgcttgccttggcctcccaaagtgttgggattacaggcttgagccaccacgcccggccaaatcccgggttttaaaaaatacaaatgaactaatgggaataacactggtaagcctgatgttgagaccaagtagtattcttcagttggttctaagaaaagaaagaggtgatccagaggagtctgtaagtccatgaagaacttggaacaggtttgccattatagcacgcttcagcagctcattcactcattcagcacatttggagtctgtgatgtgcttatcactatgctgagtgtagggaacacagaaataagactgacgtggtccctgcccttgtgaggcttacagtttagggagaaagaaaatcattaaataagtggtaagtgttatgaagaaaataagatatgctggtggagaataatagaaaaagcctctttaaggaggtgacatttaacctaaaggatgaaacagaggaggcaggcctgctgaggtctattcactttcttttcatctttggttgtagctagaatttttgagtactcttcaagggagctttatgacttgggttctgttaaacaagtcaaccacgatttttaatccatgtgctttatcacgaatggtttccttcaccctgttcaaaacatcacaaatatgatataaatgggacacttactattcagtctaaaactgttctcatttatttacttattaaatacagaaaaatccctttagaatcagggataagaggaaaggtctttgtgtttcgcaaagttcatccaagtgtactatttgtttcttccccatggaattgtcatatcagctttaggaaagatgatgaaagaaaagaaatgggcccagagggacctaaggaaaccaggccaaacttgctgttcacgtggacccttacagggagaatggaaggcaaaagcagagaactgggtccaattttctttctcagtgctatctgtgcagtggtcagatgtggcactcacaaccaaaaggcttttgaaacagcactggtgagtcctgacctaccttcttcaaatttctgaaaatgatacattttattatctcatgagtagagatactggagattactcttaaggcaggaaggggagacctagggtccctttctttgctataattaactgcattttctctgggagaacagaagctccccatggatatatggggttgggacaagtggctatttacagctaagaagggaatatttttgaggtttagagaattcaaatcacgattactatctcatgttcaaagactgaaataaaaatggctgtgtactctcttcatggagcaatttgatgttctgaggccctctactccctggcttctggaaatctatttttccctccatcacaatatttcctttaactactgaataattaaccctagtgactaacctagtctcataggaagaaggcttgtgaaatctgctcctgatgcatgtaataagtgtagaaggacacattaagtaatgtgtacagtctgggaaggccaaaattcctttcccaaggcctggtccaccctgaaaaagaggaaggaaagctcatactttaattattggagcaggtattccactggttcacacattaccaggaccttagaggtttcttctatcatacagaaggaacctggatcagcacactcgcctactcttctttgtctgccagtggaactccacaacaactgaccgaagctgtcaccaccccaggctgccaatgtgggcctccagattgtgaggccacagggtcagatatggggcctggcgctgcactgacagtgctgcatgtccaaagaggcaagcagccaggcagagccctctctgttacagcttggccacctgtctgagagggaagacaaatcccatttcatcgggtttggcatggaaagcaaattgttcacccccacacgcaaaagctcttgagtggcagaaggaaaagtacacaccccaggtgcgaatataaaagcgggtctctttgggatgaaccttctggttaatttggtttggagtctatggtgttttcactcagctctcatcagtttttaagccgtattacagctcccaggcttttaggataattctcttaatgaagtaatgaaatgccaaagaaatggcatcacagggctttgccctttcctgctttttaaaggccatcaaaaccatcattccctaacatacccacacaggaaaaaagatgaggcttatcttgtttttaagctattgtgttgccagcatttccatcgtacaagaaagataagtaaatgcttgcaaaataaagtctgacccaagcttcacctgatatgcagtttctatcttgctgagtgcacatgataataagatttccaagcagcattagaaaccatggttcaatccagaagtgtgctcctgcaacccggggagggggctcctgatgacttcacagtgaagccaccgtcacaaacaggatttcctaaagaggtcttagggtgaggaagaagcttcattctaactttggctctgccatctgggcagcactgctgctcctcccctcctgtaaacaggcagttaagagggggcaggggcactccttcctattgttcctcatggctctcacttccctttcatctttggcaatagctggaatttatgagtatgttggatgaccttccaagtctttccttcggagtttatttacttcgtggatactccttagtaaggctccatcttttggcggctcacaccccggctgtatttgtccaaaggtgtggctttatctctgtatggtattgaattgaatggaaaaggagtcataaagactgtgtgattcatataatccaacggtgattgtgcatacacgacactatttcccaacttataccttccagtacagccaggtcttgcttttctgagaatgaatgcactgctatttttgtggcttgcctaatgaagttcttgttaaatatccaatcaaacatcttcaaaatccagctcaggactaacttcaggaagcccctattattctagttcagggtaatatctgacttttctaagctcttaacagttttaaaaatctgtaccatgtggctcagcacttacatatgcctggtctgatactgtttgctaattattacatgctaacacatcatgcacatttttatttgctcatgtaagttataacctccttcaggctcagtcttcaggtttttgctatcttccacagtgcccagaatgattgtaagcacctggtaggttttcttttttctttttctttttcttttttttttttgagatggagtcttgctgtgtcacccaggccagagtgcagtggcgcgatctcggctcactgcaacctctccctcccaggttcaagcgattctcctgcctcagcctcccgagtagctgggattacaggtgcctgccatcacatctggcaaatttttgtgtttttagtagagatagcgtttcaccatgttggccaggctggtcttaaactcccaatttcaggtaatctgcccaccttggcctcccaaagtgctaggattacaggcatgagccactgcgcctggccagcacctggtaggttttcaaagaatatttgctcattcattaattgagagaagaatcccatgggattcttctgtaagtttcatttccttattatgcaactgagttaaatatattaagtgtaaacattagaactaccaaaggaataatgctaggaccagtattgacttaatatgtttatactgttttgattagtaaaatgacataaaacctctgaatttaaaattaagtgctttctgggaatataaaataaaaaaatgactaaactctactgaagaaaaatcttgagactaagtgactgaagagaaacatgggaaaactgttttgaaaaaggcaaggagcaaacgatgcatttggcccattttatgccagagctactcacagagtgatgggctctgacctacaggctgcagtatgttcattcatttattcattattcatttacttagtagccactttatgccatgctctgttaggtactagttatacagtggtgagtaaaatagagagggtctggtttatagtttcatgagtgatagggcaaacaggttttaagccagaaaacactaaaataaatataagtgcaaactgtgctaagtgctatgaaggaaaaaagtcaaggtgttgtgagagtgaatacccgaaggtactgattttactctgggtcaggaaaggtttctttaaggaaataacatttaagatgagattggaagaatgacgtggagcagccaggaggtgagttgaggaggtgagtgggcaatgctccaggcagatgactccaggaatctctgcaggcagtttcttgaagggaccgatataactgctgcttctgcacagcaaagccaataaacttatggatccaaataagaatacaggaaattcatatactcattcaacgaatctttattgaatgctgactatgtgctggatatagttctctgcctctgggatatccaagtaaacaaagcaaagatccttgccctgtggagtttaagttctatagtaagaaataaatgcaccaatatattttcatctaaatattgcaggtttggctacagaccttgatgtgtgtataatgaaacttgaaaggtctcagaggaaggaacagtggtgtagtggacgcaggggacagctgttccctgttgggagacaattctgcatgggccctttgtatttctgcacatcttgcaagtagagacactaactgcatttgtgctggattagattttcaagtaaactgctttggaagatgatagtgtctccctctatagcatgagcaggtttgtttgctcttaaacatgataatagcttctgctggggcaaaggtaaggccgacttaactgaccattataaaagattcatgttggggattcgtttttgtaacacaacccgtgtgtgtgtgtgggtatgtgtgtgtgtaagtgtgttcgtgcgtgcttgcaggtgtcatctgccccccttcttattttcctatgggaattgggaatctggtgcaaatgctgatactgtagctactgctattgctgtgagtaataaactaggctttgtctctaacccaagagtcttgtgtcttttgccagcattcatgaaactgtggtagactaatttgttaacctgcaaataggggaaaaatctcacatccttcgcaggtcttgacatgagtcaagtgacaaaccaaaaaatggggactttttagttgagaaagacaaagaccaaaggggtagaggataaggctgaagtatataaaatcaacaaaagtaaacttggttgtattcaccagtcttgaatatcaagtgaagggatgaatccctgatgtttgagagaggtaagtttatgtcaatagaaaggaatttcttcacatacaggatactaaccttatagaacttaccatctcaataaatggtgctggctgaaactacaaattattttataaaaggcctcactaaagtgatggatgacaaacctagaatgcccagttcaatacgtattggatgaccgagtgtttgccaagtgaccatctataagatgatctcattatctgtgtcagagaagaactactgggaaaaatcattaatttgacctaacaaggaccatttttaatctacaaagtgagaaatagactcttcactgctttatctagttttagtttttactatggatacacatacataaacatatacatttgggatatgtaagtataaaaatctcctttacaacaagctacaattcataatcatcttaattcataaatgttaaataataatggtaaaatatgctcctattttagggcagttgtttcccaagctggatgtgaagaacacttccaggaaattttaagaggcatatcttgaaaaaaaaaagtctcacggtcaaatatatttgaggagctatgcactatatgtatatatctttggaaattcaaaatttacattaataatgagggctgtgataagccctgagtcacagaaacctttaagctcgtgtttcccaaatttttagtattgaccgatcatttcacagcatgcccattattatctcatgaaacactattccatgaaacagcagattgagaaatgcgtttgtcaattgttaaaaaatgaagatttttatggcaaggactgctataatgccaacattatctataaagcctcactaatttgaagttaaaaacaccagtgaagtggggacagaagggcctaacaggtgactggatgtcctggtttgcttctctcatacaggtggttgggccatcttcacctggggggatccttgggattaattgtttcttgtgtccaaggagcccgaatgccccaatttcatgaatattttcatgtttaaggcaaggataacaatcatagttatagctaacatttattgcttccaattgatgtgctacaatgccattttgagcactttatattctaaaattctcacaataaaccatgagagaggtagttttattatccatgttcacagaaaaggaaactgaggcacgggtggttctgtcacttggccaaggctatacagctagtaagtggaagagctaggatttaaacccagacagtctggctccaacatcaactcctgtgcttaactacctttggaattacagcatatgtcagcaaacttccacattaccagtgtaattcataccacaaagcaattcactttaccttctagttgggttgagcctaggtaagtagccttcagagcttaggaaccataaataacaaccagaccttgtgctaacacatcttgaaaagcttgtctaagctttacaattgtaccagaagaagtaaaatacaaataggacagcatgtaccattgccaaaacaatctcccctttgtatagttttttcttctcaccaatttgttactatatgcaatactgactttaagtaaacaaacaagaagctacaaacaatacacccaccctcttttaattacagcactacaacaaggccactttgttaaaatggttcatctctaaaatatttttcttaccaaaaatgatacacagatacatacacactcatgtttccccctaaaaccccaatcctttttgtatgttgtgagtggagtgcagagaataaagctcctactgagtgcttttggccttcagatttggtgctcattactgtgtagacattctcagccagagcgcgacaacaggcattcagaactgtgttttctgcaatgtttattgtttattccacgatcttttgttgtttttttttgttgttgctgttattttacatgttggcatattaatttctattgctgttgtaacaaattaccaccaatttagtggcttaaaaaaacaacactcatgtatcatctcacagctctgtaggtcaaaagtccaagtatggcatggctcagctggttctctgttagagttgtacaaagctgacatcaaggtgtcggcagagctgtgttccattctggaagttctggggctaaatctgcttccaatctcatacgtgattgttggctgaattcagtctgatgtggttgtaagactgaggtccctgtctccttgccagttgacagctgggggctgcccattgttcctagaggtctctctctggttcctaatgtggctgctacgtctcagagccagcaaagcatgtttgatccttctcatacttggagtctctctctcacatctcttttgcttctagcctgagaaaattctctctctttttttttttttagacggagtctcgctctgttgccaggctggagtgcaatggtgcaatctcggctcactgcaacctctgcctcccaggttcaagtgattctcctgcctcagcctcccgagtagctgggactacaggcatgcgccaccacacccagccaatttttgtatttttagtagagatggggttttaccatgttggccaggctggtctcgatctcctgacttcaggggatcctcctgccacggcctcccaaagtgttgggattacaggcgtaagccacggtgcgaggctagttctgtttttaaaggactcatgtgattaggttgggccccctcagataatccagaataatctccctatggtaaggttcataaccttaattacatccgcaaaatcccttctgctatgtaatgtaacaaattcatagtgtttagggtgtagatatattaggggaccattctgggtaccacttcaggtgaacatttctgtgccaagatggctaacaggggtgaatgataatgctaaatctgccccaaaacaacaaacaacaacaacaacaaaaccaaaagaagaatttcactgacattaaattctaaattttacccatttccagaagcctttaaggtccaagaaacaggataaagatcagaagtgagttagggactaggagtagaaggtctttgatattataaggagcataatgaattgctctagaccagcatttgtgcaagtggtagctggaagaaaccactgccagaaacagagtgacttcagggggcttaaagagaatacaggaataacagcaaatgtctactcccaggaatgcatttctataacctgaaataatactaaaaaacttttttttttttttttgacatggaagaacactggtgtcagctgttaactctctagtggtggaatcttagggaggccctgggatcttggagaggggcaggggcatccagggagctggggcactccaaggaggggctctttaccaatgggtctggaagcacatcaatattttaacaatgggtaagggatgcagtaatatttataacactgaatattggaaatgtaatccaataacatgaatgagagtcaacacgctcacttatagggaggaacactacagcacaaatacttttgaatttcaacatttcataacgtattgatagattgttatttattaagcagttccacaaatactgaacattttgattaatttcactttttgtattaatatagatcatcttcaagtagagaaatgcatgttaagaaaattgggaaaaatgcaagacatgatatcagaaggaacacatcacccacctgagagtttaaccctatttgcctttgcatcactttctcaattctcctaaagtgtcaattttgttatttgctgtctgccttaaggggactgtaatttagctactccattttacgtctttataattctttcttatctcattcatctccctttccatttcatctttggtttttcactttgaatagcctttcatatatttattttttaggtctttagagaccatttctttctagtcaaaggtagggtaaaatgaaacataattttagtcatacttaattagacttttaaatctgatggtacactctgcctgaagcttttcaggggggaatttctgaggtccaattacagggctagtctcataataagaactaataattcataatgaaattatttgcttttaaacctcatccagacgctgttgtgaaaaatatactaacccaaccacattcctatagggtcattaacacggccagtacaaacaggtgaggtctgctgaagtcatagttctcagagcttctgtgaagagctggatgttggttctgtgacagtatcactacagggcaaccctttcataccagtcctttcatagtatggcatcctgttcttgatgtatggattttgatatccttctcagctcaggtaaatgcccaatgggtatttaacaaatatacaaatagaaactgaatccttgcatcactaaactttgtgttgccttcacacattaagacaacttagctgaaaataaagttcttgggttatagacttagcccccaacaaagttgtagaattttccctattctcctctggctttggttcaacaagagagaagtctgaggccagcttgattttctttcctttgtgtatagctttaatagaaacgtattttatccttgtaggttcttttctttctccctgcaattcaaacatttttccaaatgtgctccacgtcaatctttggagtgaattccatggattgtctcccctttcaccttgtagcacaacactgatgttcttcaatctaccatctatctgataagcaaattcctttgttccggtctcagtcactggttccactgcaggcccacatcacaagcagccctaagaatgcatctcagggctcctgtttgaaatcctgacacagaagaacgtactctttatctgagtatcctgcagggcagatgtgaaacctggaactactgtaaccgctttgccaatgaatgaaaacagcctttgaagatgccaagacatagaaaagggaatgttagagaaatggagctgcagcttctggattaagccaaccctgatgctcacctatctctggaatcaccgtttatgtgagtcaacaagttttttattctttagtggatccagaatgagttttctgtattcacagccctgagcatctcaagtactaatgtctctttttaatgattttcccccaaatattacaggatcttttaatttgtgtactcaagtttttcctcagtttaggaacatgtttctttaattatggcttttattactgcattttaagaccatcaatttcctttctcttttcgtatttagagacagggtctcaccgtgttgtccaggctggtttcaaactcctgggcttaagcaatccccctgccttgacctccaaaatgctgggatcacaggtgtaagccactgcacccggcctcaagatcatcaatttcttaggccagatttctattctttatccttcatgtttgtcagtttctcaccattttataaatcttttttccttttttctcagtattttgtgagaacttccaatatcatcctttatgtcaatggttccatttcctacagtattaattctatgttttactgcttcctatcagattttaactgtgctatatactcagtttccttacaattccacttatcattggtctctccatctcagattgctgttttcacattttagagtgttcaattcttgtggctttttttttttctgttttagagagtatgtcttctagcattcttctcagtctactgacttttagaaattttcttctgatttagctaatcactttcagaatttttttctttggttttttgagtcttttgggaagtgttactttaccctatctagtagtattttttcaaaagttacaatcattttttcttttagatagttgtttttcattttctaagaggagcaatctaaccagacaatttgtagtcaatgcaatgtagacattactttgaacttattctgtaaatatttaatggtctctgagtagcttagatgtttatatctaccatgtttcttctaatattactcttatgtctctgtccccacttactaaatatcccattcttctcacctccagacccctagttcctttttgcatgtatgtgttttctggtatttgaagcgtcttacccgagagagcaaaagatgtaatactgtggagtaggtaagacaacagcactatggagctctcaacaggaaaggtagtgggaagagctggccattttctgaaccgaagtcaaccttgtgtttctgaaacaaggggacttgagggaggggaataaagatctacctatttccaggtgcacataacaaacctgtgtcaccaaatggatatatatatgtatatttttctgagacagaaaaaagcctgtcacccaggctgggttgcaatggcacaatcatggctcactgcagcctcaatctcccaggctcaagctattctcctacctcagcctcccaaggtgggactacaggcacgtgccaccatgcctggatcatttttttttttttttttgtagagacagagtctccctatgttgcctaggcttgtctcaaactcctggactcaagtgatctgtccaccttggtctctcaaagtgctgggattataggtgtgagccattgcacctggccaccaaatggatttttcaattcagttctggctaaatgaaaattcttcctataattttgataattatttcactgccagtcttagttttttaatgctggatgttttgaggggccagtaggtatcactttaaactaaaagctcccaatattttaaataaattttgattgagggtttacagaggtaaatgcaaaaataagctgttaatatgcaatctgtaaaaaaggtactaggttagagaaaaaaatgaaacatgtctaagttcagtgctgtttttaatcagggctgtatgccacctaacagagtgcctttgaaaacaagtttattgcatgctgatgcctagagaattcaatatgactctgataagcaaaacagataaagcaattggcttccaaattacttctgaatattgaaatattagcatgtcaaattattacaattaaatggttgggcaacacagtgcaaacacatttggcacgctcttgttgcccaactttcaaagtattggatctcctcccaagttttagactgggaatgtccagcaaactctgtgccagtgataagagaagagctggtagtatccagttcagttcatggtaaaatctaatctccactagaaatctgccatcttgaattgtcccttgcaatgtttcaattagcaagtaagtacaatccatatgtctgcagctgtctgtcacacctttctttttcctgttataaaagtgcatgtatgtgcatttgcacatacacacacgctcctaagcagccaacaactcttaaacaatcctatctatgagtacattctaatacctgtaaatttaatttggcaagcaaaactggagcaataaatcacaaacccaattctatcatgtatttccagagaaggttaaaggcgaaagaccatgcggaatgctctatatttcctatggttaaagtgggagggagagaaggacaaagggagagagggaaagagaaggaagagaaggaggagaacaggagcgtggagggagggaagaagagaaagaagatgaagggaggggataaaagaagctaggtaatatcttttatttctgtaagaatatacccaatgtttctcagttaaaccaagtgctgggtcttatcagacaccagctccttcagccaccataggaacaccagatgggaggtagatgctcagcgcaaaacaaaagagcaagggtatcagacagccacagaccactccacagcaagggcccgtatggagttacttggtttgtcactaccccctatcattttagtacaagacctagtagaatcttttgacacatcttactatttgttgtaatttagcgccttggttgtgtttggtgggaaattatgtaggcatacaataaaatctcagcaatctacatttacctgaagttatttactatatttattattgtctagtaaatttgcataaacacaataaaacaaatgtaaatgttacaccacactttaaaggagttaccaaggccagactcaactcagattggaggtccaagccccagctagaataattttgtgcaggtgtggttctttttattttgtagggctatgaagtacctcctgctcatgagaaaaatgagatggtaagtttgccactgactaaagattagactggtaagaactgactttccatccaggacacaattttcctttagagttggccataaaactttcattccagaggtgcccaccctacacctggaggataggagcattcttatctctgaagacccggggacacagaatgcacctgaacaagcaggccttgccaggtttcccccagtttattaccattagatcatacccttggtcttccggccacacttctgcatgactgtccataaaaatgcacagttgtctctgtttctttgggtcttcatttctgaaggctcccatgtcacataaaacatattaaataaatgtgtatgtttttctcttaaaaaaaaaaagaattggctttcaatgtataaaatagtgactgtctctgtgttttataatcaaaagtgggtggcttctggacctcaagctgaatattttcatctgactcaatggctgaaagatgtgaccaggtagacctgagactttatgaccaggtagacttgaaactactagtttgattattttcctattgtaagcagctgatggaaaagcttctagagttattccaaggagtagacctagaaggcatccaaagtaatgatgcatgagcactggtgactaagaaggaaaaatgacatgaagcacctaaattctgcctggaaggaatatcataactcaatatacattattcttcaagcctaggcacttctgaaattctgtagaataatctttgaactgcctgtgcactggaaaaaaactggtctgaaaaactgcttgggatgtgatctgagataatttttttttaactgacaaaatgaggttgattccttccctatcactacccaactgataaaaaggaaacccacagtgaattttacagttgaaagatgtctcttatgcatcaaaccaaacttaacaaaagttttataaaattaccatattcacttatgttttccacttaatatttttgacacagtctcactctgttgcctagcctggaatgcagtcgtgtaatcatagctcactgcagtctccatctcccaggctcaagtgatcctcctgcttcagcctctgagtagctgggagtacaggagcacatcactatgcccagatgatttttttaaattttatttttcgtacagacagggtctcaccatgttgcccagactggtctcgaactcctgagctcaagtgattctcctgttttggccttccaaagtgctgggattacagatgtaaggcaccatggccaacctccacttgatattgttttaatgtagtggtagaaaaggtagcaaggcttacataagagttcttttcttgctttactcttgacaacctttcttcatctttgagaatctcaatcctacctcccacctcaagctaaaaacagagtttagttgaaactttttgcagggtaatttggtttagctagcacaatttaaaaaatttgcatgtcatttgaccctgtaatttcacttctggaatttactgtacagaaatacctggacgaatgctccataaaataagcacaaagattttactgcaacactgtttgcagtaaatattgtttgtattttttgaccaaaaaacccctaaatgtccatcaagaagaaattaaattatgaaataaatgaactgacagttattaatctgtttaaaaatgagttaaatctctaggtactgacatattatgataaaataaagcgaataagcaatgtacagaagagtatcgggtaagcccatttctgtgagaaaaatttacatatgtacatgtgtacctatgtattttagcatttataaactctctctctttctctctctctctctctctctctctcatttgtaacaaggaagatctggaagtatatcgaggggactatctttgggagttttggagaagtacaggaaagacaatgttcacattttatacttctgtattaacattaggtgtttttacaaccagactatgttattttactttttcgtttaaatttttttaaaattaaataaaactaacaggcatggaaatctcctactttgatccttcgtacagcaatttttgtttcttaaagtgtcacgtggagtgaaagatcacagagacaatgaggctccccaggtgcaagcattttttaaagtaaggacatattgaggatgatccactagtgtcgataaacactttatacttgcaagtttgagctcaagcaccattaattcaggagaagaaggccaggcagctgcatcaatatcagcttggctggttttacatgcaagggccccaacatctatagcccctacacaaccagaaaagaagacaatgtgggacacagaagaatgagacttcaatgagaagggcactgacttattttctcccctcttcccaataaatggcaagttgtctctgtttcttctttaatttatccttttatttgatgacttagacctgcattgtccaatcagtacatgtggctactgagcacttgaaatgtgctgaaaaaagtctgaactgagatgtgctgtaagtgtaaaatacacattggagtttgaacagttagtaaaaagaaagaatgtaaaaatatctcattcatccatatatttatattcattacatgttgaaatgataacattttggatgtactgtggtaaaaaaaatatattattaaaagtaattcgacttgtttctttctacctcttaaaatgcagctactagaaaattcaaaaatacatttgtggctctcattacatttctcccagacagagctggtttatacttttatagatattccacatggcaatgcaaatgttcagaaaaaggaatagcagggtagagaagtaggcatgacacacacacacacacacacacacacaccacacacacacacacttttgaattcataataaggaagaagtggaagtatatccagggggatatctttgggagtttggaggggagtacaggaaagacaatactcacattttatacttccatattaacattagtcatattagacatagtaagagtttcagaaatgaccaagatatggctttctcaaagaatatcagagttggagtgaatcttggacatcatccattccagtgttttagggtctttttaaatctcagaagcccaatatagaaaaaagatgaaagcaagatactctgattaaagctgagtgtgggaacaagaagggccgagaaatctctggactatgcataggaagggaatctaagaactctgaagcacagtttgaattccatggatgtggtatttcagcctctccattttataggtaaagacgctaagttccagaggttgatggtttgccttcagtggcaaagctggtaggggtagggctggaacccattcttagatgtctggttcctaagaaacaacaccgtgctctgcatgacatcattgctgcacctatggtggacaacttgtgtgcatggaaagatagtggctcaggaaagtgctctgacataggtacagacacaatgctatggggctactgtaagcacagtacagtgcttcaggcctcttcgttaaagaagcagcttctagatttacctttgaaagatgacagaggcagctgggcacccaggacaagagaagagcaagggttctaaggagaaaaactttgaggcatgttttggggccaaaaggtaggtctctttcactaatagtgacatcttggagaataatatatgcaatggccagaatagagttggagccttctttcaaaaggtcttgagagccaaggatcctacaccagtcttagcaagattttgaaaaacagtgataataagaatattaatttatcataaatacatgaatgggcaggaaacagggagacagattggcaggttactgggtgactgttaaaggcagcctcaattaatgagatgcaggtcatgatggaaatgggccagattggaggggccccatggagacagaatccacaggacttggatacagaaggatgaagatgattccagggtgactctgaggacccagctggggggctgcgggatgagggttccattaacagaaaaagggaaggtaagagaagctggttagatgggttcagtgaagaaagggtatctgtgaggtggttggtggaagagtcagtccattaagaaactgcagtttggccctggagcccatctgagggtcatctatatcttatctagatagaattctttgtaaacacctaggtttgggagaagggagatgaagagccagcaaaggggatatgggcagaggcacccagaagtgtgctttttaccaacagtgaggacagggaggctttcacggagtgagtggccacaagattcaaatgctgcagacatcaaatgaaatgagaatggagaggaggctcctggatgcaatgatgaggaggtcaccatcaacctctaatatagcagcttaagtgtcaggaggactctgaagtcaaataatcctggttcaaagcctcttcttgggcctcagttttcttacctgtcaaatagggatgacaacagtgccccttataaagttattctgagattaaaatgaaattgtgtattttaaagcaccaaatatagctgaccctcgaacaacatgggggttaaaggtgctgaccccctgtgcagtcaaaagtccatgtataacttttgactcccctaagacttaactactaatggccgagtattgactggaaaccttaccaatagcaaacagctgattaacacatatttggtatgttgtatgtattataccctgtattcttataataaagtaagcagagaaaggaaatgttattaagaaaatcatgagaatgagaaaatatatttactattcattaagaggaagtggatcatcataagggttttcatctttctcatcttcacattgaataggctgagggtaaaggggaagaagaggggtgagtcttgttgtctcatgggtggcagagttggaagagctggaggtggtggaaagggagataggagagtcaggcacacttgctgtaacttttactgaaaataatctgtatataagtggacctgtgtagttcaaacctatgttgttcaagggtcaactgtacagagcgtggctcacagtaagtgtgcaataaatgttatctattatttttatgatgggaagggatgaagaaatgagcaagtgaagaagaagtggaggctacatgtagagacactattctttcaagaagtctgggcatgaagggaaggagaaagactaggggaatacaaaggggaatgagaatcttttccagaatggagagacaagggcatgatttgactcttacgaggcaagtcagaaagggatgatggatgaagtgagaacctagaagcagggtaggaacaagagcaagggttgagggagatttgccttgtaagcagggagaatgcatccttctcagaaactggagggaaggaaggagaaggtgaagataaagagaaatttttgaactgaaagagaaaaggaactcacttcgagggcttcactcatcttaattaactggagatggggctgaatgttgggttgggggtgtggaagtaggttggggcttaaggatcgtggggatgggaagagaagtgaatcctagcatggaagtgggtctcagaccaaaggaggggagctggaggggaggaaacatgcccaccaaaagcctagatgcaagtgttaaacaagcacgtgtgctctagttgctcttatttctgtctctaagtagagctttcttttcagtggtggaacatttggatgatgaagtccctaatgtacaatgtcatgagaagggagaagaaaacattaattctcacgggggtcactaaatgcttgtgtataggctgggggacagggagagtgcaagctgagtgatgcagctgctgagtcaatcaagaccctcaaactgctctgtctccacgtatttgcaaaacacttctgtcagtaacatttactcttactctgtagtgactctttgctggaaaatcatgggtcctgaaaatctccaggtcatgccattaggactggggagacaggagtgtaagaggattgcaaagagaagttgggaggctttggcggaactgtgcccccaagaagcagatagctaaaaacactgcaattcccttcttgaggggatagagcacctacagaaaaaggccgggttttagttaccttgaagaagattgtgagtaaaagtttggggaagaaaggaacttcttcctatgtgacaaggattccaagagtcagatttgaaaggagtaacagaagtagagagtcagcgaggggaggtattgggggctaagaacagggatgggaacatgggaagaagtaataaaccagcagttgttagtaagagggaagcaatggcttgggaagtaagagggaagaaagaatggtagagtggtatatgatatgtgatagaatggttagaagaagactaagcagataaaatctggtttgtggtaaagatcacagaacaggcagacctaggatatgagaatggaggtgccctggagtgggaaggtggaggaccaagagatgccgccacagggaaaggccaggtctggtggtggcttctcaatatatgtcatgaaaacaaatatatttttcaaattcatgttaaagtacacatcaagaatttaaaaaatcaggccaggcacggtgcctcatgcctgtaatcttagtactttgggaggccaaggtgaactcctgagctcaggatttcgagaccagcctaggcaacaacagcgaaaccccgtatctactaaaatacaaaaaattagctgggcgtggcggcatgtgcctgtagtcccagctactcaggaggctgaggcaggagaattgcttgaacccaggaggcggaggttgcagtgagccgagattgcaccactgcactccagcctgggcaacagagcgagactctgtctccaaaaaaaaaaaagaatttaaaaaatcaatattaataacattaccaaagtattaatttgttcttacttagaactaccttgtttgcattactcaaccaaaattggaccttttcctgggtaccatcttggatatttcctcactcataaaaatgctttttaaagagatcttcccagccaggcacggtggctcacgcctgtaatcccaacactttgggaggccgaggcgggcggatcaggaggtcaggagatcaagaccacggtgaaaccccgtctctactaaaaatacaaaaaattagccgggcacgggggcaggcgcctgtagtcccagctactcaggaggctgaggcaggagaatggtgtgaacccgggaggcggaacttgcagtgagccaagatcgtgccactgcactccagcctgggtgacagagcgagactctgcctcaaaaaaataaaataaaaaaaaagagatcttcccatttggctggttctttaaaggaagaaaaaaaaaacaaaaacagagtctaggaaaatatccaacaaaaggtaagaaatctgaaagtctaaagtgccctggtttccatgcacgtgtttcgacctaacctgaaatgatgggtttcttctcacaggctagggcgtgccttctggcaccctggtgttcaggtcagcttgtgaaggacctcatttcctggatgtcactagggagggtgctcaactatggggaggcaccaacacagtaaccaatgggaaaattggcaaggtagtcagtgacattttaaagacatttgctcactgaccactgacccacaaaggacagtttcactgtcagtttctcagctactggtgtttaattcatagaaatcaatgacgacaagcctagagaggccaccagacaagaggcaatatatgacaaatcaggaagccttgtttgtttccttctaacagtgactctatttgttatattcttcctggtggcatttggcatttcttagctatggattggcagagctggcaactcagaacttctaagaattactatctgcttgccacaatcttcgtattcaaagaaacatgttttattttcttttttcttcctttttttttttttgagactgagtctcactctgtcacccaggctggagtgcagtggcacgatctcagctcactgcaacctccacctcctgggttcaagcgattctcctgcctcagcctcccgagtaggtgggactacaggagcatgccaccacgctcagctaattttttgtatttttaatagagacgggttttcactgtattagccaggatggtcttgatctcctgacctcgtgatccacccaccttgggctcccaaagtgctgggattacaggtgtgagtcaccacgcctggccgcatgttttattttctaaatgtgcattttatgtgactttgctgtaacctggaaaaccccataactttcaaactacagacagttctaactaggattacaaggcaaccaatagatacctggggagttaatactgtgaatttattttgctgtatagttaaaaatcaatctatcacaaccatccaatcatccatccatccatccatccatccatccatccatccatccaatctcatcctttaagctgactagttggccactaaccaaatttataacaatttttttttagtattaaaatacaattcaatgtggagtaaggatgggttactctggatgaagaattaaaggagaaagataaaaaaatgtagctcttacccattttgtagaatacttctgtgggccagtgtgggcagttattaaacccagataacagtgacagatgatatttaaactctctggctctttgtcaaccatctgccctatgactctctttactgagtttatatttcctaggtatttcatttttgaacaaaagacatgcacctcttaataatatgacagagaattggccaacctttccaatacaggacagattctaaatcaaagctattaaatacatgtgtgatttgcttcttgaccactctaaaatatcattgctgctacatcacagtaatacacaaatcattacagaaaaaaatatggcctagtaggtcaaacaacagcaatggcagaaacccagcagagtagaaaaatcaaaggcgatcgagtcaggcagacatggggtcttggctctgtcatttgattgttgtatgcccatgggcaagttattcaccctccttgtggaaggtctagttcattatctgtaagctctggaaagaagtcttcagaataggggtttaagcagataatgcacatgaaggtgcccccaacccccaactgccaaggcatgggcctgtcacatgacaaatggtaactccctttgcttcttttcttctccctaggttatggaggatggtgagcctcgctgacacataaatgactattcctcaaagattttaaataaacaactaggatgcgacctctaaagaaggttaatcccaactgctggccttccactgagaaatcttccctctccaaaaacagacttgtcattatacccactcacagtactctacacttcttcacagcatttatcccacctctggttaattaactaattgtgcaggcaatggattttttctctactaggatttaagtcacccctctagaagtgggcctggcatacaacagtcactccataagttaattgtggactgaatggaacacttgttatagggtttccaacatgtgacatattactgttggtgacatgtgagatgatttaggggataaacatgcatgaactttctgaatagttttagtggttatatatttattctaatgtgtatcagacaaataaataaccggtcaaatctctgatttttatacacagccatgaccctcataataacgttttggtcaacaatgaatgaaccacatatgtgagggtggtcctaaaagattataatgaagctgaatgattcctatctcctagccatcttaacgttattgtagtgcagtgcattactcacttcacatgtctgtggtgatgctggtgtaaacaaacctattgcgctgccagtcatattaaagtatagcacatataattatatacagtacataatatttgctaatacaagactctgttgctggtttatgtatttactatattatacttttatcattattttagagtgtactactacttataaaaagaagttaactgtacaacagtctcagccaggcccttcacgaggtatcctagaagaaggcattgttatcacaggggatgacagttccatgcatgttattgcccctgaagccctcctagtgggacaagaagtggacaggcaagacagtgatattgaccatcctgattctgtgtaggtctgggctaatctgtgtgtttcttagtttttaacaaaaaagtttaaaaagtaaaaaaataaaaaatttaaaaataaaaaagcttatagaatgaggatataaagaaaagattttgtatagatgtataatgtttttgtgtttatttatttattttttttagacacaaggttatctaggctagggtgtagtggcatgatcctagctcactgtcatcttgaactcctgggctccagtgatcctcccacttcagcctccggagtagctagtactacagatgtgtgctaccatgttcagctaattttttattttttgcagagatgggggtctcactatgttgccctggttggtcttgaacttctaaactcaagtgatcctcctgccctggtttcccaaagtgttgggttacagtgagccactgcatctggcttgcttgtgttttaagatgtgtcattacaaaagaatcaaaaagttaaaaaatttaaaaagtttttttttttttttgagacagggcctccttctgttgcccaggctggagtgcagtggtgtgatcttggctcactgcaacctctgcctctcttgggctccagtgatcctcccaactcagtcttccaagtaactggaactacaggcacacaccaccatgtctggttaatttttgtcttttttgtagagacagggtttcgccatgttacccaggctggtctcgaactccagagctcaagcaatccacctgcttcagcctcccaaagtgctggcattacaggcgtgagccactgcacccggccaaaaaatttaaaaagtttatgaagtaaaaatgttacagtaagccaaggttgttattattgaagaaagaaaaatatttttagataaatttagtgtagcctaagtgtacagtgtttataaagtctacagcagtgtacagtaacatcctaggccttcaattcactcaccactcactcactgactcacccagagcaacttccagtcctgcaagccttattcatgataagcattctatataggtaaatcattttttattttttataccatatttctactgtatcttttctatgtttagatacacaaatacttaccattgtgttacaattgcctatggtagtcagtatgataatatgtcatacagattggcagcctaagagcaataagctataccatataacctaggtgtgtagtaggctacaccatctagatttatgtaagtacattcgacaatgttcgcaaaatgacaaaactgtctaacaatgcatttctcagaacataaccctgtcgttaagcaacacatgactgtacttttgtttaggatgaggctaaataaaaaagtaaactgacagagagtagtaaaaaaaacctacgtaaataatagtaccagtctcataagaatatggcaaaaacaatgaaggtgataaagaaaggacaaaatttggtaactactgccttagcatcaagtgggtacccagagtttagaagttcaagacaaccagggcagcacagtgagacccccatctctacaaaaaataaaagatgctaggattccctgatttaggattagcctaaagcaatgaatgagtctgctttaagagcctatggcttgtgaagtctcaactgggtcaatactgaatcaggagtcaagtcagaaccaggtcaagctggtgatggaccccagaactcatctggcataagtaagaagcatgacacatggatatctggggggtatcataggaaataccaaggacacagggtagccaccctaggagggatggtatgattggccttgattcactctcctttcagccttaaaggcatatgaacctggtttctgatactgcttcctccttcaagcaattatttctcaaattactatttttgtgcaaggcttctggagaaagggtactttcttatgtgcacatttgaagtgccaaaggatctctacccaatgtctcacttttccagcaaactgaagcagactgctgccactatcatcaaaggaaccctcccctgagcctccaatatttgagtcctacttctcagtcccaatgctgagatggagagataagtattcctctagtcttggattggaacatagaatgaattttcccacagaagaaaaaattttgatgaattagcacaatgggtgttttgtatatgttccaggtcgtagaggattctgcaagctaggcttggaatccagtgaccacttatcacttcagtggaaaatgcttttaacattttaaaataaaatttgttccacaaatggagattgcctatacagcaaattccttagtagtgaatacttaattctacatatataaaattttatctttcttttaacatcttaaaaaaattgacttttagcatcaatcatgactagtattcaagtctgtaattgttgaaggactctgtctttacagttgagactattctagacacataaagataattccaataagcatttctgtaatcaactcttggctgtaccgagttattcctgcgatgaagtagaatgactgtcttaactcctactctgctctattgacagtaaattattcttggttctaaccataagcctttaacccaatgtcttctacacttgttggatgaaaagaatcgctgaaggtacttttaaaaataagaattcctggccccagcccagtaatgaatcagaatctcaagggagaggcctgggagccagacttttaaagactgcccatccctggtcatactgtcatccaacccaggggttcttatcctggaggctgtattaggatcggaggacttgttgaaacacaggttgctggctcccagcccaagaacttctgaaccaataggtctggggtggggcctgagaatttgcatttccagcaaggtgcctggtgatgctgaggttcctggttcagggaccatactttcaaaatcactaatttagcctgtttggcaaacactgcagctgatttcagtattactttttctccccgctccttgggaaaaaagcaacaccagaatagaacttgcaagcttcctttggactcatacccctgctacttcttagctgcctaatgttagacaaataaatgtaccactccatctcagtttgttcttattggtaggactaagaaaggtagcataaaagaagaggtttgacactatacttggcacatggtatggctgcattaaacatctgtttactctgatctccttgtgatgatctcctatcctatgagccacagatgaatttgctgagtactagcaacagttccaaaaatttgttacatgcacaaaactttgtttggttaaaaccaaccaaacaacaagcaagcaatggctgaccacttcttttccttgtgagctaccatggagctacattttaaagatacaatgggaatatactgtttcctaacttaccttttcccatggaaataaaaatagaaaagaaaaaaaagattagattatgattaggttctctgtttaatttagactaggctgaacttagtacccagatatggattattttcctggcagatctttattatattatttggctatttcttgtgacctgaaaatcaaacaaacgaatcacatgctctcttagagggaacttagagggcatctagcctacgcaccaaccctataaatgctactgaaacatcaccaatgtgtggaggtccagcctcttcttagacacacaatgaaaactcactattctcacaaaccccaatccactcttcagataactgtctaatcattagatttctaccccttttaacaaaaatctttctttttgtaatttctgtatccttggtcttgtttctgtcctctatagtacctgaatatatctaatctctcctgtacacggcagcatttaaagtgctctgaagtagcactgacatccccactgcctattctttttcagcctaaatattgtttttttcaactattctcactatcaaaattccatcaaaaaagttttcatacacttaacagccttggttctcctcctatggataaagtccactttgagatatttcttcactaaaaaaatgcgaaaatatgtgttattttcaccatgtcctatcatcaccagtaaaacaatgtaacttataagaacagtggggtattccttcccaggcagagtttccagaagctgcaagctacagtcatataaaacaacactgtaagcactgagaaggcggtttcaggacaggcttgcaagtggtagcctggggtagatggatctggccatcatgacccctaatgatagaaatgccatgctgccactcaaattcacaaagatccacagtctcttttcaaggaaagcagagtgaaacaaaatgtatttcttactttctacgaaacatttctgcaaatatgcagccaacactccagagatccacgggggtggcgtagctggactggagcaagacttcgggtgctctgtaccacagcgtgacgacctgcaatggcaagcggatccaagtgttactgagaaggtggctgttggcttagactcctgactaaacctggtggtttaatgacaagatgtagttcagaaagaactcctataaatcatataaggacactgcgctagaagcaataggtaaataggactcatcactgacaggccaggaaattacatcatccccacaaactgggttcccacctccaactctatgtctaactaggatggcataataacatgagtttcagaaagcaaagaccaaaaaaattttttttaaacttagaaaccgttttttttctccccccctttaagggcctttaaaaaataatacatggaaaacaggtgatggcaacaattacagctcaatccccaggccagcattattggcagattagaagatgatggcatacagagtggtgtaatggactttggagactcagaaagggggagggtagagaaaggggtgaaggagaaaaaactacatactgggtaaaatgtacactacctgggtgatgggggcactaaaatctcagacttcatcactatacaattcatccatgtaacccaaaaccacttgtaccccaaaagctgtacatatatatatatatatatatatatatacacatacacacacacacacacagacacatacacacacacacacacacacacacacacacacacacacacacacacacacacatatatgaagatggtgccagggctgctggatggtgtccctgaagtctacacaacacccaggacatgtcaaaactgctcttaccgtgacagcttggggaatcaaagtaaaacccctctccatgatgctcttttcagaaaacaagtaaaaagtggggaagaacttaagagagaatgtgtaacccaattgttcatatgatgtgtgaaaaagccaagcagaggaagggattccaaaaagacaagaaactcatttaatacagagcagcgtatagtaatagatgaaacaaacacaacaatttttcctgccaggttgagggctgaagaaagcatatcatgttaaggctgcagatttgagtacatagggggggttcaagtgattccttttgtgggggaaggggcagatagtctatggataccctgggaggtgcattctttattgtcagataaggaattcagaatataaatctattacgtcagaattttatattattcagatcccttttatccttattgttttgtctagttgtattattatggatgtctatctaaattttctaaaattctgctttatatattttgatgctatattacttggtgtgctaagattgcagtagcaagtctcaataaatggcggctgccatcaatttccttctctccttatttgcacacactgttgctcgtatcaagggatggattttattcatcttccattgaatctgagttggccttagtgacttacttgacctacagaatatggtagacgtaatgtctgagactaccaatgttaggtcataagaagcctgagcctaggccttttctcttgagatgctacctcttggaacccagctgtcatgctgtgagaagcccatgaagatgccctggttgacagccccagttgagctctcagctgaaagcctgcgaatgagccatcttggacattcaagccaactgacctcccatataactgcagtcccagacaatgtcacacagagcagaactgccagctgagtccggtcaactgacaagattatgagtgataataaaatgaccgttttaagtctttagatgattatatggcaacatcaaattggaaaaagattcttgacaggttccccctctatatctcatctaacatattttgctttgaattcacacatgggtcaagttttgtttaagtaatactggttgatatctaatggagggatggttgtgatataatagaaataaaaaacaaaacacaaaactgacaatactgaaacaatgttactcaagttaccatttggccccaacatatctttctatcaatgcatcacctcccagagtattttccatcaatgcatcacctcccatagaacttccatagcctttatatcctagtcacatctatactgcaccactggtttttaaccctgcctgttcatcaaaatccccatggggttttagaaaaacttaggtgtataggtcttatcttgtgccactgaattagactttctgtgggctgaactttttgggttggagttttcctcttttgttccttcctttttttttttctttttgagatggagtcttgctctgttgcccaggctggagtgcagtggcatgatctcagctcactgcaacctccgcctcccgggttcaagcaattctcctgcctcagcctcctgagtagctgggactacaggcgcacgccaccacacccggctaattttttttgtattttagtagagacggggtttcaccatgttgctcaggctggtctcgaactcctgagctcaggcaatctgcctgcctcagcctcccaaagtgataagattacaggcatgagccactgcgcctccccctttcttctttttttttttttttgagttcttcaactaatcctcacccttggctatgtttgaacaccactagattatgcaagcatatcccatcgctcttgtctccatgcttttgtttatatcattttcctagcctgggcaactcttctttctcctctccacatatgtaaatttcacctattctacaaggcctagcctagatgccagcaccaccctgttgcagcaccagctgctatctgaaaatcataccttgtaacatagctcataatatggtttgttcctgaggacatggccctgccttaatctatgtttatatctgtaaatgcctatcacagtactgtaaacacaacaataagggcttatacacctatcaaattaatccttttaaggcaatcattcctagaaagataactgggcaaaattcaatgaccagtcatttccaaaagggaaggtattgtttttgctaagaagagtgtccaatactggggtctagttttagttacattacttgtttctgctttattaatatttctagctggaggaacacttctttgcttccctgacacactgtaaacaaaactgcaggtgcaaactgtctgtaaggttccacttgagtggttgacagaaatacacagatatcatgaaggcacacacttatctttctacctcaattcaaaataaagtctagcaacataaaaagaaaagtttaatctgaatacagccttattttaagctgttctaaggaaaatattatttctttcttttttctttttagacagggtcttgctctgttgcccagactggaatgcaatggtgcgatcttggctcactgcaatgtccaccttccaggctgaagcgagtctcgtgtctcagcctcccaggtagctgggactacaggcacacgccaccacacctggctaatatttttgtattttttgtagagatagggtttcaccatgttggccaggctggtcatgaactcctggcctcaggtgatctgcccacctcagcctcccaaaatgctgggattacaggtgtgagccactgtgctcagcaagaaactggtttctgattgattacccatcctaaaaaactttagtaaggctgactgtcttcattttcaatacttcagtcagttatacctattatgataaataaatgtatagacagtcaaaatcataataacaatattgatatgttagggaaattccctctattccttttaaaatttagttaccactcaaaatgtagaatgaatttttatcaaatgctttttaaaatgtctattaataatgaccatataatcatttgcctttgttttattaatgacgtattagttacattaacagatttcccaatattgtagcatccttgccttcttggaataaatcatttctgattgtgtattattcttttaagacactctgaaattctatttgctagtatctattcaggatattgacttatattcataaatgaggctgatctgtagttttcttttttgtgttaatttttcatgttttgttatcagggatattcaagcttccaatctttattatattctggaatagtacaaacaacagaagaataatcagtttcttgagggtcaaacaatctcgctcatagagctgtctggatctttgttagcagtgtgtcttaacggtcttttgaatttcttcttggtaattagtctgctcagctttcaacctctttagaagccaattttcgtaatgataaaggattttcctacgaacattcttaatctagatttaaaaatgtattgacttaaatttgaacatagtatttcttataatcattttaatttcatctgtttccttggttatactgattttctttttcttaatgttgtaaatttttgttttctctttatatctgtcaggtttgtcagaagtttagccatattatttatataaaaaaactgacataattttatttccattttgggaggattattgttttattttataatttgttgatttctatttttatcttttaaaattttctcctaatttctttgttgttgttgagtttttttttgagttaaaatttagctcatttcttttccattttaattaataataaaatgctaactacatatttgtagataaacttttctcatttttgctcatctttaaatactatgtaatttatctttaatttagaaaagtgttttaagatgtccatatggtcaggttatttatggctatctttgaatggttgaatttctacttttattgaattacaacagagactatgatctgtacaatttctacttggtaggatttattgttgttttctttaaaatgatgtatatacttggtttttgttctgggagtgtaatggaagtactgtctttgtaaagttctttattgataagggtttgtcttatataaatccttacttatatttttctatacttcatttgtcaaactctaaaagagagttgagtttctgttttccttcccccagtatctcaaatgcaaacatagataatggtttataaggaatataaatataatctttgaaatacttcagaatctttattttgtcaaagtgaaggttttctaaactgtgctctaatctgtttatttgcatcagagcaatacaaaactttctaatacatatgtttttctccctaaagaaaactagtatggttttgtgaagtgaaaatcaaaactagtgataatttcactgacttttcacagagttgcaaaatttacaactctggtgggcgcttgtagtcccagctactggggagcctgaggcaggagaatggcgtgaacccgggaggcggagcttgcagtgagctgagatcgcgccactgcactccagcctgggcgacagagagactccgtctcaaaaaaaaaaaaaaaagaaagaaaagcgtttccattactttccagttctctatatgatatgacatctactcatcacttcacatttaataagttcaatgaaagctaaaatttagatatctcgtttttatccttaagattttgctctagtctgtgtaaatcattgtaaccaagtgagagtgaaattagactaactttatgcttacactctattttaaactatcaacatctgtctaaagagacatcatttttggttcaatctttgaggaattcaattccaaaagaaagtataaattgttcaagacttacatttctagttaattctctaataaaataaccccatcaatgacctgggcctacatttaaaaataacaaactactgggccaggcgtggtggctcatgcctgtaatcccagcactttgggaggctgaagcaggcggatcacttgaggtcaggagttcaagaccagcttgggcagcatggcgaaaccctgtctctactaaaaataaaaaaaattagccaggtgtggtggcacacgcctgtaatccctgctaatagggaggctgaggcaggagaattgcttgaacctgggaggtggaggttgcagtgagattgtatccctttagtctgggtgaaaagcaagactgtctcaaaaaaaaggaaaacaaactactatattttgcaatagatataaaagaatagcattttctaatagttgtttcctggtttatgtaatattattctatatatcaagagagcatccccagttttaatttgttaatttacttggctgttctataatttctgaaccacagtctttcagtccctacattaagtcactgaaattttaattatctcaaattatgacaacttctgtaatttcataggatttaaaatatctactgcaactaaatctggatccaagtttttgagaacaaattgcaacaaattttcctgacagtaaaatataaattccctttgcttagacattattatacttctgtgcctctaaaaacttctgatggaagactgctgaacttaaaaccagtttaagtcatgcatgagcagaagcttatttttatttgaaagctttataaagaatgaataatatcaataaaattgtttcaaggttttagctcgtgaaagttctcaacaatataatcaattctaccagaagttctgtttaataattctaaatatccttaaaaagaaaatataatggtaaatttaaattttaaaacatgttgaggaaaacaatgagtgcaatatataaagatcaacatttagaaatccgtaacaaaagtcgctactaatggtaacaatgcagttgtctagtaagcaaagacaataggaattatggacagagtttggtgattggagccagctggaaccaaagcaaataccatgtttattacaatcattacatgtattaacagcctctagaggtgctgaatggatgtggcaacaggagggggagcggaaggcaggggggagttcaaggatatttacacaagtggatgtatctgtttaaactgctttgatctctattcacatttttttgaacctgttcaataatagtataagaaaaagtacagccaaggccaactctgacttaaaatacatttcagagtaaaccgctctcacttgatgttatatttaacaatcttttatcatgtaccctttcaccaaggtcttgaaaaaattagatgttatctgattcatcctcattatatggccacaatggcagaaaagcatggtatgaacactgtgctggatgtcttctttttgttgccccagatagtctctgccctagaaatggacctgtatctgccatatgcctccagtttcttactggctttggccaatgggaagtctcggcaggaattcagagagaaggagaagcatgaggtcaggatcctcaactctttgattttcctcccagcaaagctgtctagaactgactgtgttgccaccacaaagtcaatgtccatctcaggaagcctgctctacttgctttcttcctcctggattccagtaactgcttcccctcttcttctagggcctgggaatggtaatgaactgactgcgagtaagactcaggtcatagcaccatcccctgagttcccctaagcccacatctctgcaaatcatgcctgtgtcaagaaatccttgaactacttgagtttgagtgtgccatctatttcctgttgggaccctggctgatacatcctgtttatagatggagaaaccagcgtgggtggcaacttcttctccaagtttcagttttctcatctgttaaagaagatgtttggactgggtaatctataaggtgtcctctgttaacattttaagactccctaaatgatatggcaatggcaatgaagatttaaaaaaacatatatactttatggacccaacaacgttatcgttaaatatctttgctgtcctttggtttagtaattacttatggagtgttccagtgtggtgatattctccttctcgggcccacttcaacaacatgtctcaaatacaaacatagataatggtttatcaggaatataaatataatctttgaaatacttcagaatctttattttgtcaaagtgaaggttttctaaactgtgctctaatctgtttatttgcatcagagcaatataaaactttctaatacatatgtttttctccctatagaaaactagtatggttgtgtgaagtgaaaatcaaaactagtgataatttcactgacttttcacagaggtgcaaaatttacttcttttttttttcgagacagagtgtcactctatagcccaagctggagtgcagtggtgtgatctcggctcactgcaacctcggtctcccgggttcaagtgattctcctgcctcagcttccccagtagttgggattacaggcgtgcaccaccatgcccggctaattttttgtatttttagagacagagtttcgccatgttgcccagactggtctcgaactcctgacctcaagtgatccgccctccttggcctcctaaagtgctgggattacaggtgtgagccatcgtgcccggccataatttagttcttcaaaattacatatttaaatgaagaatattataaagaattggaattctaattctgccaagcacagtcttctcattataacaccttaactggttatggaaactattaagaattaaatactggccaggtgtggtggctcacacctgtaatcccagcactttgggaggctgaggagggcggatgacctgaggttgggagttcgagaccagcctgaccaacatggtgaaaccccgtctctactaaaaatacaaaattagtcgggcatggtggtgcatgcctgtaatcccagctattcaggaggctgaggcaggagaatcgctggaactcaggaggtggaggttgcggtgagccgagatcacaccattgcgctccagcctgggccaacaagagtgaaattccatctcagaaaaaaaaaaaaaaaaaaaaaaaaaaagcattaaatacccataaaataataatggagtcatctcaaattcacccatttgtaatctaagggctagaaggagatgttttgacatatggcaaaaaaatgtctgaggtcaatacaaagatgagagtctcacagcagggagcgctgtgccaataactttgtcctcacctctgctctgatgcatccattaccagcagaagggctgtatttcctcacatctacagctgccttggctcacatggggccactggctccctttagatatgtggatgtcccatcacctgctattgctggtgtggttctctgattctctctctgggattctctttctctgagtctctgcaggtccagatcctacccatctttcaagcctcactcacatattgcttcatccacaaagcctttcctgatctcccagctggaagtaatggctcttctctgagcttccactgcacttctatagtacttgaccctttctatcttgcattatagcttttccatttcttggccacaatacatttacagtgtcatgcatggaaggtgctcagtaattatctgatagctagatacatcaataaccacaggaaactcccagtggcagtgctgaagatggatagaggcaatcacctagactggagaatatgaggacaatactgtcccataataacttaatatctttgagtaatcatgtatctttaacagaggaaatgatcctgtggagggaagagcactacctgattagcttcagagattgtgtaagaagactcacagggcaatgaaaggcacagggaaaatgagctgaatgggtgttccctccaagtagagaggaaaggcatcttgggggaagagagccactcagtaaacaggggggctgtgtactcgtgtcaggggagggatgaaaatgactcactgaaggaccagcaaaggtagaattcagggatccaggtttctgaccttttgtgatatcagtggcacttgccatttcttactgagtcgtacacctctcccccattttatctatgtctaagcagatctacctacaaaaggcctagacagcaagcctttaggtcaaagtaagcttccagtcaattcatcatgtgaatgtctactctgtgaggtaccatgttagtcctggacagtgtggtcgcaaattaggaaagcaatgagttaaatgagttggctgaagtacaactgggttggagggaggggtggtgtctgtgtagcaatttaagtgcagaatgctacggtcctgtcctagtgttcctcctgcctttgtctcttttaaattattgcttaatctaaggcgacatcctcaggcagtcacttttcttacatgaagcacaatccttgtggagcactccatgtgcctgtccccacccccgctccaatccatgctgtattcagaactctgcagtctctgacccacaaatccaactgtctcccggacatcactacttagtgctgctaccagtatctcaaattcaaaatgcatgcattgtcattcctctgaaacttgcttttcctatatttcttctctctgtaagcaaaatcgctacctacccagtttccctacttctcttgactttcaatgaagccaccatcagatcccgacaattccatcgagagcatgtcctctcctggatggtccaaatagcttcctctgtggtcttttcctgccaacatgccccctgccactctgtcttctttactgcatctgaagctgtgctcaccactctcctgcttaaaatccttcatccattctctggagatttcagggtcaagctcaactctaatttacctccaatgctctcataatctggttcccacccactctctgccttcattgtctgttcccccttcagatgaaggctttctttaacttgtcagagaccgtgaggttctttaaacatgtgtgctatgtcgtgcctcatgtggtcttcccataggcccttctctggaatgccctcttcacaaccccattcttaattcctgtgaaccttgccctgcctagtcctccgcaagcataaatgattgcagcacttacattgcatctcaatcattgtatccttacggtctactaggcccaaagccagccctttgagggtagagagtatttctaagtggacttttaatcccagtccctcgcagagtgttgtataaagcaagcataaaataaacatatgttccaacaaatgtatgggtagccagaagacagcagaatggagagttacaggataaggagggataacacagggcaggacagagtgtttctattatagtataaattttataggccatagttgtgtccccatgtccacaccaggcattctgagagtccaccaacatgatctttagtcaacagatgactttttaataaagtgcaaggaccattttatttttgtaaaatgaagttttaaaatgcctgaagggcctatgttttccttcaggctgcactgtttaaatttcctcttgaactcgtgaaacttaaaatagttaccacttattaaacgtctattatgtttaaagtaacaaactcattctctttgtagaagtacagtatagtatagttttgattttgacactaaacaatcatacatttgatctccctctgctttcaccatagaaaccaagcaaatatttgcagacattccttcaaccttcacagataagtagaaatgaaaattattctgaacacaggatatggcaggctgcagggctcattgtttcctcttagaagttgttttaactcttaaggaaatctatttgctttgagaggccacattattactcagatttgtaaaagaatttaaaaattgggtttttccttgctatggaaacagtcaaatgcctctaaggtccgtgccttctttctcattggttactatgctccttttgacacaggttgcaagcaaacctactaaatgagtactagcaggttatatggttagtgcaagtgatgagggaaatggaagcatagttttaaaatccaagttcaggcacacacattcttcaacattttaaaattccatgagcactgccttccttaaatggggaggatttgcagattgtcaggtggaagcagtcatgaaggtatagctcattcagctcattctgcagtacgctctcctcctcaaacactcccatctgaaatgggtcatcgagatgcatgcaggaaaataaaaccagccacaacatttcccagtaatccaggctaccagaaatgaatttatagtctacagaggactgtggtggggggggggtccccactatattttgtgctttaagctattaaaggaaagacataaagaaaatatgcttctgaagattagggtgtttcatgctgttcatttagcaagattaaaactgcaaacagaaaaggaggacacatctgagagaaggacttagattgcagcattaggaatttgtgttagacagaaggaagtattttctgacaataagaactgttaaataccagaatggattactgtggggccttgtaatgttttctcttctctaaaacttttcatttttattttgagtgtaaataagtagggggctacggaaggagagaaaggaaacatttgtaaagcacagaagatgtaatgtactgcgctgaattaactttatctgttgtcttatataatcttcagtttaatggtgtgaggcgagtatcaacgactctatttttacagataaggaagctgagaatcacagaagagccaatggcagaaccaggatctgaagcaggtcttattgaactcaggttcattctcctcactgtggagtctaaatgacctcaggtcttttcttttttggtcttaagcctaattacaataaaaaagtttgtatttccagaatagtcaacatttccatagtaatgcagtttaccagaaaagctgacaaaaacaaaagaagttgtttttctaagataatgggaccccaagggatttcaccaagatagctgccagttgagggatcagggtcatggatgtgcaaatgactgggtcctggatggagggtagggaaggtttgcctacccacaatgttctgcacaggagccagaagtcgggcactgtgtgcacaggcatgtctatgctgttccctagatcccttccctgaagaccaggcatcacccttcctccctaacattttctccttttgtattctatctctgcaaatgagaccaccatctcaccagctgcccatgtcaggctcttcctcaaaatcacccctcacccatttatgcagatgtagtgtaaaaagggtgccttcttgtttacaaaaaaacaaaatgcacagaagactagagctgtggaaataggagagaaggaaaatacacaatttagggaacctaaatactatgacccaccattttctaacacagtcactaagcaacattaaaaaaaatcatattacttgacataagaattctttggttttgaacacagtgcaattgtatggactcgacgacattatctagattttaccatctgatttcaaagttgctaaaaaaaaaggtctaatatgtaatatgtgtcctagccctttatttaatttcctctttcttttataacacagttttgctgtacttactgaattttaaatgtcctcaaaatctaaaattcatttcatatctcttctatgagcagagatgaaagaaaggatcattgaaagggaatatagttctgttgattaaataattacagaatatatacattcatttgctcttaatgagccacaatgcttttcttaaaattgtctcagtttctaggaagaaccacactaataccaaggacttacagagtatttctaggtatatccgctgtcaggagagatacatgtgtgaacataaaaaccagcggaaggcttctcacctagactcagggactcatgctgcatgcgtgttgggggcagtgtggttgctgcatgcaaacactacttgaaaggaaaagtaaccctctgagtttgagtaaaacttggcttctaactcagaactaattcaaagaaacgctatatttccatttataaacatttcaaagaatgttactgctttctagaaacctgtggcaggtagcttcttttatcctggaaactgttagggctttcaaaatggcctaagaaatattccacaaaaattatagcataccattattttgcactaaactcctgcactaggccccaacagactggactaaaagttaaaatggagtcacttatgctcaccaaaccaaaactgggtaaatcaggagagacagagaagtcaaaagagaaagacagcctaatttcccaaacaggccagtttctatcttaaatcagcatgacaatgaagttccctctgttttaatctttacaatagagtaacttgaagtaacctgatgttaagcagttatctattgttctgtctccctgtcccttacatggacgtaactttgaaatgaccaagctgctttccgttcttttgtttctgctttcttctgccccttttctgtctataaagccactctcctttgtttgactaactggaacacttactctattttacagaatgtggtgttgcccatttctagaattgcaataaagccaactgagatctttaaactaaatttgttggaatcacagaagtgatcacagtgatatctaagaaaaacatgtattacatattttaactatcttttagtaactgaaagtacttttttctcatttatgtatttatttatttttgtacatgagtaagttctttagcggtgatttctgattttggtgcacccatcacttgagtagtgtacactgtacccaatgtgtagtcttttatctctcaccctcctcccgccccttccctgaatccccaaagtccactgtatcattcttatgcctttgcatcctcattgcttatgagtgagaacataccatgtttggtttaacgttcctgagttacttcacttagaataatcgtctccaattccatccaggttgctgcaaatgccattattttgctctttttatggctgagtagtatttcattatatatataatgaaatatatatataccacattttctttatccacttgttgactgatgggcatctgggctggttccatatttttgcaattgtgaactgtgctgctataacatgcatgtgcaagtatttttttcgtacaacttattttcctttgggtagatacccaggaatgggattgctagatccaatgatagctctacttttagttctttaaggaatctccacactgttttctatagtgatgtactagtttacattcccaccaacagtgtaaaagtgttcccttttcaccacacctgtgccaacatccatttttttttttattatggccattcttgcaggagtaaggcagtattgcattgtggttttgatttgcatttccctgataattagtgatgttggacattttttcatatatttgttggccatttgtatatcttctttggagaactgtctattcatgtccttagcccactttttcaaaggaatgtttgtggtttttttcttgctgattttgtttgagttccttgtagattctggatattagtcctttgttggaagtatagattgtgaagaaaagtacttttaaatcactattgtagatacttaaaagagaactctgacatatggcaaaaatagaagcagggcctcgtgataccctctgtgaaagtcttccagaatattctgagagacgaagcagattcctactccacactcctgcagtacacctctcttacagcccttgctgacatctggtgtgaccagaagaatctgcttccatctctgttacccccataaaattgaatgctacagtggcagggactggggtttactagctaatctttggatccccaatgcttagtgcaatatctgacacacggcaagcattcaatgactatttgttaaatgtatgaccaagaaaagtatcttttctgataaagaagttcttccaaatttgcccccaaactccaaaaaatgaactctgtccaaagcagcaaatcaaaacaaggaggaaaaaatccatgtgtttgtgtaattctgaaggtatgaaaagtgttctagattaacaactacggcaatagaataaaatttatacataatagcttaaaaaagatttcttgtaaagaataattttggcctctgttggcattggttcatatacatgtataattgcctaaggcatttatttatctatttatactgaggtgtacacaaatcttaacatgttcgatgtatctttacacatgtacacacctatataaacaccactcagaccaacatatagaatacttacatcaccatcaccacagaaggtcctcttgtatttttcctagcaataccattcctgcacccctatttatataaccatagattaatgttgctgctccttgaatttcatataaaggaatcatgtgttttgcttcttttgctcaagataatatgtaaaaactgtgtatgctgttgtagttatcagtatatagttttctccctttcattgctgtgtagtattccattgcatcattatgccagagtttgtttagcaattttttctgttgatggttatttctagtttttggatatagtaaaataaacattctgctttgaacatttttgtacatgtctcttgttggatacaggcatgcatttctcttgggtatatacagggagtaggcaaacgtttagtagatactaccagttttccaagtggttgaaccattttacactcccaccagaaatgtatgagagttacagtttctccgcatcttggccaacagttgatattcccaaccattcgaattagtgtgtagtggtactttctatacttttgactgaataatttgtattctaaaaggataatataatctggatttattaaagcactaactggactttcttggtaatgacagaataaatagtgtctgtcatttgtgactaacattttaaattgtcttaaactactgtgtgactcagtagttcaagacaactgtaaaatattaggctttttttctgacttttgtcccttctatgtcggacttagcaaactcccaactctttaagcatctgtttgtcctcctcttgaggtgtatagactacatatacatcacacacacacacacacacacacacacacacacacacacacacacacacacagagttcttagacaatttaggcattgaaaaagaactgaacttagtattctgaaatgtttgtttgaacattaataatgtaaacattttagaagctgttggatagtagtttttactagatttcttctatggacataattctgaaacatcattatacactaaacatagaaccatatttgtcagtttatagccctgtagcttagttaaggggcaaaccacattccctctaaagaggtcacgcagtcacatttccatttgttgtgagtcttcccattcacccacgcacagaatttaaaaatggggaaccacagcaactattttggcggagggaggctgaaggacaataatcagtgtacacatgctgccattttttccttgtagtttagaaactctgaattagtgtaggaattattttttttaagtcaacaaacatttgcagagtgctacttggtggccaacactcagtgccagtgaattctagggtatggttcttgcccttacaaggctcataggctttacaggtaaacgtgcgtcacaggggttcattgtactgattatttcatcactcaggtgttaagcttaatatccattatttttcctgatcctttccttcttcgcaccctccaccctccaataggccccagtgtatgttgttcccttctatgtgtccacatgttctcatcgtttagctactacttgtaagtgagaacatgcagtatttggttttctgttcctgtgttagtttgctaagggtaatggcctccagctccagccatgtcccagcaaaggacatgatctcatttattttatagctgcatagtattccatggtgtatatgtaccacattttctttatccagtctatcactgatggtcatttgggttgattccaaatacccataaagaaatacatgaatgataaagaaaatgattctttgctattgtgaatagtgctgcaatgaacatgcacgtgcatgtgtctttataatagaatgatttatattcctttgggtatatacccagcaatgggattgctggattgaatggtacttctgtctttaggtctttgaggaattgccacactgtcttctacaaaggctgaactaatttacactcccaccaacaatgtataagcattcctttttctccacaacctcaccagcatctgttatttttgactttttaataatagcaatctgatggtgtgagataatatctcttgtggttttgatttgcatttctctaatgatcagtgatgttgagctttttttcgtgattgttggctgcatgtacgtcttcttttgaaaagtgtctgttcatgtcatttgcccacttttttatcgttttttttccttgtaaatttgtatgtttcttatagatgctccatattagacctttgttggatgcacagtttgcaaaaattttctcccattctgtaggctgtttactcaaaagaaacatgatagtttcttttgctgtgcagaagctctttagtttagttaacttccgtttgtccatttttgcttctgttgcaattgcttttggagtctttgtcatgaaatctttgcctgtgcctatgtcctgaaaggtattgcctaggttgtctttgtgggtttttatagttttgggttttacatttaagtctttaattcaccttgagataatttttgtatataaggaaggggtccagtttcaatcttctgcatatggctagccagttatcccagcactgtttattgaatagggaatcctttccttattgtttgtttttgttaggtttgttaaaaatcagacagttgtaggtgtgcggttttatttctgggctctctattctgttccattggtctatgtgtctgtttttgtaccagtgccatgatgttttggttaccgtagccctgtagtatagtttgaagttgggtagcatgatgcctccagctttgttcaaaaagaaatatttaattcagcatttacaaagctgaatgactttctccccctcacataacatctattaacattctacagaattagtgatccttggaaaacgagttgaaaagcactactctatgacaacgtatggggttgagcacaaataatctaaaataaaatttgaaatatatgtatgcatgtaatttagtaagaaaaataagagctagtatatcttgctttaagcaagcaaaatatatgaaaacctggttttgcattaaaaatgaaagtaaaagttaagaatccttcagggctttggtataaccattatgggagtcaattaccactatatattattacagatgtagatggtgaggacatcttgctatatatctgtattaactatactatttttattagttcagatatgctcacattcaggtagtggcttttctgaataaatatcttatttactttcaattactttttcacgataaaagtagagtgcagaacaaattctaattacttatactttctggctgtctgtacagcaaatgagaagacatttattgtagtataatgttgaagttcatcaataattactgggcaatcaacctaccaagacagaagctgagactataaagacaaataacatatcatgtctgtcctggaagagttcatagtcaagctaggcaaatgtaaaaagaaataactgtaatactgtgtggctggaagtataataaggcattgagaaagtgctacagaaacacagatgacttcattaaacagaatgggtgatttattgctcctacaatgaagtacacacacaatgtctatgtacaataaaaatatgactgcaatcaagaaactaatatttattgagcacctattacatattgtaaatgtgcatgccagaatttcttaattatcaaatcactgttagtttcatagaatttcatattgttctcaaaaggaatataaaatatttcttagatttttgggcaattttattattcagaatcagagggagccaaacaaaagtttaattttacattttagaaaaaagtctaaggcaataccatcatatgcaagcaatccctcagattggtaatcagaactatatagattacacgtgctttcatttcacagttagagccagcagagggagtaaacctcttcaaagaaaagactgaagtatatatggagaaatgtaagacttcagatgtaaagaatgcctttgataaaaaagaaaatttgagtactgagacacagatgtcaaatacagggaagtactttaactgtacttttaaaactcattaaatgtaagcgtaaaagcaagagcaaccactgagtaaactgaaggatgccatcttattgctttaaagagacccacaggactgaaaagtattaactttcccatatgaaagccctgtaggctgggcgcggtggctcacgctggtaatcccagcactttgggaggccgaggtgggcggatcatctgaagtcaggagttcaaaaccagcctgaccaacatggggaaactccatctctattaaaatacaaaattagccaggcatggtggcacatgcctgtaatcccagttatttgggaggctgaggcaggagaattgcttgaacccaggaggcagaggttgtggtgagtcgagatcacaccattgcactccagcctgaacaagagtgaaactccgtctcaaaaaagaaagaaagaaagaaagaaagttctgtaaaatgtgttctgtagcaaaatctgactgattggcattaacaggaaggaatttcaatagtccatgtgctaattagcaagagctactatctgatgagtgcctgttttactccaaagataagtccatatacaccaatcacagtaccttgctgcctgaatttctaaggctatgaaactgctacctatgaagagtatgaaaattatcttgggctgggcacagcggctcatgcctgtaatccagcactttgggaggccgaggtgggcagactgcttgagcccaggagttcgagaccagcctgggcaacatggcaaaaccctgcctctactaaaaatacaaaaaattagctgggtgtggtggtgcgtgcccgtggtcccggctactctggaggctgaggtgggaaaatcacctgagcctgtgaagtcgaggctgtagtgagccgtgatcatcatgccactgcactccagcctgaattatggagtaagactgtgtctcaaaaataaaaaacaaaaaacaaaaacaactaccttaggaacacaaattccttgtgaatattacaataaattcattttttaacagaactacacaggactaagcctttctttgattttcctcgtgtagaagaaaaaattgagagagaaaaattttctgaatgaaaaccaagtatttttactcactttcatctctggtacatccacaatattttttcatctttgctcttcacggggtacttcttgtacccttctcagttggtatttttaccatatttggttcacctaccaaacaaactataaacataatctgcatagtggaaaattattaataggaatgtctgttttgcacaggcccaaactctcttttttgcaggttactattttccctgtcttttgtttacctgtgaacctataacatgtataaataggaggtatttgtttttcttacctgggttaagagaaagagatacaagtagagaaagaaatgggggtgcctaggcttgagaataactggatatgggctgagttcacagagaaaccctgatcagcactccctcccagccctatgtgatcctgtctcatatgccacaagttctttcaaaagctctattacctagtagcaaagtgggctggcgtgatctagaaggtgactctcaggaccaactggtaggtttatttttccattttattatctgttttctaatttattcatttatgctttaaacttttcctgcatcctagtttatacaggtatattctaattaattcatcattatatactttaacatgttttaatttttcataatgagtaatatgtaaatacaatcgatgcttgttgaaaagaattctttttcttttgtgctacttggattgaaggcttttacatttacagtcaatctttcttttccagtcataaaagcagttagtgctatgaattagcctctgtgaatagctttggtcatattgtcagctttgatgtagagttcactgttgtcatgtgaagtcactgttacacattaaataggcaagagaaaagggggattttacagattgtgagaagtttatagtgaaattggagtatggcaagttgataagctgaatggttgaaatgtcagttaccaggtacccttgggaataagtaaagaccaagaccccatgttgcctcatgctcagtgtacaaaacgtctgttcataatcatttatgtggtcatctacttgctgaagatgatctaaatatcggccatttattagtctcatctttagtcatctgtgaacaccacacagtatagggggtatgtgactagatggactaagggaaagagtccttgattgagattttgaaatctgagtttttgttccagatatactctggatattagttttaaataaatatttatatccagatatacctctggatattagttataaataacctttgtatatttattactttgcaaaaaagtaattttatattgttaggccctagtttctcaactacaaaatcaagaagtcacatttgattatttctaaagtctttccaactccagaatcctataattagaataaataaattctacatgctcagtgacaccatctgaacattgcactgtgtaccaatacatccaggtcagtgatgctgttcacagaaacttgacatttacagaaatcaaactttaaccaagaggaaaactgaaagaacattaataattactcaatataatttgtgattccataaagcaaaattggaattccagaagagcctgtgaagaacctttaagagttatttagcctgagtggcaaaaggcaaagccacatatcacttatcaatgtagctacaggctagagaacaatcatgtctgcatgtcatgtaacatgggagaggctgttgtctgtctcgtgttcttttcagaatcaagcatcattgttcaaacagaaatgtgtagtgattgcgcttcattaggtaagcatccaaatttattacaaaatatgctcagagtggccatttcagaagacatgtctgtctctgaaatagaaaattatatatatataaaaagaccacagcaaaaaggaatgacatgggatataatttttctgttcctacctattgaaatatatctctggttcgtgtctttagaaattaccaaagagaaaaagatgatctcaaatgactgaaattacttatagacagaaggatattaacctcctacgacatattaaaaagtttgggagggagaaatttaagctacacatgatatctctggaaattccattctgtttcatgcaaatgatcagtgaaagttataatgatacaaagttatgtcaataatagacttttaaagaaccaggtataaatggcagtgtaaatatacaaatcatcttggtttcttttaaatattaccaaacaaatatgatcctaggactaaggcagaaattagggggaaaaagtctcatagcttctttgttggtgattaagggaccctgaggtaaaaaaaaaaaaaagaaagaaagaaagaaagaaaaaaaccaacaaaaatcaagaagcaatgctcaaggtaataagtgctttcatgtttccagttctcatatctgagggcactggatcaagctaaaggacaaagagataaggacaatattgcaagttacaaacaaatggcagataaaagagctcttctgggttctgattaagtgacagcattctacacattcttttgacttgagaaagtcagactaagagcagcggctaagttccatgtgaagccccgctaaataagcgtatctgcatgctttcacattctggcaggacaggattcctcccctttcattgaacagagacatgttctctgggctcacagcaataatgcgcctctgcttcaacttccataaaaaagcataaatgtatatgctgaaagcacagagaagttttgtgctttgggacgaggtggctgggagccaatgtttacaatcccctgggtggggaaggcaggctgaaaggctcaggacggcaggctttaaaagtctttgctgttgccgccagtgaccttcgcctctgttttcaaagcagctctcacgttaaccccttggattctgtgtgcactggagctgcacaaaggaaatacctttctttgaaggacacctctctcacgcacatcggtttctgatttcagttggagcagctcagaaacactggattaagaaagaagcatgtattcaatctgctgtcagacccacggacatgtcagcggtattggatctgggtttcggagtgtgctctgttgtacaaagtgaaagtttccagctttaggcaatggactcaaggttataaaccaggggattgtgaaacatgagcatatttggtctccaggggagaaggaagcatccaatttatgcagaaatgctcttttcccagctagccaatgagaggcgaggctacaagagtgggcttcctattgggatctcctgactagaagaatggtgcttaaaattaaagacaggctaaattgctaacaggccaacttaaaaagcagctgaagagaaaacaccaattgtaaaaatgaaaagggagttttcccgttatgaaatcaaagctgaccacatttagcttattattatatgttgttgtttcacggggaaagaattaataatcttttattcttaatgctaagaagatcctacaaaatcttaccatatatgtgtatttttttaatagtctttactaagttactcaaatgatgatattcaagagtggtattatttaaggcctcaaaatgttttcaggacacaagatttactttgaaaaaactggtttgatatgtcagggaccagatcaaatgatttactttgaaaaaactggttcgatatgtcagggactagaacaaacgctttggtctatgagaaattttgtggatttaaagatgtttgtcatctaaacattgatcatcatggacagtgtcacccctttattgaatggacagcatatggaatcctggggtcatgaattgtgcaattctaatattcagagtctatgaactcctaacacatttcctgtcttcaagaggattaagatttctggagaagaaaatgaaaagcaacatacaccagaaaatttaaccgattcgcaaaaaagtcattaagtcttactaaaatcatccaatcaaatatgagacaggaatgagagagagaattttctcttcacatttggagatgaagcctggcctctacgttaccaggcagccatctataatgtcacaaagtacatgtatactatagctggaagtcatcttaggaatatttgagagaactgtttttcaggactaataattggctcttaataagtgcttcggaagacagttaataacatttcagcttctcgaagaatgcttaatagtaatcataactatcggcctggctttcattacagaccaaacaacctgttccttgttatctattgtggaagtcaatggtgattaagtaaatatattttactctaatgcagaaactgactagaaggaatgttttgagaagctcaaagaaaccccagagctgcacaacagagaagacatagccaaagaaaaacagtcgaagtttatcaagagtcttccgtacgcctggcacttcactaaggacttcacacattttatgttacttaaacataaaaacttgtgagataggcacataattttttacccatattttaggtaagatactgatattcaaacatgttaataactacagtagtcccacaactagccacttgtcagagatacaatccaaacccaggtctaactccagagtctgcaagtaaccactgagtatgacaaccatgcaggcagacagccctctaccactgcagagaagcccccgggaaacatatttcacagctctaaccaattggtgtacattgcaattactattttattggggactccaaggcatgtcaatcttttaagaaggaggctgtgttcagttggagatttttcatcgtattactgaattaaaagtcacatatgacttctatcagaggtgaagaagctgcaatacttggtttctgcaatagatttactaacatttatatattaatttcacattttaaatggaatctaaaagtagcagatgaaattatgctatcacaaattttcatgttttacaagccagttggaaaatgttttattcacaggctacaggatccatattctcatcattcccagtctgggcccctcactcctacccaaagcttttaagatgttgtttcttatttgtctccataaatgaatcttgtcttaaaaaaaaaactgctgtgaaatcaaagaaaataattgttgccatcttttacagtaatgacatgtcacttaaaaagttttcagcttagactccgttttctgaagcagcttctatgaactaataacctaacagctctccatgaactttaattattgcaatagaattattaggcaccaccagttacaactgaactcctccacacacagtataaagttaaaactgtacaaatgaagccaaaatatgcacagctaaaaggaatgttacaggggggcctctcttagcgaacaaagcaagctcagtttggctctttttccctcgcgctaccacatccgcacatcgttagctggaaaattcctgatatatgctgtaattttttgtgcttttttttcccccagtacacttgaggctttaatgtccagatgccattttcccccttatctgtccctgtttggggttctgccagctatggtcaacaattaatacagccgaagaaaaaatacagtacgctccctggcaactggtacagccttgcaggaaataccaaataaaaacttgattatgtattgtttaaccattttgtttgcctgtaggccaccctgtcgtcggtgtaattcagacgagcatgcttcatctggacggtctgtgcactgcaccattgttcccagagtctgtcacgcacaatcactggcttcagcctgtggccctctaaatgaaaggagcagatttgtggcagctttccaacctgcattccttttaattagtcaacttgtggcccaatgttataatagataagtaacctcttaatattcatgtaattaatttatttttttctcattcagttataagcctttgcatggtggaaaaaaggctttttcctatatgggctctggcttatgaaataagcatgctactattataaagaacatcagagaccatgtctcaatgattctccaggaggacaattccagaaaccacagtatgcccataactatattttaagcatattatttttgcatttaaaatagtaactgatatcttccttttgcatgaatttgatgtatgtaagatgaatcatcttgccaacttcaactgggctgataaattttaactaataacttagttcactatcagagagacagaaagctttcacattttaggatcccttttaaagcaaggctgacatgaaaagtggccaggagttcccaaagtactaggaagtcctctactctagacctcgattaagtcaataattaaactgctgatgctgttagctattagcacatgatgaacctttaaaaagataagttgatttctataaatactaataatgcctcttggtaacaggaatcagaatggcttctaaaagctccatatttaagttctttcaactatttacatttttctactaaaccaaattctcctcaaaggcagtaacatcatttttacttatttcatgtcctcatggacaatacacatggtgggtgaaatacagatatatctgtactactctcacatattcttagtagcacttctcatgagatttatgagacatttacaatgtcacatcaacaattaattcattcattcatacatatacaaatgtgcctactaggtgacaagcattggatctcagttgcaaagatgacacacagatgatgaagtcatcatatctgttctcaaaagctcacagctgagcagaggaggcagacatgtaacttaccaattgcacaagctctgtgcgaggtagacgtaaataatttaaaagcctggattcaaatcctgtctcctcttttatgagctacatcaccttggctaaatagcttaacctctccatgcctctgtttcctcacctgcaagatggagaatcatagtacctgcttaatagggcaactggagaattatatggataaggtacataaagtactctgcaggtgcctggctctataaactttagctatcagcaaatgttatatacacatcaactccacaggggtgaggcggggtgcaggataggggtatctagtgttagaggcttcagcgaggaggggcaagggcatgactggtagagagagcaacatgagcaaaagttgaggagtatgaaactgcatggaccagataacaggaccccaagtgttacttgacagagctaggactttatcctgaggagaaggggaggtactaaagggttttatgcagggcgtgtatgtcagatatgcattattctacatttgcattctggtaactgtgtaggattgaaattggagatgatcctgaaggcagggatctcaatgaaaaggctgcaatgatccagatgctctgggaggaagatgtataaaaccacagcagtaggagaggaaaggcaggaagaataactttaaacgagtcaaatgaaggagaaagaaagattaactgaatctaggataagtcccaggtttctggcctgggtggccaggtagatggtgaggccatcagcctgaatagggacccagaagggaatgactggaaggcttgctacttaggatgatattcagaaagatatttgggtctggggctcaagggagtggaccgagttggacatacatgagttccctgcctccaggattacctccacagcggaggagactgttgaaggagatagcatgtacaggctatgtgccatagggcaggacctttgaggaaggcagaggtgggcaatcagtggagaggagtgagagacgtggaaggaaaagcaggataccacgatgtcacagaagtcaaggtggatatttacaagaaataacgaatagagaagcatgcatgtacccgaagatgccaaacaaggtgaggtctttagaatatccactgcggtaacatgatggcagcagaaggctgcctgcacaaaattgaagggttaatgacatccagagtgaagtccttagttacagaagaaaagaggcagacgacagagacaactgaagctgctctctctgcctaccatgcctttcccacttgcctctaactctgcccagaacctctggcccctttaaggcttctttggaaaatagtgggtacagactgtgcttgaaggcatgggggcagcaaagacatgatggaaccaggatccggagaggatcaaagtggatgggatcaagcgcccaggtagtgagattagaagagcactgactccaaggctacagactcagaagtgaagatgagcacagaaaaatatagattaatttgcaagtatatgttgtagagatgcactgatggaattcacattcaaaggtttattcacttgattaaaatacaaacaatattatcattaacaggggcaatctctggtttgtgaagtctaaagcttacacacttttttttttttttgagacggagtctcgctctgtcgcccaggctggagtgtagtggtgcgatctccactcactgcaagctccgcctcccgggttcaggccattctcctgcctcagcctcccgagtagctgggactacaggcgcctgcaaccacacccggctaattttttgtatttttagtagagacaggatttcaccgtgttagccaggacggtctcgatctcctaaccttgtgatccgcccgcctgggcctcccaaagtgctgggattacaggtgtgagccaccgcgcccagccaaaaaaaatatggaatgcttcacgaatttgcgtgtcatccttgcgcaggggccatgctaatcttctctgtatcgttctaattttagtacatgtgctgccgaagcgagcacctcacacacttttaaaaagctgacaaataccacaaaatgcagaaataaaatcacaatattttgattaataaacggacacctccactaggaaactcacttgccctgtgttatttttgagcacatactcgttgactgtctttcatctgacagcaatttttgaaatattttctacaggaagataacatggttgatcaaagattatttttatcaacagctgtgatgcagaaaacatgtcacttcacatgtgatcactgttggtggtagtgctacaggttttagccataatcaaatagaatattgataaaatctattttggctgattcttataaggctgattctttccttatagaagaaaaattgcatggttatttctatcattaaatatgttgcattatcaagtatattcttttttttttttttttttttttttttttttgagacagagtcttactctgtcgcccaggctggagtgcagtggcatgatctcggctcacttcaacctctgcctcctgggttcaagtgattgtcctgtcttagcctcccgagtagctgggattacaggtgtgtaccaccatgcccagctaatttttgtatttttggtaaagacgggatttcgccatgttggccaggctggtcttgaactcctgagctcagatgatccacctgcctcggccccctaatgtgctgggattacaggcatgagctaccatggtcagcctcaaatatattttcttattatgaaaaaacttccatcttaactaggcattgatgagaatagaaacatttgctttcaaggtacatgtctgttgccttgaagaattctcctcagactagcctttggctcagtatgtttcaaaccttgtttctcctccactacccacagactttggtgccagagaccataggacatggtcatattgtgaaatgacctctgaatcccaggtaagtcagcacagtgctggtggaagtgaattcctggaggccatttctacacgggggtagccaggcataactatgttaaggggtttctcaatctgggcacttttggcatttggagccaggcaattctctactgcagggggctgtcctgtgtattgtaggatgtttaatggtatccctaggcttccatccactggatgtcagtagcaacatccctctcccccatattgtaacaacccaaaatgtctccaggcatcgatgagtgtcccctgggggataaaatcatccctaatcgagacccactgatatatatgtaaccagtgaaccccatatagagcttataaaacccaaatgaactcaacatccccttagccagatctcaaaaatgcccatggtcactccattgccacctgacacgagaactgtgatgggtgaggtggaaggttaatcagctgcatttaaaatagctcacctccacaattaaaaaaaaaaacaccagatgaccatattgctagagcctctcccataaccttggtatgcgatgggagctgaaagtgaggagctctgaagcttaaaactcattagacacagataaatccacttctgatcataattttagtcataagcaatgacatatttttaaaaattctctttttatactgcataactaatgatatgacatgtttcatacacatactgcaaatctcaagataggtaaaaatacatttcaaatgacctcattaatcattataatatgacctatggttaagtaaagcacaaaacaagtattctcaattctctagataaacatcacatgttttatgacatgaatgtgttatataaaagaatatctgtgtgttatgtatgcaagcaactaaaattttaacatttcatttatctggtaagatgaatgaagacttagatgtaactagatttcctggattacttacatttctctttgtaagctctgcaagtgtattattttaatcacttgaattttttcttgcttgtgtcttattatcaattgcctttttcctgctgttatgatccctatgtttatcagcctaactccttttctagtttctgcttctaatatggacctattacacttcaaaatgaattcaaacacatttatcaggtcccccacagaggggcctcagactacctccctgatctcagccctgacctctctccttcctacttactctgcctcagctgcactgaccttcttgctttccttggacagaccaaactccctcctaccttggggcctctgaattcactgctccctgtgactagaatgctctcctgaatcttaggatgctctgtccctatctcctacgcaaaagaccttctttgaccaccctccccctctaaaatagattcccggtgtatcgcactctattgcactgctgggccccagagattttatctaatatattaatttgtttatcatacaccttcctgacaagaatgaggggagattttatatatatcattaatttctacactctcagctcagtgactggccagcagaaactatagcaaaacttgaagaaattttaaataagagtatggatctaaataagaactcaagaggtagacataaggctttaatgatgtgatagctacttgggtgctcagagccctcctctctcttttgttcttctgtatttctaattctattcccttgcttctttacttctctttacccccacaggcaaccactatcctaagtctcatgtttttcatttccttccttaaaaaatgttaatctataaatatacctaaataatatttagatttgctttatacatatttcatatgctttataactttcttcatttttgttttattcccctcaatattattgctaatattcatccatgttattgcctgtagctatagctcattcatttttaaattttcactgctgtgtaattctattgtgggaatataccagtgtcaatttaatcattcctttgtatatgaacagttgggttgtttggagtgttggtattacaaacaatgctgcagagtattcctgaatatgactcttggtacacatgtgcaggaatttctctaaggtatgtaacttaaggcatggaattgcagggtttcatggtataagcatgttaaactgtatagttaataccaaattattttctaaagtagagtatcattttatgttcccttcaacagaggatcagttttaggtgtttcttgaaaaagcaaagacttggttttagagaaatattttaaaaatctaatctaacattctttgccatcgaactggtgagttttgtccatttacatttactgtgattaagaatctgtttggacatttttaccaatctatgtactcgacattctttcttgcatctcgggcattccttttgagattattttctttctttttgaagtacatcctttagaaaattcttggtagtggtaaactctcttggtttttgcttctgtgaaaatttctttacctcattagtatactgtgtacttagaattccatatatacacaaaatagtaacaaaatatccagaatatccaaagtatttttactacgatgtccttcaggcaccaagagaggaagcatataacaagtagttgttcaccaagtaaccaaccttctcctacgttttgggtccatgctaaggcatgcttagcaaacacaaatcattgttcctggtctcaaagagctttgagcagcattaaaaaaacttggaaatcacatgaaacctaagtagagagtgaaaggtttcatgtaaaggatgaattgggtggcttaagaagtgctgtgggcattcagagcaggaagcatccaaagaaaggtggatcccagtcaggtcatgttgcagaagctcctgaattatgtttctacacaacactacttatgtggccaaaccacacctttaccttgaatctgaaaaaagccagggtacgttttctttggagatggtactgtggcttaactgaatcctgaattgggcactagatagataagagcaatattaagacaaatgttcttaaagactaaattagagaataagcaattgtatgaaatgctaaatacaaattttccagaattgcaggttgaatgtgctactcagttattagtctaggtaccaactccttttctgaatggggggcattcctgcatggctttgtaaaacaaaacaagacagtgcaggttatacaagggctgggctgaaagcctcaggaatttcttttaactttcttgaaaggttaatagctgaaagagttcttatatgacacatcttaagcagactatgtgaaagaagtgtatgttatctgtgacattaattcctaatccatagtacaatgagtcacttattcactggagaataatctaacctatttgggaaatgaacctttctgaatattaactaccacctattcccaagaggaagtgatcggtggaatacaaaatggctcagtacagaaataacattaaaatgctcattttggccagcgtggtggctcacacctgtaatcccagaactttgggaggccaaagtgggaggatggccttgagcccaggaggctgagactgcacagtgagctgtgtttgtaccactgcattccagcttggacaaaacagtgagaccctgtctttttaaaaaagctaattttgactacagtagggaaagaaatttactttcataattaatgagctgttactttccagtcatctgccttccactctatagagattaaatacacaaaatgtccttcgtgaaaaacaattttcttgtctttgtagaatttgtcctgtgggtggtaaagaagaaaagcacaaccatgaaggtctgtgctccagggccacaactcaatttttctgtgccatcctcaactacttgcctagtggttgaaagtaagcaaggaacaaagactgaagaaacaccactggatttctgggactctgagatctcacactgagatatggtgcctgaaagcaaagcaattaatactgcctatacagtccattcacaataacacactgattcattcttagattctcagtgaaaattctgcaactgtctggatttgtgcattcaatttcctgtattcgaagaatagatacgtgtgtagccttggaaaaaatacattttatttttccccagacttcaacattgtttaaataactgataatggaaagatttcttcagcataatcatttcaggaataccagaaacactctctcttttgagaaataataatgaaaaaagagagaatggtctccctaagatgttagtaatctaaactttagtaaaagtgatttctaagtaactgattaacagtaataaaatggtttcattggtttatattcatttctttacctgtcttcatattcaggttcaaagatgagtattactattacataatttaattataggacttcactttttcatgtattaactcatttaattcccacaacaatcctattaagataggtactgtcattttctctattttagcagagaagaaacccaggatacagagaggctaaagaacttatttaaggtcacacagcttgttaagttgcaaaataactttgtataaaagatctggttccagaatacgtccctttaaccatgtactgtggtattatactgtgtataatagccgttatactgctttttgaaggaagcaatgtttttcaaaaaaattatctctttgcctatatttgaaaatggtaggagagaaaaagtaatattccaggaacacttgaatcaattcaagacttcagaaacaatgttgccaagaaggaagtgagaaacaagggaagaaattctaaaacaacatcaatggagtcactgtttaaagaaaagaaaggacttattctcttggaagggtgtgaactatttattcacaaatacctgatgagatatagaaaacgtgcgtgcatgcgcacacacacactcacagtctctttctctctcacaagataaataaatgtagtattagaaagaatgctaggtatataatgttttaaattctgctgtcttcccagactcttccaacttaacaatctctggcctcaagaacatgacattattctcttaagagaaacagccattatcaagtgtatgatattatgggcagcagatgagcagatggaggaagacacacagtggtgatgatgaaatttttaggcatatttagttgtttaaaaaatcctcaaactgaacagactcttactggattatatccaatatctaatttctaaacttgttattctttaggaatagtgagggaagacgggtgaatgaaggtaattagccccaaggagagaaaaatcgaaaaagggctgaaaaaaaatttgacgcttttctttactaatttacaactttctttgaaaccccagtttgattatctgacttttgaaattgagaaactaatctgtgttaccattttagagaaatgaatggatgaggtgaaccaagaatggagaatggagataaaccaagaccacacaaatttgactataatgagtatatattacttttataatagacataaacagcttcaaagtgcatcatcattaccaattgctatttggtgagcataatctatgtgacgcccgtttcttccctcaaggtgcttgttgtctaaggaaaaaagtaaattatggtattttgtggctgtttacattacataaccctcattagggtttagtcatataacgaccacaagtgaggtatacaatttgccaactttagcaaaatctggattatgtggaggaaaaaggagaaacagaaagataggtggctaattaattagaacataaccatgtcactggcactttaggcccaataaagtaaaacatctatcatttaagtcctgataaaaagaaatatattttttaaaaggctctgtttgtaaaagaaaaaaaagtcatttcatgatagattcatctgaattacaattgggataaacattaaaccactagaaaatttctgatttatacaactactagtgagatgtcatatagagattcttcattatacaatttgttccgttttgaatgaaaatgttaatcataccaggagaaattactatacatattcaataccactgccagtaaaaatagtagtgattacatcagtagtggctactatgttctgagcatgtgtcaggacacatccacaacagtacagtatgaaggcaattatgaccagagacacttatttgatttaaataaatatatttttatttcttatttatctcataaagtaaatttcatatcagattttgacatgaacatgttttccccggatctacatttaacagcctccagtttctgtcccatctcattcttgctctcacgtagcccctcgtcacacatctttcttaaaacagcctccacgctggtttccctgccatcaatttcttaattcacaccaaatcctccctaccaatccactcatcacattgtagtagactgcttttttttagggtaaaaaaggttttaaagcactctgctcaacaacccacatacttcttgctgctttgccgttgtgtgtgtgaacatgagctgatgtttctcaaccccatacctagaacacacctttccctgtgctttgccaggcaaactcctcctcacttgtaagcctgcctcaaaaattagctcccctgagaagccttccctgactctcctagatctaacaatgcttgtctcctagattcaccagggtttatctggctaggtaagagttgtagaggcaacttcagatttacatatacatatatgtaactaaaaaaacatacacatatatacatatatgtattttatttatgcatccaaatactgaatattacttttaatcatatgaatatattaataacaaacatactatttatgtaatataaattacgtaaataatattaatgaaattcacatctttttaaaagttcttagtttaacataatttttcttattgcctcactgtttttaaaagcaatccttagcttcctgaatttgcctgagaagaatgttacctgctgattgctgatagatggctcatactcaaaaagtgtttgctgattgctattattaaggaatctaaggaatcatagtcctggtgggtgtggtaagcaatcattcttagtctaatcaacatttccatgaaactctaaagctttctgctttcaacatatgtggagcacgtaaggaaaaatgcactgtgctttataaaacattttattagagattggtgaatatatcagtgcgcctctgaaagaaaccaacagcagatgttcctacctatacagtggccctgctgccttggtgggggtgtatctctagactaatgaagggcctgtacattcgttgttcacccaacagccatcccctgctttcctggctagcataacctgattttcttttgggtagcaatatgcttatctacagactgattggtcaatgggtaggtacgggattcaattatgagtgatgaaacctaaagtggaagtttgaaaagagcttttggaaaagattgtcttccctgattaaagagacaataaaaccctttttggcccctgcttcctcacctactgcttagaatactgttgtatgtgatataatgcttttgaagttgtggcagccatcttgaggccctgagggatgacactctcaactaaccaaagaagaaggaatggtattttcccaatattcggttatcggaaccaagatgataccatcaagcaacagcaccaattgcagaattacctatctccagacttcttatatcagatttaaacgttattattattcaagacactttgattggatattttgtacttgtaactaaatatatgatgctataaatgggtccagaaaaaaatctgaagattctagctttggtgattaccagtaatgaagttaaacaaaggagaccaaagcagaattgcctaggaaaggagaagctgatgagtgatctttttgttatgatctgtttctactgccatggaacaccagatggagaggtggggaaaagcagagatgagggctgatactcagaggagacccgggcagacggatgacttggacacctctgcacggagatgaaagttacagccatggacctgagtcagacacagaaagggctgaagtcagaacatgctggatgctttattagaggacaggaagagcagaaagcgccagcaaaggcaatggccagaggcactcaggagagacaaagcagtgagctctctcacattcagttaaggagtgcaggagtaggagctgaaacccttttggagaacaatttggcattatcaaatttttgaatgtgcattctttgtcctttgtcctggtagtaccatttcttaaataattatcctaaaagaaattagtatttcagtgaaaaaaacataagcccaaagatgttcactgcagccaaaaaatgagaaaccacccaagtgttcatcctgggagactgggtaaaaatattatgtaaatttacacagtgaaagtaagaaaaagaataacaggctaatatatgttagatatggacaaaatgcctaggataaataaatggaaacaagtaaacaagaaatcccaaacaaacagaaaacctgtatgtatactattataggcacatccacatccaccctcatgcacacccatactgagggttgtatacaagtagcaaaaaatataaaagttcatttaacaaactgttaatagtggctttttttctggaaggaaggatcattgaggattttcccttttcatttttttacctacctggaatggtcaaatttttttttttttttttttttttttttttttaagatagagtgtctatctgtcacccaggctggagtgcagtggcatgatctctcagctcactgcaacctctacctcctgggctcaagcgatcttcccacctcagcctcccaagtagctgggactacaggcacataccaccatgcctggctaatttttttattttttgtagagacaaggttttatcatgttgcccaggttggtctcaaactcctgggtgcaagcaatctgcccgcctcagcctcccaaagtggtggaattacatgcgttaaccaccacactggtggaatgttcaaattttaaaataattttagcaatgaacaaagaatgcagacaaaaaaactgaagaaggaaccgtgacactttgggaggctgaggcgggcagatcacgaggtcaggagatcgagaccatcttggctaacacggtgaacccttgtctctactaaaaatacaaaaaattagcctcctactcaggaggctgaggcaggagaatgctgtgaacccgggaggcagagcttgcagtgagccgagagagcgccactgcagtctggtctgggtgaaagagcaagactccgtcccaaaaaaaaaaaaagaaccatgagagtttaagggagcggggactcgcatatacaaatgctacaaagggaatgtggaagaacctgcaaaaaatgccactggatttggtgaactctatcttataaatggggctatttctctctaaaaaattgtctactaagaccaaatttctaaaaacaaaattactgagtaaatgcatgtgaattaaaaataaagcaattgatgaatatcttatttttctaaaatattatgggactaacaatacttgagaactacaatcgactattgaaaaaatttgatgcctttaaaaacaggagtacaaaaattacaaatgataagctgatggaaaatacaaattgtactgtgcatatagtagcagcaacatgacctttaaatgcagtttttcagccccacatcctaaaaccaagaagtcgttatagaaataaagatagaacaataaatacaaagaaaagataaagacaagattttatttcaacttgtgtaaaattgctgaggtcactcttgaaagcttttcttactttaaatggactattcaatcttgtcaaaatcttaaatattgtgctacatttttaacatctacttgccaataaaaggcatgacagtggacagtttgggtataagaacatgtgagtttctctcttctttagacattaatcctatgtatgtatgtatgtatgtatgtatgtatgtatgtatgtatgtatttatttatttgagatggagtctcactctgttgcccaggctggagtgatcttggctcactgcaacctccgcctcctgggttcaagcgattctcctgccccagcctgtagctgggactacaggaatgcgccaccacacctggctaatttttgtattttttcagtagagacggggtttcaccatattggccaggctgctctcgaactcctgacctcatgatctgcctgcttcagcctcccaaagtgctaggattacaggtgtgagccactgcgcccggttgacattaacactttacaattcacaatgggctatctgtggcttttcctaatacaatatttttgaatgtatatcaagtaaaaactacagtggccagacagtataagtagttttacataatatacataaacctgtaaagtcttttaaaatgcatcttaatctagtaaatcatattttaaatgcataggcagcttttgaaaaactttgccaaagcccatatgcaaattacttgattttacatatttgatttttaaaacatttatgcagttttattaaagctatattggttttttgaacccaagatttggtttctattacaactccattaaaaatgttccctgacttaaattaatattgataaattagtcatttaacattaaaagtggttatgattagaatgagtatcactgattaagcttccatttactctgttgctctgtactgaaagctgaagaaatataactttaaataccaagtcaatttgttttaagtcctcaaaatttaaaaaaagtaaaaaaaaaaaaaaaaaaaaagaactagtatcactgagatcttgtgcactcttgacaatatccaaccagctgactagtcatgcatttgtgtaaaatgcagtaactttggttttccagaatatcttctaaatataaacacaagattttagcaatgaaagtgactaacaaaataagtttaattcttggtgtttaaatttcaagatggatgcagatacaaaccacaatggcacctttcagggaagtcaatatttaaagaacagcatcccttcccaacctcagtcctcctctacctcctctactcagaaacctcctattttaccacccacatatactctataaacactcactgagcagctaccatgtgcctgtgtgttgttacctgaagtgctgaaatggctattttgcaatgttaatcttttaaaaatagaagacagaagtcaaacaaatggggatactaccatatgagaactactatattacaggcaaatcaaaagtgcacgggagggtaggtacttaactttatcctggggagttgggcagacttcagagatggcatctgagtcttgaagaatgagtaggagattgttaggctgggaatgggaaaggcaatctaagcagagagaatgtttagtgacacggaagcataaaatctaatggcatgatttttcaagaaggagcaaaaaggtctggatagcaagatcatagggtgtgtggagatgggtttggtgtgggtgggaaagcaagaatggagagaaaggttaggaacagttgactgctgcattccggagctcagagtatacagacttgagtgtgtgggcaatggggagtcactgggaatttttactccttcacctccccaaacgggcttgtttcccacagtggtccatgttgtatggctgttcccacagctcccttctacatgccagtcttgtctttccaggaaaaagaaaatctccttttctgactaactgtagtcttgatctttcatccattctgcaaaaatgggattttatagacaggtaaggacattctcatgaatatatgtgaagaccatcattttaggaatttatttcacattcttgatagtagcttttaaatgctttactttataaaagttttacagtttttttttttctttttctaatctgctttttctaaactagtaaaagctagttttctggaactaggttacagacagactttggcccatttaacaaggtcagactgtttattcttgacagaattctttcccactgtaaaaaggtacttttaaatgccacattccaaaaccagtgccagtaagccactgaagcatattttcccacaagaactgataccatgtgcagtccctacctcactgaaatcatccagcgttacataaggtgcagatagtatttaacgtcaccatgaaatctatcaactgaaatatgccagccatgtatttataaaacacttccgtacatttcaaagcattggtaacatttaaaaaagtaattattaaaaatcgaaatgggaaaaaagaaagggaaggacagtgctagaaattttttaaaaagaatttaagacagaagaggaaaatgaatcttgtaactttatatcagtatccaaacctgaagtagtagagctttttctcccttattttggggtttttatggttgagctgttaaatttacagccccatttttagattctgccagccttcaaaataaatatatgagcagcgctaaagtaaattctcctacgctttccccttttctcttttggatgtttccctgagatttgaaggtagattattcctccacagccaacagtaaagttcaacattcaaatttatgaaggatttaaaaatcatcagtatccttgtagatagatgctgggtgcaacaatgtcactcaccctgggtttcaatccctagagagggggaaagcagaaagcaggagcaataagaggaatggttcagcagccaaagactatcatttagaaatgcattgggaagattagcaataaagtcaataaatgcatcagaaaatccggcactacaaagtaattgtataaaagtctgagctcaacttttggagagacctacacagataacaggatcataaatttaatcttctcaaggacccaaatggactagataaaatgactaagggaaactgcaatgcagagattttcaaccccttcttgggacactatggtttctccaaagatcccaagggatcttagctttaaaataaaagcataacatacagaacatctaagtgcacaagtcaggagatctggcaaggtttgtgatctcaaataaagagggatgaagcacaataattatctgaaggttatgaatggctgcccagacacacattcaaagtgtaaatgttactccctcagagctcaagttattatcaaggagtgacgcaggcaattgggaagattagttgaaagttgtgtctaaaacaaattaaaaaaatttttttggatgcttataattgatgatgcaatgacacaagcagcaacatggagaatgcagagtaggaaatccattcattgattcatttgtaaaagcagggagttgtgaaagcaattaagttcaaagaatagtgaaaaactgataaagaatatgtgcttatgttatgtgcttaccactttgggtagaagcgatggaaagacagaaaggtaggttggagctgagcttcaaaaaactttgtatgccatgctgtagagttacagttcattctctaggcactggagaatcgtaaggattcattcattcattcaccatgtactcaagtgcccacctcgtgcaaggaaggcactgtaggaaatgctaaaatacattatttggactgagtgaataaaaatggatatggccaatgttacagaatttgagaaacattatcttgactcagaaacttacactatgatattatcaaagcctaagcaaaatattgccacctctcctttccttaaaaggaagcagtgacagctctaaaatacaagcagctcacgtgtccaaagaattaaagaggacacaaaaatccaaattattgaaatgttgctttatattcaattccaaggaccatgtctcatactcctatgagtatgaatataacacttgcgttgagttaagcaaatttaggggagatggaattatctcattaaatagaactcttcagagaagcccctaaactagcacagaggcatattcccaaaaatgttaaatgtaggaggcaaaatgttttttcatcttctggatccctgagaagccctttacttgaaaaactttctgaagcatatggtctcattaatcttaagacaatgcttagtctttatatccagtttggcctcaggcttttgagattttgaatggcatcatatagggtgtccgtatgaaaaacaggcccaggcatggtagctcatgtctgtaatctcagcactttgggaggctgagacaagaggattgcttgaggaatttgagatcagcctgggcaacataatgagacccccatctcttaaaaaaaaaaagaacgtagctgggcgtggtggtgtgaacctgtagtcctactacttgggaggctgaggcaggaggatggcttgagcccaggagttggagcctgcactaagctatgactgtgccattgcactctagcctggacgacacagcaagacctggtcaaggaaaggaaaggggaaaggaaagggaaaggggaaggagaaggggaaaggaaaggaaaaaggaaggaaggaaggaagggagggagggagggaaggaagaaaggaagggaaaggaaagaagaaagaaagaaaaagaaagaaagaaagaaaagaaagaaaagaaaagaaaaagaaagaaagaaaagaaaaagaaagaaagaaagacagacaaccagattctctgtatcataccctgatagatgctggctgaacaaatgtaggaaaaaagcaaggaacttctggctctttctccgagtaaaacatcctccaggcagtagcattacagttgaactgtttttgtccagaactaattcgcaacagtgaccacttatgaaggagctagaattaggtgagtcaaatgaatgactatcttttataaacaagggaatcagtcatttgattcacttcgcaaatccacttggtgcaattagatagccacatgcatgcacatgcaccaacagcagctttctgtgcagtatggaatacattctctttctacatggcagaaattctcacagtggtcatcgatatttgccttcaccgtggaggcagagctaacctatcagatggtaactcaaatgtgttttattaccactgagaacgcgcagtggagaatctggatgggttttcatgtttgttttggctctggcattttccatgtacccagccctgggaatcctaaagaaaacgtgtcctgttcccagctctgtgcactgcccccattgtgttccacttccctcactggtgaaagtgaaaacgaaaccggcacaaaccctccattgttaactatgaaatatgtactggcaactggatgttttaacaaaacagacctggttgtgtcatggcaagatgttgagaggggaaggagtcacaggagcccttcctgcttcagaggtgtgtcctgcactttcgctgaggtgccgaggcgacggggctttgggttttttccattatactcatgtaatgttcttggtttgatttattcagtatgcactggcagcttttggaggcttctgtgggagctactcggctgcccaagccgaggcacaaaccctgccaggtctccatagtaaatacaacacgcacgaagaggaaacaagcataaacaatttattttctcctgtaaaagatgacattgttctccgatctctggtcctgcttcactttgtcacttggtggtgccaactgggtgccgtggaatgagttattccaaacacacacacacaccccaagcacgaattgcatgacgcgcacattcacagggcccacatccaggcgcgttcaacaggaggatgctggtgacctctttaagcatcccacattttgacctgggtaaggagggagggcttccctggcccttagcctaggcaggttcttgagccttatcatatggcctcataaaaccatatccctttcctttattgcatttatctctgtttctaactagacatttctttgtgtgactatctgattcagatctatctctccatctcgcttgtaagctctctgaccttgtccatttccattcaccatcatccctcagcttcactgacagcgtctgcacatagaaagtgatcagtaattatttgttgactgaaagccacaactccatttcattgattttctcccctaggcttatcaaagtttctgaatccacgaggttccgttagtgttactaaatgctatcaacactgaggtcagagtaaggaaggaatatcatcagaggcacaggaaggggatgtaagtaatttttttttcttcaactttaagttccagggtacatgtgcaggatgtacaggtttgttacataggtaaacgtgtgccatggtggtcagctacacagaccatcccatcacctgggtatcaagtccagtattcattagctattcttcctgatgctttccctggcaatttttgtaatacttctggtattaaataagttaatgatctcaaataaagcaatattgggaatcttatcagttacagatttaaaaaaaaatttccaaaattaagttttgtactttgtacagctgtcgaataaaagtcttctcatgtttaacatttacttgttgtctttttgtaatttctatggaataaagggtgttttcagaacatgtatatcttttattagtgaaggtaatatggaaaaaaagattcttggagaaagagaatataattcacttagtgagaattttattaagtcactaaaaagatgggaacatactcccactcttccattatggtacaaagaggaatgtttctctaaactatacaggtgtgtttggcacaggcatttgaaggaaaaatgctaacttcatgaatagcattaaatgattgtataaaggccccaaaaatacaaagatactgaggtaccaaaaagaatgacctcattttagggtacacttctctctacccacggatggctttatgatggctgtcctggggagtggctggctctaactgcctgggtgttggcaatcacctgtggtataaaaacatcaatactggcattgccttgggtggtccttacagtattcccatgtacactgagagcagcacaatgaatgtgctgttgcaattatggacttgggtgattttaagggagaggacacagataggactgaatcaagagaatgcttcatttttcctaagcaatgatacttttataagacattcaggtgcacaatgtggcaaaagttttattgaggtctacataaaaaaagaaaaccaggaggcaccagttcatgacccagtgttcctcactgtgtcaaaatgtggcatgagctagttgtctgtttttggttttattattttaacaagacttaaaaaatattctttaaaaatggactcctaaacatttgtggaacctctaaataccctttgtagaatctgagagttccacagaacacagtttgataccctcttgggtactgaatttttggtatggagaaaagaggagtggggatagtgggccagagccagaatataaacattagaattctccaagccatttacaatctatttggtaaattcagacttaagctggtcacactgcctgtttgaatggcagtttccccacttttcaaaatgaaatggttgataaagagttccaagagcaccaaatccaatggcaacaatatcaccctccaagctgtatgattaggtttagaaaaaaaattaaagattttgcatcataaatgggaagacaagactgctcccttcctgagcttgctggtcacagtgcttcatgactgtcagagccctcaccagggctgctgatgatgttcctggctctgctctaagacatgtcagacccgggtgcacagtgaggtaggactgaaattgctggctgagtggctggtctctttttcccttatcttcacaaaaataagttgcaccatgcactacatttcacatgagaaggacttagaaatgttgacttcagagtgactctaaatatagtttcagctagtcacaacagtcattgtaccgaacaggtgtatattcttgaaacacttttgccagagacattatataacttcacatgtcatgatttttacctatcagctatgtacaatggaaagaacttccctgtaacctgttctcattggttttccaatgagaacaaatgtaatagttcaatagaggtcagagaagttaatttttcatggtttcagagaaacttttctgataaaaataacccatgccaggtgttaaatataacaggccccacttctcttcacatttccaactccttctttgaaccacaaggggcctcatacacatgcttacggacactccagtctgcaagtccaagctctgcccatatgctgcaaacagctgcccctaggcttaggagtgaacacacaagtggcaaaatccctattaggaggaaggatgagcccatgcccttcccatttagtcagggaattgcaatgtcctgtgtgcggtatggggcaggggtggaggtctcaagagacatgcttccttggcaccctgggttgtgtgctccatgaagggagacaaggctggagtagggccagtgtaggcttctctaaagcatgagatccaggtcaggggcccctcttgcctaggaccaaggcaaacactgttaccatccacatcttaattctacaacctttaaagaaaaaggtataatactctgtatgggtacatgtgcatacaagacactatattgagcagcaagaacccaataccccataaagacaccagaatgtcatgttggaggcagcctggcaaagttaggcaaaagacatttaactctttgattagtcctcaatttatcagatgaggacaagataagtcattcagcccgatgttgcataccacctacagctacaactatggtccaggctactgtcctaaattaatttctaccaaaggccaacatatgaagtatattctacttatgaaactcgtgtttcttaacaagaaacttgttttcactagaaaaataaaataataaagatcataatataaagggttataccttaagatgcctggaaagcttacctgtctagaacaactaatttctcaattaatccaaaagatgccttgtcttgaatactggcatagagcatactggctcagaaattaaggagaagtagtacttcaggatctgtcaggtgatcatgaacttaaaatgaaaataaatactgttaactgctccctcaaagttctatatgtaagaacattttgaagttttcagaaagaagctaataatacaagcttttataattgttcaaatagaaatatcatttattatgtaaatatatatatattaacatagatagtaaaagttgtctagtaattcacccattctttcatttagaggatgttaattatcttagaagaatatgactcctcttctaaaacttgctttaataacaaaacacaaggggctaaagaaagtcttcaaataagtaaaattacaataatgctacattcctctatctctacagctttctgttcaggacaggaagttcaattcatatatgtaatttgttcctgaggcagtagaaaggattatgataaaaacaatacacagactgtgaacttgggtttgcgtcaacttttcactcctaacttgagattgagctacagcatgtattaatagctttcatgattttgaacacagatatgtgctgccaataaatcaatcaggactagggtgcaaaatggactcagccattttaaggtatatggagtaagtccttcagcttaatattaccaggtagctatgaggaatattgacacacatcaaatgagaccattaaatgtataacatagctccttctctattcctgttatgactcaactgcttatatctgcaagtcagcatttgtcaatttattcactgaaaaatatttcctgagtgcctatcaaaataaacaaggcactgtgtgttagggctgaataagatgagcatctgccttcgaggaacttatggcctgataaataaaattcccaaataactaaaaacaagacagaaaacagtattataggctgggcacagtggcttatgcctgtaatcccagcactttgggaggctgaggaggacggattacttgaggtcaggagttcaaaaccagcctggccaacatggcaaaaccctgcctctactaaaaatacaaaaattagcctggggtggcctgtaatcccagctacttgggaggctgagacacgagaatcgcttgaactcggagggcagaggttgcagtgagctgagatagggccactgccctccagcctgggcaacagagtgaaactctgtctcaaaaacaaaaacaaacaaaaaaacccaaaatattactctggaaacagagaggaaaaagaaattaatttctgaaggggatactagaaagggtacctctggagtcaggctttgcaaggtaagtaaaatactagcatttctcatagttttaagatgtcagttttgaatcagttaacttgtaattcctttaacattccacaaattaagttgattctcagttcctgtatgacataacccactaaaaaatgtgtatttccaggaagaggagtgtagtctttttctcttcaagagacactaaaaatacataccagttcagtctaaaaaactatgattccaagtttttatgtcaccatgtgtatataaatcgacgcattactatattaaatgggtatttcctttaaatagaaaaatacaaaagagtggggaaattttaaaatgcagtaccctgtaggaacataccctttattattaccattaaattccaaccgtcactctttccaataaagtctgatttttgttttagaatccttctcagctgctaacatgttttacttatgtcactataggaaatataaagcatgcagtataaactagatactgaaaaattgtgtatttatgactgcctttctccttttcctctatgaaataatttgtctacattttcctgtttgaacatatcaactttcagcaagaatggaatgttaattgatgttacgcacaagctcaaatttaataagcaaaaaaaaaaaaaaaaaatcaaacacaaaccaactgggtttcctgtttttatttatggttattagtgcccatttggggggattaaaataaaagcgtccatctcagttacagcttatccttccttcaattaacgtacccaaggagacaagttccttccatctactcccctgatgactctctggatcacaaagcctattcaagcttctccccagggccccaaaacaacatgcgcaacaacttcctagggaaactcaaagcctacctcacccttcccactggggaaatacacagactcagccctttctggtgtgattacataagaatacaagggcttgcttgaccgtgctcaaagctgaggcctatcttttaaacatcaactcgtgccatttctcctctaaagcaatggtgtatgctgggcaaagaggaaatgagtaggatttatcttctaacaatggcaacattttccaaggaatcctctgcatcaaaagttctgatgccctaggaaaagtctataatgtttggaaagtaactggtcttacgtgtctaggtggtagcacccctattttgactgggggcagggggtggggaacacttttataaattggattttttcctaaggcaagttatctgtctcagagaatttctaactcctctcttgaatttctacttatcagctgtagtattactgaaatttagggaaacaattttttgctgtgcagaatgaccaaagatgttgccaatcattacttaacaacagggccatgctgtccctgatgtgagaaccactttgaggctaaagatggacaatacggattatttttttttatttctttgaatatacaaagatattttcttttttaaaattctttttcttaagacttaatttgctatatattatttatttaatttactgtacgtaaggcatgaatttactgtatgcaaaacaggtctttcaaagagaagggtattaatacctatttccaggctgctctttttgtatttggggtgcagaatttcacaaaaatccatctgagaaataatgaactatatggagaaatagaagctaaccaatgtcaatagctattatggttttgcagctgaatggcaaaaagaaacagggtatcataactgttattttttgccaaaacagggccgttgggttcgctctttctattcagggttatatgagccttcacctggcatggcggtgctctacgttcatgcatcatccaagttcactgtgaatttgatttcttctttacagctggcaccatagcttcagatgagtgcattaacaaacctgtgtaggcactctgtttctcaaaaccatgatgctgcagacaggtcaacgttgctcgtgctctttcttccctgaccttgagctgtgtgttccctaggcattgtacatacagctctgaaaacagtggttatggcagaaagcatttggaaacttgtaactgattcctgtccagtggctaagatgcaacaggctatttctgcaatggatcctgtccacaacaagcccaggctggatgtgactgtagctgtaagcagaatgctttctgcctacccactgccatataaaaatgggcaaagacattctatccaccaactagtcatgggcagtactaacattagagacatggaagagggacagactgtcattcaaaataggaaaaataagtttaataaaaggacagcactctctcactcaccactgaggttagagccatctggaaactatagatgcgggcaaggccgaagtcagcgagttttatttgtccgctgctggtcaccagaatgttctgtggttttagatcgcgatgcactactcggtgtgaatgaagaaagtccagacctcggagaagctgaaacatcatatcctaataaaattaaaaaaagaaaatcagtaaacactcaaaacggaagttgagcatttgctatgctggacgccgaatccttagcattttgtggctgcttggcatgcggcaggcatttgacaggtattggctgaatgagtgaattgtctcccttcctgcctttccactcccacactttcaagaacactgcaaaaaatttcactctcaacctgtattttattaatgaaaggacaattttaaaatagtttttgatggaataggaaacattctggaaggatatctgccaaactggtttcagtggctcatgctggggagaggaaggaggaggtcgtgaggggacactttttgcttctctattgtttaatgtgccatttcaacaattaaaatccagtgaataataatattgttattaatggtgattattattttatagcacctagtactaaacactcactatatatcaagcactattctaagcattgtccacttagtaaataatttaatccacaccacaacatttaggtaaataatatcattacaccattttacaggtcaagaaactgatacacagatgtaggctactaattagcccaaagtcatactagcaagagagtgctgattaactgtttgtttttttttaaacaggatcttgctctgttgcccaggctggagtgcagtgctgtgatcacggctccctgcagacttgacttccttggctcaagagatcctcctgcctcagcctcccaagtagctgggaccacaggtgcatgccaccatgctaggctaatgtttttagtttttgcagagatgcgatctcactatgttgcccaggctggtctcaaactcttgggctcaagctattctcctgcctcagcctcccaaagtgctgggattacaggtgtgagccaccatgcccagtcttaatcaactgttttagaatattaacagagtcttgatttaaactagggtctggaaaacctcgattcaaatctccaatgtattcctttatcaaatcaatgaacaaatgaatacgtaaaataaggcaagccatttaacctctctaaggcttagtttccctgtctgtaaaatgggacagtaacaaagcccactttatcataggatcattgtaaagcacttagcaccatagttaatattcagtaaatggcagcgcttattactgttattattaaccagtatggaggagcggatcattcaggatataaaccaatatcagatctttttctaattttaggaccaatacaaatatacacaagatttaatactcagggacagtgtctgaaggtaggaactaagacattggccatgatgtcataatcctctgaaatgtgtggaaattaagagtgacctactcccctgacccaaatattataagaatggtgtatacaagggaggatggagctgttttgttaatacaagggttagaaaaatgactgggtaccaccatggatttcagagctggaaggggctgtgaggatacacttatcattggccggaccactgaatcctctcatcgagaacagtatatttggttactggtttatggttttggttcttcctttagagttcggagttctgtctttatattttagcttgttcaaaaccaaagccttagtttttccttttataaagtggagaaagtagcgattacttttcctactattaagggggctaaatgaagtaatgtatgccaagtgcttgtacagtttctggcatatggtaagcacttgacaaacagtaattattaggatgattattgccaagataagtgtcctgatttctgggggagactgattcacaaacaactaaaagaaaacatgaccactgctacaaggtcggtgtgaacaaagcacttagagggggtatgcagtgatctagaatcatttctgagatccccctgagtgaatattctgaactggcaggggtgaccttctaagcttcccaaaaccctggagaagactgcattggggaggaaaagcccttcaagacttgagaagcactgcaggtccaataagttgtaatgaataaacaggagtgtgaaaatgtagcacaaaatgttcaaggaacattttggcaaataagtctttattggaaacacatgcacacaacttgtaagcactgaattttaaaaagcatgactaacctaaagtaatgtcctgttggctcatcatctttagcctctatacagttaagtgtcactcatttaaaacagtataaagaataaatctgtttggttcatgctgcagtgttcaaacaactttagcagccaattagcagtatacaaatttaaaaacatgcacatcgtttttatttgtgttataacacacactatgtttttcttaattataaaattgctaagatgtatagatgcatgcttaatgcagaaactaataaaatgttttaagaatccagagaagaagaaaaatcactaaaaaattccactacttggagaacagagaaaacttcactgttaatataactttttttgtgtctttttagtctgtcttttaaaaattacgtattttattatatttggatgtataagtatatttaagtaaaagtggttattattctgtacacattattttgtagctcttttaaaaacatgtaacaattcattatcaacattttgccactaataaaattctgcaatatgactttttttatacaatgagatttttaatggctgcatggtttttcaccctgggacatgccataattattattattcagttttagttgtgttactttggcacttatactacaggtctagttcttgtttgtttaaaggtagagtagattaaaagggcttgttaatatcataccaaagcatgggttaggcagtatgaatccacatgactgcactaacgttgattccatgtgtatgatgcctatagatgtaagttggttctacataagaatgaccattctttagattttattaggctacttaaattttttttttgtttagcaaatggcttttcttttaaatctccaatatctagacacaattggaattctgaaccaatgaacactgagttaacgacttaaaaaacaaaatcttgcccaacatctcatgaccttcagtaattcaaccacgagttaggttgttgggcattgtgaacctgtaataagcatgactggggaacccctctcagtctttagccaacctttattgcaatacctaatttcaaaggtgaagtacattcagctacgtcaggaactctggtcccaaataatcataagatatagtcccaattccagaggattatataaataaataaattacaacattaaatgaggtaagaaaaaaacacctttcctacagaatcacaagaagtgttttcatcaaagacatttcaaaggactctctacgtaagcttatgatctgttctatctcagtttatagtatcgtgaggcatactcttaaattagctcaagattttaatctaaattattctgtaccatatatgactcaaatatttcacagtaaccctagtgatgcaatgcaatgaaactacagataccaccaattaaggctctttcagttaaacgcaggtttaaaagtttccctttttatgttatacggcacagtctggtataaaaagtttgaacatttagtcatacttatgataaacagtcacttgggaccctcactctatctttttaaaacatgcgactcgcaagcatgtttcaacaggacaccattgtggaatgaagtctggctccgagagatcttaggtggggctttatcttggcaatgcccctaaaaagactctggacctttctgaatacaagaaatccttgaagtcttgtaattgtttctcttaggtgttccagagctctaatcctcttatttaaaatcaagacaaacaagcaaactaaaaaacgacttcaggcttttctaatgggaaaaggttgatcatggggccttcttttctttttcttttctttttagaggcagggtcttgctctgccacccaggctggagtgcagtggtgccatcatatcatagctcactgcaacctctaattcctaggttcaaacaatactcctgagtagctgggactacaggtgtgtgttaccatgcctggctactttttaaactttttgtagagacagggtcttgctatgttgcccaggctggtcttgaattcctggcctcgagccatgaatccttccgccttggcctcccaaagtgctgcaattacaggtgtgagccactgcacctggcctgggccttattttctcattacaagaaagtatgattatttccaaaagacactaaaaacacccaagtcatatcataagtcacagaatgacaactttaaatagacaattctggatatagggatatatcttgtgatatattcacatcctcaaagttttagcaccaaaaatgtataatcctcagtttatttaaaaattaaaaacaggacatatccaacttgtaggcaaagataatctatttttctccttatactctgtaaacctcagtcttttcaaatttgttattcaagttttcacagaactctctccatagtggtttgtctgtttcctatgaagtgtgttagaggaggccacagactaaaatgtatcacatataacaaaggttttttaacactaaaccaataagaacatgttgaattaaggtgagggttacgattatagcaacagagggaaaggtcacctgagcctgcatataacttctctcgcatgtctccccatgtacccctcccctcagtccttgacagccaccattctattttctgtttctatgaatctgacaactctacatacctcatacatgtggaatcacactggatttgtctttttgtgagtggctcgcctcagttaacatagttcctttaaggttcattcatgttgtggtgtgtatcataatttccttcctctttaaggttaaataatattccattgtatgtatatatgacattttgtttatctggtgatccatagatgggcacctcagtagtttccactttttggctgctgtgaatattgctgctatgaacacaggtgtagaatgatctctttgtgactctgctttcaatttttttggatatatactcagaagtggaattgctggatctattcccagaatgttttaaaaccatggttctcccataaaatgtggtatattgttgctacctaagcaatgaaatagtgactaacagcatcgtgttaaggtcctaaagcgttagccaagtggcttgattcactccttggagattccacccacttttgtctgcattctgggagaatctacactgcaggtccccacatcaagcttgctgtatgtatacagcttctactctatttcaaaacctgacagggttcccgtgtgctttcattgatcaatttgcaatgagcaatgaacaatgagcttcaaaggctgtttataaacaggtctcccctacttctcactgtggtcctcaggaggacccaaagaatgcttcatccaaaatcacaaagaacaagacaaacaaattctgagaaaccaagaggagggttcaagaggattccttaaaacttccatatcacctggaaagttgtaatgggtgaattcaaagcaagccattaactggcaagctaaaagagtcacacatgagctttgttccacagcaaagcatagtccagcaatgccatagtacccgtctctttgccactgtgcatgatgagtcaggcacacatcacctcgaggcccctcaggagaaacaaaggcatgggccctaaatggaaacactggcttctaatttttactgcttctaggcaactggataaaagtgtaataaagtggcattgcatgtaaattttaataatcaaatatgtattctgaaatgagaacagaacccactttttattcattcctggaagtgatgataatgctgagaaggtaaagaatcagtctcaactaactggaaataaaaaaaaaaaagataataagtcatttccaccaagcctgaaaatgttggtgtttgaggaacaatgtaatgacttaaatgaacaacatgaaagaataaatcattacctcatcataatggctatttttaacccactgtggaaaatcatcaggaactgaaactgcaaatatgcaatgctaaacataatttcttcagagcaggagataaaaatcagcactgggtaaagaagtaagaaaacatgaagcccaagttcctaggttgttgggtaatgacccaagtggctatcattctatacacattgttttgtgaggcttttaaaaacattttacaatgtgctgtgaatatttccccatttcaacacacacttttctataatgaaattttaggccaggtgtggtggcccacacctgtaatcctagcactttgggtggctgaggtgggaggatcacttgagaccaggagtttgagaccagcctggacaacacagggagaccctgtctctacaaaaaacaaaaaattagttgggcatggtggctcatgcctgtggacccagctactcgggaggcctaggtgggaagatcacttgagcctgggaggttgaggctgcagtgagccgtgattgcaccactgcaccccagcctgggcgacagctctcaaaaacagaagaagaaattttaataagctttctaatggctgcaattggacaaaatactttcttatctttccacattcttcctctcaattccctcttttgagaattttcccctcactctgtacttccttcctcttcaaatgaggtaatgcttagaggagctggttttccacaagagtagaacagataattatttgtgtgatatagaagatactgctggttgtcagccatgaagacctggtccaggccaatgaaggcaatcacatttccttttgctaggaattgatccagggatgaacatgacacccagtcctgtatgggcaaattggctagagagtttcaggaagcattttcctccttgataagaggtgcacagtagaatgctctctgctgtacttcctcatctcccattcctcacccacgtcttatactgaatgctaccgagctgtagcaaccatcttgaaacatcatctgtacacataaaaggccagagtgtaaacagggaaagagtctgggtctttgatgacatcaatgaatagctgcatcaactttagggctgtctgcctccagccttgtagttatgtatataataatgcccttatctggatccacttttcattgagtgttctgtaatttgcagctgaaaattattctaacaaatctaacttaattaaaattatattaacttaaatatgttatgaacattatctttcatttatagccaccatgattcaccccagggtgaggtacagacccaatggggcctgtaccaacattcttttcctgttggcaatcatccctttcaggtggttatccttttctctttgaggtgtgtacctccttccattaatgtttataatatcgcctttgccatcactatcatttactgtcaactctctatattccccaggaaccatggctcatcctgtttaccccacactcaacgtcttcctgcaggactccaacatcactaggatgcccagctaatattagcttcagaactttgacttctttaacctcatcccatttttgccatctacataatactcatgcagatggttagtctctgttttctaaatggaatgcgaatgcatacaattttgtaactgtctttttcacatcatgctgtatactgaactcatttgcatgtagatctattggcaatgtagatctacagcttaatttttaatggttctatatttttctatttttatttatattctatgattagcaaaagggtttaagcagtcattaaattacccaccaattttaaatgccactatttctcatgttctaaattacttgaagttattttctggacttttgctctttgtttctggctctgtttagagtacctctctcctttaattattaaatatttagagtaaattttaacatctgcagggaaagttttctctttccactctttataaaacattcctgaatattttttgaaaataaaaatatgtatttatttatttttagaggctggtctatgttacccaggttggcctcaaattcctggcctcaagttattttcccacctcagcctgccaagtagctgggactacaggtgtgcaccatcgtgtctggcattcttggatattcttatatgttatgattatgaactgacttcagaatcattttattgagtgcccacaccttccaaaaatccttttagtattttcaatgatttttaaaaattgataaattgatttggggataacagatacctttacaatattgagtctttccttttcttcatttactcaagtcttgttctgggctcctcagtaaagtcgtgtctttttaaatacaattcctacacctctgaggctcccactatagcgggtctggtccgccttctccttcctcacatataccattacctagcctttccccactgatctcagtcctcaaatccatcttgtactctctgtctagactgaacccttaaaagtgtaaacctgatcctatcagataattctcctgcttcagccccctcagccaaagcccacctagctctctggccctgcctcctggtactctgtggatttctgccatctttactcatttactgccccatggccccaactcctggcagggtcctgcttaaattgctcttcctctagatttattggcctcccaccacattgtactaatgggtgtcaataaatgctcaatgagttttcataaagaagtgagggcccaaacaaaactaaaaatgaccatgaaatctatgaaggccattagcttaaaaagaactcactgactccttttaggaggaatgcgataaaactccaggggaatcagaaagagcaggtttggattacgggatagggacaaaagaggcatggcatataaatcagtattcgtaccttttagccattaaaacatgttcatatgtgttgagactttgggctcattattttagaaatataaaactcccatgactataatgaacactgacacactgaacaaaaacaatgaaggatgcttcctatcttaccatctctttcagaagcaacttgcccaggggtcaagagacatggatttcagcacattgttccacagcttggggtaggactagcttaagtaccttatcctctcccatctctaagagaagtattccacagatcaaatcactttgcctgagtcttcacttggatgcagaattggactattggccaaatcccctaatactactttaatttcatatgatcatatcagagtttctcaaagtacagtctcttactccagtgttactaagttccgttcaactcagccactagtcagttgattaagcaagttccaccttccttcttatcatttttgtaatagtacagattttttatttcattttttacttttgtcaacttttattttagaatcgggggtatatgtgcaggtttgttataaaggtatatttcatacctttgtatgtctaagggtgtaaatgattccatcacccaggtagtgagcacagtatccaataggtagtttttcagctcttccccgctcctctagtagtccccagtgtctatgaagtcccaattttttggagcctcaggttttcacttataaaaaccagaataaatcctgccctgcctctgtcatagaactgtggagagaacctagacatttgattattttatattatagatttgatttgttttttaaactgccaagcgctatccagctagattgcaaattccttgaggaacaggaatgcaatgcatctttatattctccaagaatcgaacaaggcacgttatacatagaaatcttttggttttacttgattggatgaatcacccaatagtctatagatatgcattaagatgaattatagtgacctttgctcttggttttgtgtacaggagttatagaacattctcaccgattaaactgattcctgagtctttctttagcaaaaaagccataatcctgcattgtggcttattggttattcactaagaatttactgactgcttgccaagtggaggcataaaagtattaaaaaagtttcttttgggtacgtataaacctaagtgagtcacttagacatgagatgtaaatttccatttttgaaggcagtatgatttaaaagaaagagcactgggttttgagctaaaagctttggatccaaatttgtacttgcaagttagataatctaagacaagtcacttgcaactttcgtgggccttgcttttcacatctatttttgagaaaatgaccccacaaaaagatttaaacaagatatattatagattatgtaatatatatttatatatgattatgtgtattatggttatatatatgacataggatattatgcttaagcactttatttattgtaaagttcatacacataataaattgctaccacttattcaaaagaactatgaagtccctactatgtgtaaggcattgtgtcaggtgatgctacacggaagcacctgaatagagtgtcccaaggagctcttactctagcagggagaaaagaatatgtacctacatacttcatgtcagtatgtgccaaggaccacaaatggcacaagagcgctaggcactgagtaagcaccaaggagggagcagcatctaagccaatctgggaggaaggctggtattagttttggtgtggggaagcatctgtcatggaggacactaatagaggaggaggaagtgcttacgtgtttgtacaccagctatagctccagcaggcagggtcctaaagagggcacactgctaaatgggaccacactgcaaagggatttattgctggtggacacagggagtctatagtgttttatcttatattcagtgggtaagtagtaaaaatgtgtaaaaccatggcatgttattattgacattttagcatacataatggatgggaggtggtgtaaggaggctatgatactattctgaacatatgatagagaaggtctaaattagaatattgaaacaaaaagcaaggggaaaagcaattcaagagacaaatgtgatatattaatatttgttctcacagttcaattttaatggcccatctttggagagctccgctacatttccaggttgcacactgtgtgatcttgggcctgttatttaatcttccctccgctagcatctaaccttcgtttcttcatctgtaaaatggggacaacactttcttgtagggtggctacaagaactaaaaataatgtgtaaacctcccagtttgggtaaacaatgtgtaaacctcccagtttgggtaatgggttcagcactggtgccactaaatgaagatgaggctgtgataatactataagttcagatccactgaattttccccagttagtatgtggatagccttctatcttccctaacactctattaagatcaacaaacacaacttataatataatccttaaaatatctgttgttttaattaaatcaaatgttatgtggtctgttcttaattttgaaagtctaggtccttagaaattatctgttattattcattgaatgtattacatgtttcattttgtaaatgacccaacttgctaaaatggttttaagttgctttttccctatacctggacagatttttctgtaggcctctctgactattgagatttcccgaaactgtccttaggtgctttttataggataataaccggatactataagcatgaaatataccattttacttaatcaacatatatattctgaagctactaccaaaacgggaaaaacattacaaatgaactttcttacatagttaactctggttgctttctcaacttaacaaataagaactagaatttgtgacattatttccttatgttatccattaatgctgaactgtgtgcattccaatacagagagggggagaggagcaaacaaggactctgaaaagaacacttagcttcatttggtcaaaaaatggtctttacaagggtttttattatgggtcataaaacatgcttaccacaatgtacctccttgaaaaagaaaagaaacccttgtagtggtgagaaactgaaaacaacacactgaaagtccttgtgcctccttcccataaacacatctgtgcatattatctgttttgggtagagttgcacgcacagctgcttatggggactccatagaggtgggacttcaacattttttattttgtgttgttgcaaggactgactttttaaactgaagtcagttatgatagaggtagccaatgtatctccagtggaaggaggaccatgtactcctcactaacaacttcttcaatctgctggaggaagaggatctgggtggtcacaactagtcaggaaaagcatggaggtgcagaggaagggggatcttcaggccaaatggaactgaagagctacccaccaaggcaaaactgagaactgggttaacgatctaatgactcttacaaagaagaatttatccagctaatgttaaaattggtatcacaggccagcacagtggctcacgtctgtaatcccagcactttgggaggccatggcaggcagatcatctgagatcaggagtttgagactagcctgaccaacatggtaaaatcctgtctctactaaaaacacaaaattagctgggcatggtggtgcatgcctgtaatcccagctactagggaggctgaggcaggagactcgcttgaaccctggaggtggaggttgcagtgagccaagaccggccactgcactccagcctgggcaacaagggcaaaactccatctccgaaaaaaaaaaaaaaaattggtattacaataggaattgcccagggaaacatgggcatccctatagatgggaaactcttagtgttcagcataatagagtacaggtatccaagtttttgcattgcaaatacaatttatgtattcagtgctactctgatttagggatacccctgtctaaaatgtcttgaactagttgttttcttaaacgtgcgcctcttgccttcaaacttttcctggcccacctaaaacccccagtcagcttttggtattattctttttccaggcaccaaaaattggcttccactttttcttatactggtcctctaaggcctaatctcagaacaatttgcacatctctacaattaggactgctgagagaaaatgttcataacaagtctgaagtggttgcacatcatggtctctaacttcatctgggctttcggtactgccttctctgggtctctagtaagctccctttgctattgtctataatggctaccaaaaacattcaccatttgtttgtgtttccataattacctttgcaattatacttctcaagactgtcttaaattttaaattctgcctccacccctcatctcccattcatttgtggcttcaacatttagtcacattctgaggcatccccagtcataaggcagctggggctgctctcccaagctccagatgtgcaaacttctgcatgtgcaaatgtacacatgcttcctgctatgttttttagaatagtccctggtaactgtaatctccatctgttccaaaataataatacagtttctttactcccaccaaaacctgtccttccatctgtatttcttatctggtataatggtaccaccatccacccaaatgatcaattcagaaatctgacagacattttagattctttctctcctcccaaacacatatctaacaagtcacgaaatcatggtaattatagttcctacattacctttcaaataagcccttctctcccatctccatggcccttgccaagtagtcagtatctcttgcctggattactacaatggtgttccgacacaaagaactcctgtctttagatttttgcatctttaatcttttctccactgcactaagtggtatttatttatttatttttttgagacaggatctcactctgttgcccaggctggatggagtgcagtggtgaagctcactgcagcttcaaactcctgggcacaagcaatgctccttcctcagcctcctgagtagctgggactataggcacatgccactatgctcagctaatgttttatttttatttttgtagagacagagtcttgctatgttgcccaggctggtctaaacacctgggctcaagtaactcttctgtcttggcctcccacagcactgggattacaggtgtgagccaccatgcctagccctaagtgatattcctaaaaggtaaatctgagtcatgcagaagtcccccactgttcactataagacaaaggtaaaacttagattgttacctaaagcactttaacgtctgcttcctaactatctctggattaatttccagctgttcctacatccctgttactatgctctgagggtaacatgctctattatatctctgttctgttgcaatgctatttgcttttcctggaatgcttgctccattgtcctatcccccgatatacacacatcttccaacatacacatcttgtctgtctggctcctttcaacttgtctttcaaggcttactttaagtaacttttggccacatcctgggcaattctccttacaggcacaggttatgtgcccgcctcgtataatctcacaatgctctgagcatagttctggcacagaacttattccactttactctaactgtaatgtcaccctccctagattacagcctcctgatgctaagaaagtaactggaaatgggggtgggatgagaaaaataaagaagcatcctaggcattttacatacattatttttttcccaggtactctgcatacattatttcatttatttttctcagcaaccccttgaataaattcatattcatttactcattctacatttgtatcatgagccaacttgtgtggcaggctggagaacaaggatgccttgtctcatggagcgaacagtgaaggcgggaaaccgaatttgagaagccagaaaggtgcctaacacacacaaggcccatatcatcagaaacctaagctcctcctcacctcgtgcccaggtacacgtggcccctctgcaactcctcaagtctccagcctcaggcactaagtatgaaaggaatgacccaatgctgctttaaaaatatgctacaaccttgtaattcaacttctaggaattcaggctacaaaaccaacaagtttacaatgagtcaatacaaagacattcagtgctgttttgcttgaaagagtaaaaaaatgaagacagctaaaatatccacaattagaggaatagttaaataaacgatgatgtgtctctctgtataatatcaagcagcaattagaaagaacatgggtaattctgacatgtaaactagataaatcgacagagaaaggagtaaggcttagagtgatatatacagcttgattctattctgacaaaacaagagatatatgtacaggtttatgtatgtgtggctatgtttgcattaggatggccagataaaacgtaggacactaaggtaaatttgcatttctgataaacaacaaatacttttttagtttaagtgtgtcccatgcaatatgtgggacatatttaaataaaaaatcatttgttgtttcttcgaaattcaagtttaactgaatgtccttattttatttgctaaatctggcaattttagtctgaatatatataaaaatgtttggaaagagatatagctacagttaaagattgctacctctgtcaggtgttgaaaatggtaggattatgggtgatttttactttttggattctcctgaatttaccagttaaaattatacatatatattaatgtttcttttaatcaaccctactttttaagttagtagccagcagtctttagaaaataaaaaaatgtagtaagtctctggtaaaatttgtgaaataaatcctctaaggaccattaaaaaaatattccacagaaacagacggcatagtacttcagagttttctaagtaatggcacataactttctaaattataaacagcactgttttatgtcctcaacagactatagctactcgaagatagtaagtacaagttattcagggttttttgttttgttttgtttttcttaactgccacttcctgacagattctagggaagaataggtgctcaataagttttatgcttttaatatttaaagcataaaattattggaaaagtaaaagctagaagtggtgctgacagacaataaaatgaaccattttagagacaaacaatgatacaaataagtactgggttgtttttaagatttactcagtttgtttaaaatattttagaatgaaaactaaatcaataatgtcctctcagaacaacttgaactttgcttaggttgagagtgaaaagcttaatcaaaagtttaaaggcaaaataaccaaggtaaataccctaagtaagaagtttcttttgaaatagaaattgtactttctttccttgaatatttccaatctctgcttctgttcttctgttatgtttgtcagaatcagcacacagcacctttcaaaaatgttttctgaaggtttttatctgctaaggctgtaagcaggcaactttttagcacagattttggggtcatctcagagtgtcagacatgacacttgctggtttgccaagaggtatcaggctcaccagtgctatctggtgtttctttaacacttatatttgaatgtagtttgtttttattttgtactttaactatatatctaagaggaatacagtttttacactcatcccaaaatatacatacacacacaaccttagactcttcattcacaaagtagtacaatggtaggctaaacaaattgtttttcttctttaaagtttgtaaactcttttttttctgaatttaccagttaaaattttatatgtataaaatgtatacatatatatatacacacacacacacacaccccttttgtacttttttggaagataaaatgcatgctggaaattgaaagtgtttaatatttaaaagcctagctatgaggcttcattatctgtaacatatttagagttcgcagttaaaaatattttactggagacttaaaatgtacaagtatgggatgtttgtgttccatattatgaattgctaaaataggctaaaaggcagtagggaaacattttgtctctctatatttttttaagtgctcagatagaagagaggtccaagtgataagaccattagtttgctgccctttctcggtgaagagagaggggaaggatcccattcaaatccctacatcctgggagatttttgcactgcatgtatctgccaaaggacttatactcacaatatataaagaactcctgctactttgagttcgagaccagcctggccaacatggtgaaaccccatatctactaaaaatacaaaaattagctgggcgtggtggcaggtgcctgtaatctcagctactcaagaggctgaggcaggagaatcgcttgaaccagggaggcagaggttgccatgagccaagatcatggcattgcactccagcctgggtgacaaaagcgaaattctgtctcaaagaaaaaaataaataaataaaataaaaataaataaaaataataataaaaaaagaactccagcaactcaattagaaaaagacacacaagagcgaaattctgtctcaaaaaagaaagaactccatcaactaaattagaaaaagacacacaatccaatatttaaaaatgggttaaagatgtgaacaggcacttcacaaaaggggaaacccaaagtccagtagcttgtaaaaaggttaacctcattaatcatcagtgaattgaaaattaaaagcacaataagatatcattacaatggtttaaactgactatatcaagagttgacaaagatggagagcagtcacatacactgatggtgaaacacaaatggtctatccacttgggaaacattttggcagagagaggaacaaaaattcatctcacagacaagatgctcagtaaaagaagctatacacaaaaagcacatactttttatatgaaataagtcagtgtagtgattacatctgggggagggagttatagactggggaaggcataaggaagactggaatgttctgtatcttgatctggatggttacactagtaaaacatcatcaaactgtatgcttgagattagtgcacccactttattctacatctcttattctgcaactaaaaaaaaaatttattgtctttccaatatttgtccaaatctgggaagttattcagtacaggtatgctattcaggacctccctggcaggctaatcattagatgtttcatggactggcacagagactgtattagtctgttctcacactgctaataaagacgtatcagagactgggtaacttacaaagagtaagaggtttaatggactcacagctccacatggctggggaggcctcacaatcatggcggaaggcaaaggaggagaaaagtcacatgttacatggcagcagggaagagataatgaaagccaagcaaaatgggcttccccttataaaatcatcagatctcgtgagacttactcattaccactagaacagtatgagggaaactgcccccatgattcacttaactcccaacgggtctttctcacaacacatgggaattataggagctacaattcaaggtgagatttgggtggggacacagccaaaccataacagagacctcagttttcctttgggatctgttgctgcttcttagtagtactttacctaatttccatttacatcagtttactcattggtaaatgggaggatactatgtttgtctcatacactattaatcaggtaatatgcatgtgtgtaactgctttgaaaagtaaaactattatatgaatgtacacattattattttacagcatttggaagaatccaaatttctccaagtaatgttaaatatgtaacatttttatcactgccaactccctggacagttctcaatttcttgaaacacgaagagtggaaagtttgtaagtaagacaaaaagtgtatagtcatcttcctttcactctatagtacactgcaagagactcaaggtataggctttatggtcctaactcttacctttctcgctgggcgaccttgggtaattttgtgtattttatttttaattgacaaataataactatatatatattcatgaggtgcaatgtgatgttttgataaatgtataaattgtggaatgattaaatcaagctaattaacatgtccattttatcgaatctaaatcttaatgtactactaaaaaagacaaatgactgtcaaactgacatgacacaatttcttatcattcagaagttttaattatgcccattaaaagggctcttgcagacttcttcacatttggattttatctatcattcttgaacatacattaaaaattaaatttgaaatgaaataatttgatgaaggtattccaagaatttcttcacattcagagtcctgctctttcacatccttttctactcagagttgttagatgtctgtgttttccacacaattttgtcttctgtcccatgaagggcactgatgacagagcagtagaactctactatgacctcgaggattttcatgcctgccattgagtaactctgcaagtttcaggcacgtgggcaggcaatcaccactggatcaggactgatgcctgcgaacagtgacttcaaaatgtgttctgttttcaaaggcccatttgtgaaaaaatgggcatcttagaactgatcaaatgtggtacttcgctctttgaacctctttaataaaataatatttatcttcacaggatatgataaagattaaattagataaggttgagggtagagtatttgagtttgaaaataactttccatgaaaaaattttaaatgtagccgctatttccaggaacctgtgttgctgataagtctgctgctttttcactttgggccccaaatctgcttcatactatatttatcaatccagccatccaataaacactgaatatacagcaaaagaatgaaaatttaactaagcactatttttatttgctaaatctggcaaacttatcacctaccctaatcttagtctcttccaaagaggtagtccctattatcagtttgttgtatattcttccaggtttggttctgtgaattatatgagatatacatgtacttcagataaatggaaccaaccagaccgtacctacagtccaaaaaatggctttcccccaactcaacactgtgccttaaagataatttcttataggtctatgtcattctttttaattgtcacatagtattctatacatagcagtctattcagccatccctctactaatgaacttagattatttccattttttccattataattaatgctacagcaaattttcttattcatgcctccttttgcccttgtaccaggatttctctgagaagtgagaagtctcagtcgctgaacatatgtatttttaatattaaaagatacttccagattacctccaaaatgctttaaaggcaaagcatccctaatctgaaaatccaaaatccaaaatgctccaaaatctaaaacctcttgaatgccaacatgatgtcacaagtggaaaattccacgtttaagtacttaacacaaactttgtttcatgcacagaagtataaatattgtataaaattaccttcaggctatgtgtataaagcataaatgaaaaataattttgtgtttagacttgggacctatcccaaagatgtctcattatatatacacaaatattccaaaatctgaaaaaatacaaaatccaaaacacagttctggtcctaagcatttcagataagagatactcaatctgttccaatttataatcccaacagttggtgtacgagactatccatttcttaacagtctcaccaacacctgacattataaaactttttattttttttgcttgcctcaatatgatgggggaaatatttactatcattttacttttcatttctcttattgtagtgagatttgggcattttttcatacttcttaaccagttatttttctatatgctcacaacttattattttaataacctaaaatcagtatcaattttgctggattgtattttgtagaatctatctttttcctatctttaaaaaaacacagaatatttctcacttctagtattgtggcacctctcctagattccatgactcctcaaaggttacatggggctcagaagttgcagccacaagttattgcagtgccctgagatataccttcctattccaggccaaattcaacaagactaaactatataatcaccttccccaaactgataattaacttacctatttctgcttttcctttactccggacaatgagtaaccaagtcctgtcaagtcttctcaatttctcatttccttccaattaatcatcattgccccactccaggtacaggccctgattatttcattcccaaaccagaggaccattctctttgactgatctcctgttgtaatttctcctaaacgagcacactgctaccagattaatcagctgaaaacacaacaatggtatcagccacccacccaagagctgcctaatttgagtttgaaacacagtgcctccacaatcaagtccacttctctcctgcttaactggcttcttgcactcatctctccagatgtacccagcctaatggtgtctttccccaagtggaaaccagcaaatcttgagcaagacttcaaatctctggcttctgctggcttgtgtcactcatgcctcagagtaacagcttcaatattctaaaaaaattgccactttctttaggaagccagtccttatttttccctcttctgaattcctgtggcttttgtcatttgtaacacactgtattcgtcataaactgccttatgtggtggctatttctctatgtatctcattctccctttctagattttaaattatctacaagctgtgtgtccacattaacatgctgctgcacaaggacttacagaataaataagatataaaactaggttgtatttctttgctaggtaggctttcttgttcccatataaagcaggccaataaaaggtgatgtattttaaatacatcaaatattagaacattctaaaaattaccatttcaatttcatcagctaccatcaggaaagaattgagggaaaatgcgcagatggtaatatactatattattcccagggcttttactttttaagtgtttcaatacacaatggaaaattcttaaaattaaatctctaaacttattgtgtgttctaatggcatactgcatgttctatactcagaacttttacagataacaggttacagaatatggctttccagagaatctgaagattttcaatagtatttcaagaagcaactattatatcatcagcaagaaggagcaggaaatgcaaaaaaggcattttatagtcaacaaacgctcaaaccagaaggaagaaaggcctttagggacaccaagtagatcaagtcattttggcgggccattaaaggctccatgcaaaatctagctgacatcactttaggcaattttgatatgccagtattattactggtcagacccttggtatagttctatgatcagttgaaaagcacatggacgtaactagaaaatacacaagagaagaatctccatcctttatatcatagaatgctgaactgtctacaaaatactttctacattttaactcatttgacttgcatattttaatccttgttttatggataagaaaactagggctcagaaaagtcaagtgacttgctcaagtcacatggctagtaaccaggtgtcttgttgctagggactctctttcataacatagaataaataaaatgaaataagcagatggtgtcttttggccttaagacctctcagtactacagtacttccttaaatctagttgaggcactgcttcctgaggccccatggaaggcaaatatatgactactcatatcccactcccattccccatccacacctatagaattaatgaatgtgattttgcaacttaagatcaagtgagccaggggtggtggcacatgcctgaaatcccaacacggctgggcgcgatggctcacacctgtaatcccagcatgtgggaggccgaggtgggcatatcacaaggtcaggagtttgagactagcctgaccaacatggtgaaacaccatctctactaaaaatacaaaacttagccaggcgtggtggcgcatgcctgtaatcccagctactcggggggctgaggcaggagaattgcttgaacctgggaggcggaggttgtggtgagctgagatcacaccactgcactacagcctgggtaacagagggagactctgcctaaaaaaaaaaaaaaaaaaagaaatcccagcactttgggaggctgagccaggagaattgcctaggcccaggagtttgaaattagcctgggcaacatagcgagaccctgtctctacaaaaaaaattaaaaagttagcttggtgtggtagtgtgcacctgtagtttcagctacttgggaggattgcttcagcccaggagttcaaggctgcagtgagctatgatctcaccattgcattctagcctgagtaatggaaatgtctctgtctgacaaaaacaaaaacaaaccaaaaaccaaaaccaaacaaacaaaagatcaactgagaaaaaacagatgccaatgtccaaaaccaaacctgaaattcttcagggtattcatatcaaattctcattcctataatcacatgtacatttttgatcctctgaacctcttttccacttatatctcatagggaacttctgactgctctgcagcacttggtgggtgtgtcctgtaagtttttgaaggcattctgctgtactgatttgtagccttctttagtcctgtgagggtatgcaataaatgtttaccaaattgaataaaagccacatgtttattcaacatacacccttatttgacaaatacgcaagtgattaccagggaaataggataataactttgatagtgcatagtgagcactactgaaatgaaatgcagagacataaatgattacaattcttcatggagaaaaaatatatactgtacttggaatgaggctctagttgaggagaataaaatgttaagaatgaaagttctagtgaagagagcattactgattctggggtaggtcagtcaaatgagggcaaagttcaaactaacattgtttttagagcaatgtacaagcaagtatagtaacacattcaaaccagtaataagatgttttaaatataggtctttattctaggaaataattctacatgagtgagaaaaacacatttatatggcttttggaaagtccaccgaactagaataataggaacttggttacagtcctagcacagtactaactgcatgactttgggcaactcaccaccctcttcgggacccacttccttaaacataaagtggggagaggctgggctacatatattccaaggaattttccaactctaaaaatgttataatttcactgatttgtgtataagtgataccttcaggactctaaaatggcctcctgagtaggttaaaaatgattcctccagttttggttacaatcctaatttgtggattccactttgatcaaccttgccagcttctcaagatttcaatttgggttgccactacgccatattttgaaaattacaagaaagagtaaaacgggaatgggctgactttacatgatctatgagtcacagtgataaaaccttattgtaacaagccatttctaaacaaaagtaacacaaataaatgaatttacgtcacaatgtggaaggcaaacctttttcagcatcctagtcaccttttgagacctgatggaatgacctgacagaacaactggaatgctggttttgaaaatgtcttgttatagtcacagtgtgatctgaattggtttttgcaagcctttctttggcttaattcagttttcgcaatataaaaatttacctggcataaaggaagtttttaaaaaaaggatttaatgatacttaatgacagagttttcaacagctaataagccattcattcctaggttttgaggcagaacatggattaccagctaaactactacacgatttatttcctgtacagacgtcatatttgatcattacaagaattgataataaaagttatgacttgggaggtcttcgtatttttttacaaaggaaatagacacagattctaatatatacaaaacactaactagacaaattcctggagtgctttctgaattgccaagaggaacaacgtcatataaaaattccttcgaaatgctaaaattccatttctagtggtctctcataatcttcctttgttctcaaataaaggtgtaaaatattttgtcacacaagaaaaactgctaagaagtcttaaggtgatgatgaatctcctactttggatactagattattgctgatattttaagaagaaaagaagtgttcgagatacattttgtcttgaactaagttgggctctaattcacaattgtgttaaagttcatgtatcatgtgtaaaagttgtacatcataccctcagattttttttaagcaggattttttcattggagagaagataatttaactggagactatcctaattcaatgataacaatacagcaaaagtaaccataaacaggtaacaattaacagagatctgtgaggaaacagcataaaaactgttatcacatacgcagttttattaactttttgcaaataaattaggctgtatctttgtaaagcacacagtatgtattcctcaatggttgtaaagtaaatatgcagtgataagagtatattctccttaactctgaaaataattttagggatgttaagcaaacaacaatatattttatgaatggccaaaatctaatgaaaaacttttatttctgaatcctatcatttataccatgtggtttaataataatacaattaaatatatgtcttcatttcatttctgaatttattttatacacttaagaggattataataattaaaattataaaaataaattaccttaatggcccagagggcacggaaatgctaaaacatttatgttaagtaggagttaactcattaaagagcactgacaaagatataaaaattatatttaattctactatggtgacttagatgaaatgaaaacagtctaatgggttgtgcaagagtcacaaatctagctcctggctctatacttgtgtgaacttgggcaaatcattaagtagctatttatgccagctgcctccatctgtaaaataaggacagtgctgcttcccaactgcatgagaatgtcctaggctcagctttgagaagtttccctcagagtttaatctttaaaaaaaagccaaacccaatcaagatataaaggtataggaaatgttaaatttccttaaacttgcagactagacaatgtcttccaatggcattgcagaggttgaactattccactgttcatgaaaatagtcatgttattgattcactactaggcttgtgtctacatgagacagaactctgagagtaaacaggggataagttctggtgaaaagaatgcagtgagtcattaggaccacaagtgaaatgaaatgctataccaaatgctgttgaaactttgggacctaaaatgagaaactactttttcccatgagaactcagtaattatcattttaatgcatgttaggaaagattttcaagttcttagatgacatgtttaaacgtaagtgttttcaatgaaatacgccattttataaaatacagtcactattaattaatgccaaaactaagagaatttttatggaattacatacagacatatgactaccaaagcagttcatcatgattgatgttattattctgaataccacaggagttagtaatgattcggtgccttcccatgaagttcaagccaatgttttttttgtctaattggctcatcattgttcactaaattggtattttctctgctattcctatttccaatcctctggtattcctctagagtctacacaatcttcaggtaactgcttcaactgaagcctgacattatacgacagatcctgaaattaggccaaagaaacaattctgaaataataatgctttttaaacatgaagcaagcctaatttatttactttctctatattttcatatttaaccaaagaaacaacctactttatggtgattaaatctacttctgaacatcaaattgtgaccttattaagttattaaattatatgcttcacctgtgaatactgaagcatatgatttaataacttaataaatgtcacaacctgatgttcagaagtggatttaatctcaaatagaattcaattactgatgatcccctaaaatcagagatcagcaacaagagtagatgaaaaatcatttacagtctacccatctgtaagaccagagatcccataattagtgattgagcccatactcatgagggctcgcatttatgtgtaccttactgattttcctttgtgatctaacatttgaaaaattataaataccgaatgaggcaaatttctcagaatctacacattattttgagaaatacttttatttctcaatttttagatatacttaaaattgcataagaagattatcttatttatttatttatttttgagacggagtcttgctctgtcgcccaggctggagtgcagtggtgcaacctcggctcactgcaacctctgcctcctgggttcaagcgattctcctgcctcagcctcccgagtagctgggattacaggtgcacaccaccacgcccagctagtaagaagactaccttttgaaattggcatctcttgctctaagagggccaactaaaactggtgcctcaagtttcctgcctgacatcatggcagaagtattgaagaaagccgtttctacctcagatttgtggttcattcctactccctgctttcaatgaggtaggaggacccctttgttgctgctagtattggtcataactcctgtgctgagtcagctcatggaatgatataaacagttcacctgggaatggaaaccttgtgttccacctctgcttcattgtgagatcatagacaagtccctaacctctgatttctgttttctaacatatacaatgagggtctcagactagataatgtcataggatgggaacagccctaacattcatcactgacaatctctccaggctctgcttggtgatcctgtcacttcttccacacaggaagagatgaagtctcaataaacacagtaacactgttacttccactcaattatcctaatggttgcttctatccctcacttaaatattttaaatggtgccagcatcttcctcagtaacattcaggaagcatctcagtaaaatcagaagatgattattccctgcactgcattgtctttggtgcaatcatttagatgaacatcagctcattttcctgtactcattagtattgatcattttcagaactcctgtcatttttatgcccccaaagcaaaatggtctcttttcagaggagaaagttccaggtctacataaatgaacgcaaaacctgttgaagttaaaacatggtaagaaaccattcttttcccccattctttctgtaaacagttttaatgattagttcaattgagtaagttggaacaaacataatttcacacaggaccatctcagtcacccatccctctgtgctggtaatcagaatttcactagacaaagccactccaaagcacagtatgtgcttataaaggttagtcaggactctatttggataacagcagcttaattcaatctttaaaaaataaaacaacagtttttggaagcctgtattttagagtttcttttctcatcttggattgcctttctcctctataactggttctcatttcccaaagtctcttcttgtttgtgctccctaaaagtcaccatagcttgtggtaaagaagggttgacagtcagcaagatggatctttctggaaatggaagccgtctggagcccaccaattttaactacttcagtttgagctgaggaggagtttattgccgctctagtccccttccctgtggcagtaaattaccaacaattaacagagtccatttcctttcaccctcttggccctaccactcttctctgctctcagcaaaaacataaaaacgatcccccaaaggacaaaacctgccaccaaggcagcagcactgtggtaatttcccaaggcattatgattgataatgatcagcagagcgtgggataatagctccccttaatttactggtccctttgaagggttaaaatatggcagatgttgatagccgacactccttgctaacaggaaagacacattgctgtggggcccacttctaggctttcctttccccgcagctgtctgtgtagggctaattgtatccacttgtttaacctcggggaacgtctggaggggacccagtgccacaagggtaccttttttttttaacggtcatttcctctctggtgtaacttgcatgacagtatgtgacaagcagaaattaatggggacactgctgtgccaattcctcctgaattgctgacactggctacaggctgcctgtttgccacccagccaagacctcacatgaaacatggcgaggggcccacagctctattcaccaacaagccagctggtcagtgatgagaggagctgaaacaatgtggtgcgcacaaaccaggaagaaaatgctttacaaaccgcttcaaaccaaggaggtggcatttgctgggagttaatatgctagtttattttcctgagtggcaaattgctgcaggactccaatctccaaagtgcattagatataaaaagtattcctcttccaaagcctcctaaggtataagttggggtgcggataccattcaggcaaaagggaaccacatgagatttatctccaaggagtcttttccaacagtcagcttccaggaaggtctgggagccaacagggtatctcttgcctctagctaactaccacagagctgcccggtttaaaaattctatgcatgggtatctctttcactctttcttgcacatacaagtgcacatacaaacacacacacaaaagaacctcatgttcaagcccattaattgcccacaacgttttgcaaggttggagaatctgccccaaccttggcaaagtccactttctccctttaatataataagggatcaaactcagctggcggtcacttaaaaaggtggctctgttatagattaggccctgctgatttaggcacagatgagtgaatagaggcatgtaaaattgtaaaaaaaaaaagaaaaaaagacccagcaaaaaactcacctaactatgatcttgtgtacaactcaaaagtcaagtttaaggagaaaagggggaaaggtgtaatgggaaaattacattggtaagatttttacaacaaatttgggaagccctaaggccatttcaaaaaggcacaacaaacaggctcctcaattttgtggctgggcatggcatgtagtgaaattttgctgctctgaagtagtggagaagctcataaaaacaagaatctatttaattcactttttcttctattcaaagttttaaccagttgatgtgaatcggctttacccagtttctgggaaaataaggaaccctcacagaagccagggaattcagtcaatgaacaatgtaggtttagatctaggttagacagggctctcatttgttggagaataaaagagaagagactgcaataacttaaagagttgtatcaggttcactgttggtattaatagaaggaagatgtatgcttctacttccaggggaactcttccaatgcaacattagagtggtgggctcaggattgtcattctttggccatcctgttaaagggacaggcaatctatctttccaataacaaatgggattaacaaaattctccatttcaattgggcaagaagcgcaagaccagagggggaagaaacggagtatgcatacccacctccactggataagggatctgggaataactttggtggggcttttcttttctaaatataatttgtgagagagctactgaatttaggaaaggtttaaaatgtttctaacccagaactgaaacacaggcctggaaaaaaacacaaaggaagaagtcatggaattggaaatgctaatctcttaaacaaatacatttccaaaatatactatataatgcaacccgagccttttaaaaaagttcactgccaatatagtctttaaggatctgtgctttctgataacaaagtactgtaatattgatttttaacttttattttaggtttgggggtacatgtgaagattttttatataggtaaacttgtgtcacaggagtctgttgtacagattatttcatcaccaaggtattaagcccagtactgaacagttatcttttctgctcctctcccttctcctaccttccaccctcaagtagactccagtgtctgttgttcccttctttgtgttcataagttctcatcatttagctcccacttacaagtgaggacatgcagtatttggttttctgttccttcatcagtttgctaaggataatggcctccagttctatccatgttcctgcaaaatacatgatcttgttcatttttatggctgcatagtattccatggtgtatatgtaccacattttctttatccagtctgtcactgatgggcatttacgttgattccatgtctttgttattatgaatagtgctgcaatgaacattcacatgcatgtgtctttatggtagaatgattcattattcctctgggtatacacccagtaaagggattgctgggtcgaatggtagttctgcttttagctctttgaggaaccgccacactgatttccacaatggttgaactaatttacactcccaccaacagtgtatagtgttcccttttctctacaaccttgccagcatctgctattttgtgactttttaataatagccattctgactggtgtgagatggtaactcattgtgggtttggtctgcatttctctaatgatcagtgatattaagctttttttaaatatgcttgttgaccacatgtatatcatcttttgagaagtgtctgttcatatcctttgcccactttttaatttttttatcttgtaaatttgtttaatttccttacagatgctggatattatacctttgtcagatgcacagtttgcaaatattttctcccaatctgtagggtgttgtctgtttactctgtgatagtttcttttgctgtgcagagctcataaacttaattagagctcacttgtcaatttttgcttttggtgtctttgacatgaaatctttgcccattcctatgtcaaggatggtattgcctaggctgtcttccagggtttttatagttttgggttttacatgtaagtctttaatccctcttgagttgatttttgtatatgatgtaaagaaggggtatagtttcaatcttctgcatatggctagccagttattccagcaccctttactgaatagagaatcttttccccattgcttgtttttgtcaggtttgtggaagggcagatggtcatatgtgtgtggcctcatttctgggctctctattctgttccattggtctatgtgtctgtttttgtaccagtaccgtgctgctttggttactgcagccctgtagtatcatttgaagttcggtagcatgatgcctccagctttgttctttttgcttaggattgccttggctattcaggctctgttttgattccatatgaatttgaaaatagtttttctcctagttctgtgaagaatgtctttggtagtttaataggaacagcattgattctgtaaattgtcttgggcagtatgtccattttaatgatatcaattcttcctatccatgagcatgggatgtttttccatttgtttgtgtcatctctgatttctttgagcagtgttttgtaattttcattgcagagatttttcacctccctggttagctgtattcctaggtattttgttctttttgtggcaattgtgaatgggatctggccttcctgatttggctcttggcttgtctgttggtggtgtataggaatgctaacgattttggtacactgattttataccccaaaactttgctgaagctgtggttaaaaagctgcatggcttgtcaaaggctagccaactatccatgttctatttgtgagttagggaactacaaattgtattttaaaaggcaatccagcaagcagctgaatataacacacacccaggcttcttagcccttcttcatgcttccttaggtctcttatcagaacaagaagaatagagatctctgttatggctttcctgtggcaagtaaaagacaaggcgatgattttccagtccatttcccctggcaacatgctcatcaatcaccaaaggctaggactttgttattttggctggaggcaaaaaagcttagtggtttctgtcttagtgaaataggactctcctttaacctgtgtttcagattagcatcagggcttgctgcctccaccttaagtgtatctgctttgatggcatataggctcacaggacgagtctggaacacaccaattttagctactatagaaatgatttggtctgggataaaagttattttttttaaaaaatgtgtgtggtggggccagttttctaaatccaacaggggcattaccaaaactatgggtatttatctttctgcaagtgatgtgtcctcagcagttttcatttactgttatccatactggtctattttcaccttcatactttcaaaaggccacagtaggatggaacaacagactttaaggcaaaaaaaaaaaaaaaaaaagaaaaaagaaagcttaaaaaaaaaccatacacacaaattccctttgtttggcatcactttccccttttatcccatttaatttgaaagaaatgtatattgtccttgagtggacagtggagttatatacaaacatgttgctgtatggccatgcacatacaatgaagattgctgttagcacttcaagtctcaaattaaatattttgcttcaagaaaaactgaaaatggaaagacatctaacactgcttcattaaaccaattcagcattcataatatcttatctattcacggacaatctccctgtacctgctaatccaggattttaaaagtattgaaagcctagagattgttacagaaatccctgtatcagtaactgtcattgtagtaaaaataggcttgcaactttactgtattctgtacacagacattaatttaaaaatttactctcatcagcaattgcttccatttacaatcaagtgaaatttctccatagcccaattatactatttaatggtaaaatgtttgtaagactaaaggagataacaatggtgtcaataaatctcattagaaaacttatcatatcatttttcctagtccttcaatgtttgctattttatcaatatcatcatcatcagtaaacatgtactgaatgtttttaatgtatacacactgattattttacaaaacctgtccctttgtgttgcctaagagcaaaggaagtgacactatgttgttaattcttatgttgggctataaagattcagatgtgagaacttcaacttttctgtaatagagggcattccccaataagatgtatgctaaaacagccttttgttggattataaaaatattgggttgaattatatgaaactgtcatttttgtagggcaaaaccagtcaattattgggaatgtcaaagggttttaatgttgtatggcactaacccattgtaaacaataaattataaggaacccataataccctgacagagatatatactgttaataatttcatgctagttttttaatatatgtatttgaaatacattcccaaaatgggatcatattgtatatatgtatttctttaggcaattattcttcaacaatatgagattttttgaaaaatcatcctatgagatgtattcattttgctagataaattttcataatgtatttaatcatcccctatggtacatttttttattgttcatttctctaattatttgggaggttgagcatttcccatgtctaccagcgttctgtatatatgtacatctttgcaaatttgttcatgttcttatccatatctaaactgggtaatctcctttttcttagtggtttgtaagagctttttatatattaaggatattaaacctttgccatagtttttgcaaatattttatcatttgctttttagttttatttataatattttcagtctaaaatttttatagtctaatgcatgaatcatttcctttgcgatattttctactgtttcgcacttagaaaactctactaccagatctgaaaaatatttgtttacatattattatatcatttaaaaaattaataatagctctctcctacacacatatcttttgaaactataaagtatttagactgtgtacaaaatataaaacaggccactcgtttggtatccaaagctgaaagtgttgtcttcagcctcctaaccagcactaaatgttactaaatcaggcctgtttctagcaaaatttacaagcaaactcagctgtcttcttttctaaggaaaatttcctgctgtacaaagggttacctctgaacagtatctccattatttcactcatgactccattcctaattttctgttttctggcagctgctctccaacttacaaataatgtgtgcctttgtttagagttccttaaaaaaactgtatattctaaatgtggaagaaagctcaatttattttactttgaaacctgagaaatcaataacatgaaccatatgttaattatagaacttggtgataaataaagtaagaagtccagtgaaactgtggagaaagtgatggtggagttgaaacaaaaaagaagtcctttctcttcatgtgtgatgctctcataaatctccccacttgggaggataccaaaatgcaactctttttcttaattcactctaatgtaatttgtgttttacttccttccaagttcccaagtgtttttattaggattttgcagcaaagataagatgcatatcatgggctgttagtatagtggcaacattaagaaaagatgatgtcaaagacaaaacttaactgatatttatgtccttctgtggtgtttatttcaatttacatagttttgtactaaagatataagtcaactcatctttagtttctggttgaaatattaaaggacttgaggtttacaagatcaattgctatgatcagagtaataatcataatgggggggacaagaattagcaatgtaatgtttcaggcacttacactcagcataatcacatgctttttaaaaaagcactttctttttggtttatttatggtaaataaatctctccttcttttttgtgactcattcaaccaattctcttcctgtgatcaccaacctatttcttccctattcttgaaccccatcctcccgacccggaatatattttggtagaggaaggaagcagagggaagcagggccctcactcatagcttttataccatcttagtctcaacaaacatttcaagtcttcagctatgagtaatggtgaatttctcagttccagacttaaatattaacatatgatatattagtgaaattaaaattttaacaagtgtttattccatactaaccgtattcatagaacacctttttttttttttttgagatggaatctcgctctgtcacccaggctgtagcgcagtggcacaatctcggctcactgcaacctctgcctcccggattcaagcaattctcctgcctcggcctcccaagcagctgagattacaggcatgtgccaccatgcccagctaattttttttttgtatttttagtagagacgaggtttcaccatactggccaagctggtcttgaactcttgaccttgtgatccacccacctcaatctcccaaagtgctgggattacaggcgtgagccaccgcgcccggcctagaacatcttaaattgaggatagctatttccagattgatctaaatctgattgcttaatagtaaacttatcttttaatgttgcagttcctaaacattattttatgccttgcagtccccaatctttgctacatttggtttaacattctaatctaaaagtggtatgactatactacagtagaatgataaatattttctttggttttggccaagaaataaaaaattaacaagtatggccagtgacaacagtgaacactggtaatataaaaatcagcaaaactgctagcttaaatttgctaaaggcctagaatgacaattagaagaaaattagattctgagtactcatggctttcaatatatgagcctcagagtactaggtttagccacattggtgtcagcactaaaaacctatgactatgatatatttaaatttaatatagttttggttccttaccaataaaacaggagtaggaattctgacccattacacttgcaagtctggtaatggtttactaatttaagaccctagagaactgttaaatcattagtgtatatgaaacaaatagcaactttcaaaggtcaaatcatgaatgagtgatgaacacttttttaaaggaaagatttttgtgtggcttaaaaatttttagttggaattctcctattcctaagcatctctttaatttatatctcctattaatgagtaagtatttttcaatagaacattttaaggaataaaacttcagtgcctttaaacaaatttcctacatatcaatgacgttagtaaagcaccacacctgacttcacctgggcttagattgcctaaacctactgattggctggggttaccaatgcacaggcaagcaaatattccagatgtctgagtcatctcagaatgtaagggagatgttttccatttcccacttgtgtcatatgacatactgcgggggttgggagtatgtcttaagctgcagtgtctggtgtcaccagagggtacttattagaaactccctcctgagactatgtttgacaatgaggaatcagttagggcaggattgtcattttaagtgagcaccccaggtggttgattcactgaccacacttggagaaacaaagcatagtgtttacaaagcctttatcaaccctttattagatagttactcatttttgcaaaatctgttgggtttaaaaaaaaaacctgttgggtttagtccattttccaggcatcctaattaatctaaccattacatggtagtagccaaggtttatttgtctttttttttttttttgaggcaaggtcttgtgctctgtcacccaggctgctgtgcaggggtgtgatcatggttcgctgcaacctgaatctcccaggcccaagcaatcctcccacctcagtctcctgagcagctgggactataggtatgcaccacaacacctggctaatttttgtattttttgtcaagacagggtttctccatgttttgccatattgttgaattcctgggctcaagtgatgcgtcctccttggtctcctagagtgttgggataacaggtgtgcaccactgcgcccagcccactttgtcatttctgacattcaaggaattctcttttactccctaaactccaagtgtcacagtgcccagatgctaagtccttaattaaatatatgaatccatattcaggccaacctctcctcctcacttgatttaccgtaagaatcaatctttcaggacaattttgcttctagagggtgatgatgaggaagaggaagaacagaatgacagtaactacaacattattctacatactgaagacaccagattctcataactggcactatggggtttgcaaggcttcattatacaactttttgtgaaaccacatattcattcaacaattacttactagaaccagtaattacttacttaactgcaatgaaacgattgtttaattttttccaccttgcttaggaatgaggaataagatactatctcagataactgatggatacctactttgtatgcctttcactgatttaaaattttgtaatgacaatattgcaaattgttggcaattgctctagtagaatggtcctttttttcaacttaatatatatgggcatctgaaatttctgggtaagaatgataaaatccaaatgaataaatatagtatagtacttcaaagatttaaaaaaataacttattcctttgaagcttctagttctcgtgatgggaatggggaagacagcatacaattgggatatagggaaagtaattttaaaatgaaaaacatgtatcactacaaaattattttttagatatatactcctgagatacgagaatagggtctaaaattcatgacatccatccgtctcttcactgagcttagttctccatccttggtataaaacatatttaagcgtcccaccccggggaagaacaatttctggaattcagttagtatttttggaattagtactattttaaggagaatatatcttatagttttggtaggatcagttattggttttagactatttctaaaccaagctatattcttagctacaacacagataatcccagaatcccggcccaccacagagaactgaatgcgcaagtgcaaagtgaatgtgccaagatacaacataccttcagcttatttttctgtaatataaatatttaaaaattttatccttgaaaaagtaccatttcctggcttgtacaatggtggtattgatgcatacatttctgagttaattagaagataaacacctagtacagttacaaacacatgtttactgaggatcccctatgttccaggcagtatgctggccctggagctagtgcaatggactagagtcttgacttaaagtctcatctagttgggaaagattaaaaaacaaacataaaaaataaatgagataatttcagctaagtgctatgaagaagaagataaaataggataatgtggtgtaatgtgataaactataactagatgtggagttgtagctgagagggtcagagaaggaatgatgaagacatgacatgagctagagggtgtggagcattccaaacagatgaaaaatcagcacggacaaatgccgagctagaagcaagctggaggaacagaaagaaggccactgtggctggagaaccgtgggcccaaggaagagtggaggcagatcagaaaggcagggggtggggagcactagatcatgtaggacttctgattttattctacaggtcatgagaaaccactggagctaagttttcagtagggaagttagataattttatttctgctttaataaggtccctctggttgttatacagaggatggtccataaaggggcaggagcagaagtggtgtgttgagttaggaagctggttgatgggttaaactagaactatagcaatgaagatattgagaagtagtcagattggggatatcttttggggataacaccaaaagcacttactgatggattggatgaagactgtgaaggaaagcaaaaaatcaagaattatgcctaaacttggggctcaaacaactggcagatagggaaggcttgagtttggcagaggattctcggtcaatgttttacatggttagctgactatctgtaccaagagcatgtgggagacgtcaggctggagaataggtatttgaagattctggactaaatgacatcacttgattagaaagtgtagccaaggaaaagaagaaggctgacagtgaagccttggatgttcccatgtttagaggaagaagagccaaaaaaagagactgcaaccaaggagtttagcacaggctaaatttagatgagaaatagccttccttctacgcagaagagcactctgctatctgttgccatggtgatataaacgggtatatactacctgcaagttttaatggactttgtaaacagattcaatgcctagggtgaggaagcattttctaaagagattctaacttatctgttattagctgaatctaagtgtcatttgcctatttagtgagtcattatttatttagtgagtcagtcttacagtacctttagaaagaaactagcttttcttaaacccatatttcctatccccctaccaccactatcaaccccctgtaccccaccaaaggttcccttggctctgcatagctctgccccagcttccttttagtccctggctttaggctgtctccaacctaagtcccaagattctttcatttttagttctgctgctcttttacattaatgtagctttttataggattggagattttaaaaaacctactaaatagctgttatattttttgttaggatacatacacatgcataattctgtcctctttctcttctgatattttcagctactataagggttaggaatttgcaaaaggatttatttctgagagtcttcagaatctagactgcataaaaatgttctcctttaagaagttgcttgagttactgagttttcccttggaatgaaagatacttgaaagcacaatatgtatgttcctgattggagcagagggaaacaaatggaaattattagtaagattacactgaaatcttactaattagaaaggttacactgaagattttatttctctctacactttagatctgggcttctgactttagtagtataaactcccacagttgttagagctcactcactctacatttccccctgaatttggaatatactcagtattgactcactattcttccatccttcaaatcatctctcctattccactcagtggtcagctgctggcactgctttgatttatccccctgtctactctcaggctggctgcttaatttttgcttagcagtatagtctttaaaaaaaaaccccaaatttcaaaactctcagtatgtgtgggggcagaggggtgcagagtggggaggggcagtaaagttgtggtttctgtggagaaaatatttctttggagtcaaaagactatattaaaagctcgtcttccacagaatataggtcacattcctggtaaaagtttggatgcctgttttttaaaaaaaacagaatgtctctaaacaccatagttaatatactataagtgatatactttgaataaggcataataagggtctacaatgtgcataaatcaactaggtaaaacattataataaccaatactgtaaaaagctacattaatggagaagggcagaagaactaaaaatgaaagaatcttgggactcaggttggagagagcctaaggccagggtaagctggggcagagttctggagagacaagggatgctgaaggtgggaggctgatagcggtggtgggagtttgtagaggggtaaacagtgaaaacaaaggatatagaaaacacagggtcttgagtgccaaaaagaaaataaactgggaaaccacgttcgcaagttaaaagccttgaaagatctactatactgtgaggagtgaactattttaagtcaaattgctgtaggttaaggcccatcttacagtaaaagatggcatcactgatctatgaggtcttttaaaccagaactatgttattccaacattcgactttgcttctttaaagagactttattgaacagtcctctcaggtgtctttcacaaatgtactttctttttaaaattatttcctgttactatgaaaagtagtttgcatcaaataccaggagagatgtgtgtgtgtttttaaaaacatggtctattcaattagtgcagctatgatattagattgaaaaaaatttccttccaagatctttatcattatggtagagtatttgttctttgaatttcttgccttgtttttgggatcaccttattatgcaacatctgctctgaatttcaaatgtgataaacagagtatgagtgtcggtggcagatggctaatgaccagcagcgacagggcattcaagcctgccttgttttctgggaagcgatattttcatgttaatttgctctgtgtcctgcaaagatgagacaaatcacctgctcgtaattcaggcaaaatggagaccaccaggagctgagaggggccatggcttgattcctttaggagtgagaagagaagaagatctgagaggctttcctcatctgcagtacagggaccagtcagtcactttgcattatgtcaaactgagaaagatgaatcagccctgggcatcccatactgacatcagagccactgtttactgcaagcagatattattcatgaaaacagacatttcccagaggcaaaaaacaggtgctattaacagtgtgtgtcagtttctgaagtctgggttttgtaaaataaacctaatagtgtgttttatctcttactaaaaatattacaaccaatagaaaactctaagaaacattcaattgaagataaaatgaaatctaattcacagagaaaacgacccacacagacatgaacctggagcttttctggccctctcaagctctatagaattcatttatcataaagatacataaataaaaaaaattttattccaagattgaatcatcaaaagaggccatatggtcttgagctcaaagaaccctgtcctattttagaggctgctgttcttttgtgtgacctttcagtgcctcaaacttgtgaaactatattgacaattgcatcaaacatttttttttatcaaacatgtttcatgcacagaatgtccacagaataattttaggttttcaaagagtttataaaatagttgagaagccaggtcatatcctaggaaagattaatgtattatacagacaagactaaataccaaatgaatgatttagtaaaagagggcattacatttggaaaagcctgtacaggagaatattttacataagagtctctctccatctgtatcttgcagtgtacagttcttattctgggtggcagttacaaattactaagaaaaatggtgagcaaatttctttacagttctttctgaccctctctcataggatggcagatgaaagcatgaaagagaaaaataaaaatctgagagctgtttttttttctcataaagctccataaatggaaggtgctatataagcatagatactctgaatttatcacgtactctaaaagaaaaaataacacaatcattaaggtgtcaattattgcctcataaatctcagcatggaaacccaggaaggcaatattaaatctcaaatgagccaataaaaatttaataaagatggcactgaactcctccacaagtaaacagacccaaagataatatcctgaattagaaagaggaaagccagatatgtcaacaataagtctatgagggaaaattagaatatctgttgacttcacaggacagcagccaacaggctgctttatgcaaatgtcattgtcaaccaagaatggatgcacctaaaggacatcaagaaaagaggttaaataatgtgatgaaaaccccaagatgaagtatgaatgtgatttctatgtatgctttttttttttttttttttttttagaataaggtatatttaatgatgttggaaagaatcacctatgattttattttattctcatgaacttctcaatgaaaattttcagttcaggcctatactcttaatgtactttattaaagtcccacatgagcaccgtgcaataattagagtttccccaataagtttacccaactatcaacctttattagtacttatggcttatggtgtggtttaatgtcttttttatttttcgaaaacaaatggcacttaagtgcacttcaaaaactgttaggtgatataagtaagctagaaaagtaagatcatcatgggctcttttctaacaaacgtgttgatgaaatgataagcaaaatgatgttacccctatgatatctagtaagacaccatggagcatcctagttttatccaagtactgcccaactaatgcaatttatgtcctgaatgtgcattagaatatcctgagtttcagtggcctgttaactggtaaacagtgccacagaaaacacaacactgggtagaggaaagtgggtagaggaaaatcccctgagcttaaatgatcttagatgaggtcttgttttgattttctattttatatatatttcatgttaaaatatctggccaggcatggtagctcatgcctgtaatcccagcactttgggaggccaagaggtgggcggatctcgaggtcagtagttcgagaccagcctgactaacatggtgaaacccagtctctactaaaaatacaaaattagccatgcgtggtggcccgtgcctgtaatcccagctactcaggaggctgaggcaggagaatcgcttgaacctgggaggtggaggttgcagtgagttgagatcgcgccactgcactccagcctggtgactccgtctcaaaaaaaaaaaataaataaaataaataaataaaaataaagtatcttagatatgtgactccgtctcaaaaaaaaaaaaataaataaaaataaaatatcttagacacgtgactccgtctcaaaaaaaaataaaaatatcttagatatgtataattatttaacaacatgatacgttttaatctatgcaagacaatgtcaatattaatacctatgatttggatcctttgaaaagtaatttaaatttaagtattttaaaaaatagtttggcacaatatagactgtgcttacttatacataagtagtctgttcttgacttgaaaatacccctaaactacttaaataaccatacagaatgtgtaccacaggcttgtgtttgcattttatctcttctcttatactctaaaggtccttcagagcaggtcctctctttctcatgcctaattcaattttgtgtccctgaactgcctagcacagaaccctccctgcacagagtgaatattcaataaatatctgtacgagtatagtcagagaagctcttattccaacagagcattctatataaagaatcaatttctgtgttcccaataggttgttcagaataacaatatttgcttgatctagttattaaggcttcccataaatgagcctatataacaacaaaatatttctgttctctggctgtgtgctttaaaatttcaattaaccagaattcagattctcctacttagcagctgtttattctgcattccaattcttaaaaacaagtcaatcacagaaacaaaagatacgagtgttgattaaaaataattttgtatcagttatatattcagcctaaaactatccatttgatggttttattatgcttttaaatgattattcaagttttcaacaatgaccttaaagcatcacaaacactcaaattattttttaaaaaaccttatatttaataaggaaggaaagtaggttagtatagttcagaattttttttttaaattaagaatgaagataaaagagtcttctaattagcttttaagttagcaaaaaatgtttgattaaccactaacatgtaagttaactgcctgaaatatttcatttgactatggtttattttactatgaaaacatcaatacaacattagccacaaaccttcaataactagagccccttgcccccaactccacctcgtatctgacaatttggatcaaggggtgctgatcctaatggctgaagaaatttaacagcctccaggacaatccctgttcaacacggaatgaagtgacattccctttcctggagatagacaaaaagctcaaaaaaaaaaaaaaattaacttttaatgtcaccttgttcaagagcttctggcaacaatcacccccttctagcaagcctccagctccatcctggctcagccactgccccctgtcttctcctcccctttcttactttggtgaccacccttctgcctgttccttttcctatcctgcttgcccctccaccctcacccttgagattccccccattccaattcatttctactcctgcctgatcaaacctgagtctagtaaaccactctggcttatcaacattttaactgcacagatgcctttgcaaatgattccactcagtagcctccaatatactaggataatttaatataatgctcaaaagatctatgtaggtggtaatgtaagatataaaatatatggttgcctcatctgtctgtttttttaaaaaaaagatactccccaaataactttgaacttagaaatgtatcagaaaatgtcaatgattttttgatagtctatgtttaaagcctttgaaagtcattttaaaaataattttgaaaatacttacatctaaagaaagcttgacaatgtgtcttatttactttgtacctatgtgtataaatcattgtgtaagacactgtcaggacatgaggatgactgaatacatgagatatgtacattaaaaaatcccaattaaaggcagaaaacaagataaagaggtagagatatgcagaacaagtgttataaggcatgtgagattacatctagctataagagttgatcaaatggcttttgagacggcacttgaaaaatttaggtagatagcctggtgagaaggagcaaaagaaatggcatgagaaggaaggccaccaaggtggaaaatcacagatcataccaagagaatgatgagcagtccaatttgcctagaaaactgtataagaaaaaggactatgccctgctctgcatgctgaacacagggtttctgacaaactcataaaggagagaactaaagcttcaggggtggaatagaatgccagaggaaagaggggtgcacagacagaagatggccaagaacaggtaactatcaggcatacctacatttggagggccttaatgtccttgaaactgctcaggaagaaatgggactattgttaagcaccagattctttaatgagagccagatgggaaaaaatacaatattaatctaaaacaaaaggaataaatcattcagtatgtcaaattctaaatgtatcagtcagtatctgagaacgtcatttagctatcactaaagacatttcttagtctgttgagaagataaactatttttagctattaacttctatctagaatgatggtgaattctataactcatttctaaacaacgaatgataaggcaggagtctgtttaagctacctaattcacacagacaaaaaggttttcatgaagacccgcacatgatgtgtataaatctaaaagatctacggggaagttcagttaagcagaatgcaaataacaacaaaactttatcagcagcattttccattagacttaaaggtaggaagaacttccagtcaatatactgcatctagtttactgacctctaaggatagaaagcatgtctcaatcatctttgaatcccaggagtttggcatagtatctggttacttaggcttccctataaacgttttatgaataagaaaaatgaagaaagaaggagggcctaacaagtaatatttcagattcacatagcataggttgtcccggagttattatacaatcataatatacaatgtgctcatgaataatgttcaaattatgtctctcatagacaataaaccatcagaagaagactgagctatacttactaaactatgtttcctaaggtctaagacaatctacaactaagtatttttaaataattttaatatgcattagaactaaaggtttttttttccacttagttctaaaattaatgaactagaatacatatgtctgtactttgaacatctcacttagttgatgaactggaatatatcccaatctttgaacattttctttgatttttttaactatataccgaattctaaaagttgtaattgtggcaattttcataaggaaagaaagccattgcttaacagactataatagtcgactgcctgataagacatgaagatgattcttgatacctttatggtttcagtgggcactccaggctctggaactttatccaagtaagtggtcaagtcttgatcgacatgttcaaacactaaagttagtttggtttctctgtctgttcgtgacactgtgcacacatcaaacaacctagaagaaaaaacaaagaggttaagtaggtggcaataagcaaagaagtaacctgtatgttttatacatatcgctcaatttggtctcataatagaaaaaaaaggccagtgttgatcatttcttgtgatcatatgtaaagatatcaaatgagatctgatactttaataacaacatgaagttcaggagaggggcactcagagtgtgcggttaagcatgagaacatctatagtaacaatgagaaagcaacgcgcttggagcacaagaacgcttggagagtttccttagttaggaccttagatagaacttgccaatggggataatttcaaaaacttgatgtctaggcaaaatatgtttcttcttagctcacagtttgagaattactagagatagattgagcatcctttggagatgctgaatgttgtaatcaagattttcctggaatttaaggtgtcacaaccatgtctgtgaaaacaaatatgatggaatatggagaaatttagtttatttctaagacagccctcatcctgctgagtcaaatcattccctggaaagggcatacattcttagtttttaaaattccaataccatgttaatcaacattgtaaaatttaaacttttttttcaggggtagggggacctgcattggtaaactatattgcccttaaataataaagcaacagattaacaaatgttttggatgggtgaatccagtttcttccataaaaatcttaaaataagacaaaatttaagttttaaaaactaagccttcaggagtcaaaagaatattcaagccaaaggacaaaatttcctttcgtttcaaccacagtacactatttagcacaacagattctcaccaaatgtttgaagaattaaactacccataaacaagctgtaagtacatttcttaacaagaatgtaatataaatactaagaaaaagctaataaaatactattcatattactttaatttttaaaaaaaattgaataaatgccttcttcaaagaaactataaatgtgcatagagtccaataactgatgcacagggttgactatcaattatcctgcttacatattacctccgttaattttttttattatattttaagttctgggatatatgtgcagaatgtgcaggtttgttacataggtatacacgtgctatggtggtttgctgcacccttcaacccatcatctacattaggtatttctcctaatgctatccctcccctaacccccccaccccgacaggccctggtgtgcgatgttcccctccctgtgtccatgtgttctcattgttcaactcccgcttatgagtgagaacatgagtgtttggttttctgttcctgtgttagtttgctgagaatgatggcttccagcttcatccatgtccctgcaaaggacatgaactcatcattttttatgagtgcatagtattccatggtgtatatgtgccacattttctttatccagtctatcattgatgggcatttgggttgattccaagtctttgctattgtgaacagtgctgcaataaacatatgtgtgcatgtgtctttacagtagaatgatttataatcctttgggtatatactcagtaatgggatcactggatcaaatggtatttctggttctagatccttaaggaattgccacactgtcttccacaatggttgaactaatttacactcccaccaacagtgtaaaagcattcctgtttctccacatcctctccagcatctgttgtttcctgactttttaatgattgccattctaactggtgtgagatggcatctcattgtggttttgatttgcatttctctaatgaacagtgatgatgagcttttttttcatatgtttgttggcctcataaatgtcttcttttgagaaaatgtctgttcatatcctttgtccactttttgatggggttgtttttttcttgtaaatttgttttaagttccctgtagattctggatattagccctttgtcagatggatagattgcaaaaattttctcccattctgtaggttgcccgttcactgatgatagtttcttttgctgtgcagaagctctttaattttattccatttgtcaattttggcttttgttgccgttgcttttggtgttttagtcatgaagtctttgcccatgcttgtgtcctgaatggtactgcctaagtttttttctagggtttttatggttttaggtcttatgtttaagtctttaatccagcttgaattactttttgtataaggtataaggaaggggtccagtttcagttttctgcatatggctagccagttttcccaacatcatttattaaatagggtatcatttccccatttcttgtttttgtcaggtttgtcaaagatcagatggttgtagatatgtgtcattctttcttgtttttttttcctttttgtgaaggagtttcgctcttgttgcccaggctggagtgcaatggcacatcttggctcaccacaacctccgcctcccaggttcaagcgattctcctgcctcagccaagtactactcccaacccgagtggctgggattacaggcatgggccaccacgcccagctaattttatatttttagtagagacggggttactccatgttggtcagactggtctcaaactcctgaccttaggtgacctgcccacctcggcctcctgaagtgttgggattacaggtgtgagccaccgtgcccagccatgtggcattatttctgaggcctctgttctgttccattggtctatatatttgttttggtaccagtaccatgctgttttggttactgtagccttgtagtatagtttaaagtcaggtagcatgatgcctccagctttgttctttttgcttaggattgtcttggctatacagactcttttttggttccatatgaaatttaaagtagttttttctaattctgtgaagaaagtcaatggtagctggatggggatagcattgaatatataaattactttaggcagtatggcgattttcacaatattgattctttgtgtccatgagcatggaatgtttttccatttgtttatgtcctctcttatttccttgagcactggtttgtggttctccttaaagaggtccttcacatcccttttgggttgtattcctaggacctctgttaaacttttaatgccttgctggttcaccatgtcatccttctgcatttctgggctttatggaccccacatttggacttctctgtgaatctatactaaattttaaaggaaacgaaaaaaaaaaaccaaaaccaaaaacaaaaaacacttaacaaaaaaaccccaccactgtaattaggttaaatctggcaggtcaaaaaacagaacaccaacaactacacatgcttcatagccagatccaagcttctttttaattatgggcagtttggggtgaattatacaactccattaaaattaaccagaatccattgaaaattttttcctcacatttatctacttctaaacattctggtttttaagttttaatatccattcctaaacttaatattttcccctaatgttacttattctggaaaattattccaataaagtaaaaactcttaacagatttattaaagatagtaccataaatcatattaagtctcacactctaaaaatatgattgctatcatgcatggatttaatatgtggaaaatttatcaaaacagttcttttgccttgataattcaagataactacaactattcacaggcttttttaagccagcttattgctattaaatccacatacttggacaacttcactcttttcttcctattgaaaaagaaaatggagttccacaatccccaactttctttatatctgttgcttgtatttttgtaataaaataaaagagcagtgaaccaaaaatggcatgtccctaaagtcaaatacaaacacagagctgtttcatactatgaccatttcagttgtgtttctgaaacattactttaaaaatatttcccattataattaatatatttagtgaaaaaattacattgcttaccactacctggaatcaatagtaattttagtaactccagttcttactgcatttatagtttatcatatatatatatatatatatataagatattatagtaatttccaaaagagaaaaaattctgacgggggcataactggagaataaagtgatcctaaaatactgctgaaacaaaaagtcatctgccccctggaccgttgtcttagaagttacctaacaaccctggcagtatgccctgttgcttcatctcactgaaaccgttttcaagcactctttgcatgacacaatttaaaaataacatctaacccacccaagttgctttcctcagagttatactgctctcttcaaaatattaagactcactgatgccacctgcagcaactggactccaggcctcagtttcaatggatgctcaagatacgaaaggtgagctcactgaagccactactaattgtcctaaatgataaaccttggagaaaaaaggactcatttcaatcggtagtttttaaaacatggaattttaaagagatgtgtaatagtccatagagcagaacattttcacataaattttaatgtatatacttgcatattcttaaaaaatggtattaggtagaagtgactcctccaggttcaaggaaataatcctttttaatttttaaggtgccattattattaacttcattcaggaaatggagcatattagagacttctcagacattcacaaagggcatcaagggacatcagagtcctaagggtgcctgtaggatactctcttttttggctccagtgctggctagccatccacatcctacagacctagtactccatggaagacatctggggaaatattgctcttcccaaaactatgaaattttgtctgacttaaattatgtctgattaatggttagtaaacattgtactaaaaattaacagttatattagtcacaatgggtaggaaatgcattttgaatcaatggttgtaaacattaatcttagaaatgctagactataatatttatgatgcttttttttgtctacaatgactccctctggaattgccccaaatcaaataatagtcactttggtgggcaataaagagaaaacagaaactttatttttattcttatttttcttttaagatggagtctcactctgttgtccaggctggagtgcagtggtgcaatcttggctcactgcaacctcctgggttcaagtgattctcctgcctcagcctcccgagtagctgggactacaggcatgcaccatcatgcctggctaatttttgtatttttagtaaggatgggtttcaccatgttggccaggctggcctcgaactcctgacctcaagtgatccacctgccttggcctcccaaagtgctgggattacaggcgtgagccactgtgcccggccagaaactttaatataacaaatgagtttcatatacaacaactgagctaagcatgaattaaaatccctggtatttggctagaggtaaacaatctgtaatgtatttatataaatcaataaggaatggggctaggctacctagaacccttacacttgcaaaacaaaagagccagacaggtctgaacacttgaatgtaaaaactggaaaataggctgggcgcggtggctcacacctgtaatcctagcactttgggagcccgaggagggcggctcacgaggtcaggagatcgagaccaacctggctaacacggtgaaaccccatctctattaaaaatacaaaaaaattagccgggcgtggtggcaggcgcctgtagtcccagctacttgggaggctgaggcaggagaatggcgtgaacctgagaggcagagcttgcagtgagccgagaccgtgccactgcactccatccagcctgggcaatgagcgagactccatctcaaaaaaaaaaaaaaaacaaaaaaacaaaaaacaacaacaacaacaaaaaaaaccaaaaaaaccccaaaaaactggaaaatagctacaactgcatgattccttatattgaccaatattttaagactttctaaaacctttttttaaaaatttttgctaatctgtaacctgacaaaaataccatttcaagaattacatgacagcagttccataagaaaaatgtaatcacaatgtattgaatatgaacaaaatatctcagatgacttttaaaggaaaggaaaattaccattaaatatttatccattagagcttagcataatgtgatccaagtgaatgttcaaaaagtcaaagtgcaaactggttattggcattaactaaggctatgccttcagtttagctgtgcaaaatgcaatccaaaaaaggcagataggtcgttatcatttcacaattaagttggccaagcccctaactctcccacaaagtaagttctcttgctgtctctattgtcctgacccgccagctgcagggcagagaacaaggcttgcagtccagcacagcactcagttttccagctgtcctagtgatgtaattatctaataacaaaatatctctctgaattaactctgcatcctacccattgtaattcttaatgactacttcctgttcatgttctcaatttaacttgctcttctggaactattgcataggcaagttgccttcatctaatggatgggattacatccaataggtttgggatttccaaagattacaatttacaaaggtctcccaaacaacatgctttgtaaacacaagccctgcctttctattgtggttacaataaaagggaaatctgtcttatttgctgtgattaaactttgacccattcacaggaagttctatgaggatttttttccggtcacttttttttcccccattctcttcaatgtttggacatcaaatagttcaagagctgagagatgtctggcacagctacctaagggccacaacaaaattctgcttgaactagagccagtatttggaatcgagaagaatttttaaaaatatctaatctcctcctcttaagtgcatgaagcatattctgtgactatgtcttgtatgcaccaaatttatgttcacacatctcactagccctacactacggatatgggccactgtattctcttttttgctcattaaatatggactctgtgtgcacttattctcaaccagcaccaaatggtatagctccaggagtatttgccaccaacaataatgtgcatgctgctagaagcaaattgcgatttcagcagcacccataaacatttaccagcacctaccatgtgcaggcactatactcagttttagagtttccaatagatatgacagatattgtttttaaaagctttactatctagttgtgggaaagaagacttacaagtaaaaatgcaggtaatgatgtatggctatgtattagtaccaaataaattctataaacactatgtacaactttatatatcacatcaagtaaatttattctacatcctattaagtaaaccacagatggtctctgcctttccatccatttacctctcctggaagccacacccttattttctgttgaggaactactcctgtcctagaatctggcaatctggttttaacagcaggggcccacggatggcatgtgaacaaccctggattgagtgatgatgaatgattcagaggtggacaggagcataataatcagtctcagaaattttgctaggacttctgggagagtaaaactctacactgggattatgaaactggcaaagtctcagcctgcagctactgatggctgtctttgccaccattttagtgaacctactatgggatgcagaagagggccagaacaagggacagtgggcaagagattccggaagacattatttccacacctgggcccagtgtgtttgatctacccctggatttattaattatgtgagtcactaaagtcagtgttttgcttatccagcttgagttgggtttttattacttgcaacaaaaaattgtcctaagacatctataaatattttgaaatgattaaatgacttaaaaatgtcaatatctggcctcaaatacgtcttacagagtagacacaatgagtgaagctcaagcacaaaagaagtagcagtgtcctcaaagtgactgtcccagttctctgacttggctgggaatctattcaccttaaatggctcctccattcgcatgtccactgggcaaaagtagccgacagcagagaaccagatcaatccatccttcccaaggagccaggcagcttcctctcagaccctacttgaggttcctgatctgaccatagagacactggatggaggaaagcacagaaggaagaagacagatggacaagtttatcacaaacaggaatgtaaaacatagagtagaaaagaactcaatggtaagaggaagcaaggagaaaaaagaacttaaaaataatacaaagatacagggttcaattaatttaaaggttgaatccagtgtgcaaggtgtgttctcctgaagccttcaattaaacaacccctttcccactagctgttgctgaaaagtggaaaaggacagggatgtcaaaccaactctaaagcacagaaatcctttgtatttaaactgttaagtttatggctgctattatctgacaagggaaggcaaaatcaacattgcttatttactaaatcattttattcctacagcctttaagagagtattcataagaaagtttcattgtttatcttctttccaactttagagttgctattaatctagtttcagcttctatctatatagacctggcactgtggctctaggagttaatatcttctgaatctgttaaccaaaaaatgttttacatgtggaatgggaatcccctaaactgggcaagtttacaagatgtgactcttgcactatagtaaattttgaaaatagagcaaacagtaaaactatgtatatggaaacacattcctaccacacgatcagcaacagaactgatgtactactagctgggcctgaaacaagctatttaggatggcttaatgggtatatgggatgcctatgtacccctctcctcattccagatcaattcctgaactggacattaaataatagaattcagcttcttccatagtcctacatacagcaagcactacaggcacttctacgtcatcaaacacaattattcaaactgctaatgcattttatctgaatgaaaggcagagaaaagagtaaggctgtagcatcactctgttatgctaactacatgctattatgggaaaaaaaaaagctttagagctgccacaaagaaggcatatcataaaatgcgatttgttgtcttgcagggaagagaatggtagcaggggcaaaatcctacttggaattaagtgaactccaagtcactaaccatgtggatcattatctccccaaagacaagagaaagataacagctaaacaatagctgttttctgtaggcagctaaacaataatcagttgataattttggtgagtccagttccaatacaaaatagatttggaagttcaaagagaacacagccaactctacaaaaagaagcgacctgccaatggagaaaattaggaactattaggtctagattagtataaagaacaattcaccaacctcagctatagatcaggaacagggcactgtttacctcttgaggtctccacctagacatgatgaacttttagtctttccttaacagttaccttcaatcagccactccaaaaacataaatatgatggacaaaataagggcctaacaagagtgaatggactgagagaccccaaaacctgtggcttttggtgagaggatggggtgaggggaactcaagtcgcaagccctactggcaggtcagagatgacagagtagcaaactaaagatagccttaaactagtggtgcctctttgcgttttgcttattcttttctttcaattctcagtggcacccacagccatgtctgatacataggtgttcaataaatatttattgaataaatgaaatttttctaaattataacttagggaaaagtcaaagtaaaataaagtaaaagtgaggatacttcaagatgtcattaggaaagcgtggcattctgagtaagccagattttgtaactgctgttaaacgaagactcaaacactaaaatattgcatttactagttaattaaaaaatcttaacaactgtatgagatggtactcattttagagacgaagaaatagacacaaatgttcactgaatgatgacgcagtgaaggtaaacaaatattcactgcggcatcattcgtgatagcccaaaactgtaaataacccaaatgtccatcaactgatgaatgcataaacaaggtgtggtatatccatacaatggaatactatttagtaatagaaagaaatgaagaacaaatacatgctatgacatggataaaccttaaagggattatgctaagagaaagaagccagtcacaaaagactatgtattccattatttcatttatatgaaatattcagagcaggtagatctatagaaatcgaaagtggatttgtggttgcctgggacaatgagcagtgggagagtgtggaggaatggggactgataatgtgtactgggtttcttcttggagtgatgaaaatttcctaaatttagatcatggtgatagctgtgcaactcagtaagtatactgacctgaagtcttacacaggtgcattttatggtatgtaaattacatctcaataaagctgtttaaaaacaaaaaatggacagcaacagtggtagagaggtttaatactttgcctaaagtacaaagacagtaagtagtggagatgggctttgaaatcagactgtctggctccagaatctgattttctaaccactctgttattctgcctctgaatgcagcacaccatttggagctgcagtgaagcagaggtcagtgatggggagactttgtgacaaatgagataccctgctgacaggcattgtgggaatgccaaagccaaaatgtttttggtaaattaaaagatcccaatacatactttacatggtgggctgaaaaaaagaagttcagaaaattcacaggaaaaatgttaaaaagcgaagactgctgatatcccaaaccctcttacatttttcccttgactagttagaaaaaaggcacacttcaattcacccgacagagcttgaaaaagagattctgatctcagaaataagtgagttaagtgtatttttaaaagcaaagcgaacagctctggcttaagtcagatagagtgtggaacattctggacaactttcaacatttagttctctgtccatttctgacctgtgaaagccctgttctccagctttgggcctctcttgaggaaaaatgactaagcagccaaaactaggcagccgcctgtaatgaagactgtctgctgtgtcttagaagaaagccaaccaagctttacctacactgtaagccaaaaacctttcataatcacatccttaataggtgagtaaattcatcccagcactaattcactcaggtacttatgattaggtactgatctaataaaacaatcactgaagttagttccttttaaggaaacttttgatcataaacatagaagaaaatgttaaaccttagtaacttaaagcaacacaaatgaaaacctcagtgaaacactaaacctttcaaactgggttaaaaacaaacttgtttaatgacaaaactgcacaacacttgtttatgaaaatgagcccacatcactgtgggaatacaaactgataaaaacctttctgaagaataatctggctctgtgtgtgtgtgtgtgtgtatacatatatatatatatatatataaataatctggctctgtgtgtgtatatatattgtatatatacacacacatacacattatatatgatatataatgtatatgtatatatatataatgtggctcttaaaataatggtactgatacatctttattgaaaatggaaagacattcacaatatattatttttaaaaatgcaagtttcaaaagagtgtgtacagtatgattccacatatgtaaacataatggtagaaagataaatcaagatgtggctgggtgcagtggctcacccctgtaatcccagcactctgggaggctgaggggggtggatcacttgaggtcaggagttcgagatcagcctggccaacatggtgaaacactctccacaaaaaatacaaaaattagctgggtgtggtggcgcatgtctgtaatctcagctactcaggaggctgaggcaggagaatcacttgaacctgggaggcggaggttgccgtgagcagaggttgtgccaccacactccaacctgggcaacagagtaagtgagactccatcacaaaaaaaaaaaaaaaaaaaaaaaatgtagccagtggctatttctgggtgataagattttggaatggttgttttctgctatttgctcatctaaactttctactgtgagaacctattaatttttaattaaaaaaattatttaaaaaataagaatcataaaagcctatttttcaattcagatttttttctcctaccactcacgtacttttcttcaatctgttcctctgaattaatgaggaaatcctaatcatcaatcctgaaatgcagttttaaaaatcaaacatgtaaaaacataaattcttttgtatttagaattgtttatgtttgtccacttagaatataaattttttgtttatgttttgttctcttagattcctgaaatctctacaaatcttaaaatattgttctaagagaaaaaataatatgtatgcattactgccgcattaaagtatgtgcttttcaatcccctcccaatatggagtgactctacaaaaaagaatatgagaaaaaattatttttctgatacttggtgaaaaaggtcaaagtaacagactaccacgaaacaaaagagaaacaacgatggctcacaaagtcttcagattactctaatgtttcttaaataaaccaagaaaaaaaatcctacatggtagaattcagtaccctttgtaacgtaacaaggtgcaagcaaccaaaataaagcttggtcaaaaataaagatccttataaaaattaaaatataacatcttatatttttaaattagatctattagagcaaaatttctgggaattattgtgttgagaactaagaaaaatgctagaaatatattctaagatcaccaatggcaaactatattaaaatattagaaaacacactgcagttggagaagctggaaaaactggtatttctaccaacttctaaacttaaggatctaaaattgggttgttttgttcaggtgcaaacacttataaaaattaaattatgatttgctatatttctataagtccattttattttagagtttgatctttgttctagaagtatctcagataataaggaaaatgtttcatggtgttaacggtaatgaaaactgtgggagataatttgtaaatgtaactgcaagtttatctatttcaaggcagacgttttcttttgcaaagaaccacaggaacacctcatatactaataatctgttagtcatctggttgtcccatgtaagtgaatattttagataattgattcttacccatcttaattccctaaactattttttaaaattaaagttttagtggaattcttggtaacatgcattgaacattttcttgactttttaagcacaatattatgtttaactggtagatgattcatggtcattactgttaccattaaattataatcatttaattctgcaccattattatgatcacttatttgagtgtttactaagtacatgcagatgagaccaaaagatccacaatgaggcacattgtaattaaactatgaaaaccaaagacaaagagagaatcttgaaagcagcaagagagaagcaactcatcacacacaagggatctgcaataagatgaacaactacttctcatcagaaactatggagggcagaaggcagtgggatggcaatttggaagtgctggaagcagccaggcatggtggctcatgcatgtaatctcaacactttgggaggcctaggcaagaggaccacttgaatctaggagtttgagacctgcctgggtaacacaaagaaccccctcatctctacaaaagattttttttttttaaattaactggtcgtggtggcacatgcttgtagtcctagctactcaggaggctgagacagaaagatcatttgagcccagaagtttgaggctacagtgaactatgactgcaccactgcactctagcctggatgtaagagtgacactctgtttctaataaataaataaagaagtgctggaagaaaaaagaaatctgttaaccaagaattctatatctggcagaaccatccttcaaagatgaaggcaaaattaagacattctcagataaacaaaagctgagggagttttttgccaatagatctgccctacaggaaatgctaaagggagtccttcaggctgaaataaaagaacattagacagtaacatggagccatatgaagaaacaaagaacactggcaaaggtaactaactacataggtaagtggtttgtaacttttaaaatatgatttaaaaaacaaatgcataggacagtaattataagtctacgttaatggccacacaacgtatgaacatgtaatttgtgacaataacaacatgaaggagaaaggacagaactgtacagaaaaaagttttatatactattaaagctgaaatagtatcaactcaaactggattgttataagttgaagatgttaattgtaatctctggggtaaccattaaaaaattctttgttttgaaactgctcatatcttgaggaacattttcttgaatttaccacttaagagcccctacagtgagcctgggactgtggcagggatttaatatatggaaacttattgaatcctttcaatatccttataaagtatatactattactctcattttacagatgaagaagctaagattcatagaataatttgttcaagcatcatagaacagagacaagaggcagaaccaagatttaaattagaaaccttcacaggcctctctccttcttgatctggaccttcaatatcaagatctcctggacctattctcttcttccccaatgtaccaccaccactatgacaatctaatcagcaacagatgacagttatctcctttatggtcacagcttcaaagagtacctagaggttggtaaatctccaacttctctctccaaaatagtactttctccaaactccatacccagttatctcttggacaacttcaaccaatactctgaacatctcaatttcaaaatgtctagaacacagttcattccccttggtgaatcacacccccatccaaataattttctaaacccagaagccttcaaataatcgtagattgtttcatttccccacatgttcaatcaaccaccaattccaccacctaaatatttttccatccactgccacttccctgagctcaggcactcaacacccttggccagttttctacaaagggcctttatcctgtttcccaaatgccctgagactctttgtactcatcccctactctggtcagtgagccttccacagtaaaaatctgatcgatagcattgaacaaatgcatttaaccagcaaacgtttattaaatatttgttattttctaagcattagattagatgctaggtatagaaaaatcaaagggtaaaataaaatttcttaagttattcagagtctagtgggaaaagtagacaaagtatcaactattctgtaaatgctgaggtatgtatgtctgcggtatacacagatacacataagtgtatacacatatacttattcaaatccgcacacacacatacacatacatctttctgtctcttatgtatatacctatggaattttaagaaatgataaaagaagcaacccatccatatgtggaggaaaactttgtagaagaaatgacaatttaactgtcagagtatcaagagttacccaagcaagtggcaaagaaagggcacttgaaaccaaagaaagtgtgagcaggagcaccgcaagaagccccattggagagaaactttgtatgctacaaagaactttgttcctctggaaagtgggcaactattttttatggttttcaaagagcccaatctgatgacatgggtaaggggaagtgtggtaagaccacctgtaaggagactgttgctgcagtagtacagggaaagtaaagaaggcctgttctaaggaattggcagcaaggatggagaggagagtacagattccagaaatatttaggaggttgagttggcaggacttgctaagtgtctaaatgtggcgggggtggagggatggggaaggagaagccaaggatgactcacatgcttttgactttggggacttggtgccaccctcatgagatacagcagtgttcccagatctttggttttcagaggcctggaaactttccaacaactttacagctctgacagaacattgccaactaaagacattaatatactctactatctactatcaatatcacttcataaataaagcatattttaatatcccaaatgtgaatagatttagctttctgaaaaatttaccacagggccctatttttctaattgcatcacagatgatggaaaattggtaccaggcctcagaccaacactgcaaagccctgaggtagaatataggagaagtcagtgcagcagtaagatgatgagttgaagtcaaaggaatagacaggcttgccctggctaactctccagccctagaggaatgtatatatattaagaattgtaaaaaagttcaaatggtgttggaggccctgaagaagaggcattcaacatacctcgaggggaagtggctggggagctgagtctcataggacagtctggaatttgccagataaacaaaggaagtttggcatggtcctggcagaaggaacagcatgtccaaaggtatgtaggtacacagaaaaattcatatttggggaattgcggatagtctggcatgatttggtgattatcttggaaaatggcaagagaagagctggaaaagtacacagaagtgaaattatgagagtttagtaatccaggctaagaagtctggaaattatcttatgggcactgggaaaaaagcaaaggacttttacaatgaacaatgctatggtaggatgtgtcacttggaaatactactctggttgcagaatggaagttggattataggagaataaaattggaggtgaggaaaacaagtaggaagtgtctgcaaaagcccaggtaaaaaatatagacagattggttacagaaatagtagcagcagagagagaccaatacaactaacaaatattgactgagcacattatactcttcagctgtctatcaggatcatcaggcaagatccctgctctcttagaacttattttctactgttgttaaacaaagttgaatcatgttttgcaattaaaaaagtttaagtgtaccaaccactttcacaaatctatctccatttttaggttgcactaaattatattctatatgtaatttattagaccatttccctgttcttgtaacattggctcattattatcttatgataaattcctagaagtggcattttaaaaataaaatgatatacactttttctgaatcaaaatatatatattttttgaaagttcttgatccaaaccacctgacagaagattgtaccaatttatactcccatagtgatatctaggaggtggaatccagaagatctggtaacctaccagaatgtacaagttgaaagagaagtttgaaatgagtttcacgttttggtttagacaaggtagatgatagtactatttccaaaggccataagaagagatgaaaataagatgagtgaagtaattaatgagctcagtctggaaaagattaatttgagatgtctgtgacattcaggtggtaaagtccaataaacaactgtaaacatatacttctcagagctccagacacaagtcaagcaatagtttgggaagttatcagcctccagatgagacggaatcttggaggcaaaacataaaacaagcagaatagcatccctagatgaatcagagaggtgagcaagaaaatagatgaagaaaatgatatcataaaacatcaagggaattaaaaaaaattcaatgtatggcatcatcaaaagcaacaaaatacgtataaatttaacaagagttctctgtacagtgaaaactacaaaacaatattgcaagaaataaaagagctaaataaatggaaggacatccgtattcatggatcaggaagacttgatattgttaagaggcaatactccccaaattgatctagagcttcaatgcaatccacatcaaaatcccagctggctttttagtaaaaattgacaagctgatcctagacttcatatgataatgcaaggaacccagaatagcaaaaaacaatcttgaaaaagaaaaacaatgttcgaagactcgcacttctcaatttcaaaacttaccatgagctgtagtacctaagacagtatggtactggcataaagataaacaaacagatcaatgaaatataatttagagtgcagaaattaactttcatgtttatgctaaatgaattttcaacaaatgtgccaagaccattcactcaggaaagaataatcttttcaacaaatgatgctgggataactggatacctacatgcaaaagaatgaaattggatcctaacctcacaatatacacagaaattaacttaaaatggatcacaaacctaaatgtaagagctaaaactataaaactcttagaaaaaaacatagcagtaaatctttgtgaccctgggttaggcaatatcttaattataacaccaaaaacataagcaatattagaaagaacagatcactacagattcatcaaaattaaaaatgttcattcatttgtaagaaatggccagagtaggcaaatctacagaaacagaaagtagattagtggctgcctaaggccaggggtgtgggggttggggaaaagtggggaatggctgctaatgggtatggggtttctttgagggagaatgaaaaggttctaaaatcagactgtttaacaatggttgcacaaccctgtaaatatagtaaaaacactgaatcaagcgctttaaatgggtgaattgctttgcatgtcaagtatgtctcaatagagctgtttaaaaaaatcaaggcaagagtcagtttcaagaagaaagaagtggtcaatggtgtatataagataaagaagtgtgttctgctctttaaaatccttctattgtcttttatccactggacaaagtagcagaagaaatagctaacacttactgagtgcttactgtgtgtcagacacaatgctaataattttgttttatgtatttaaatctctttaccctataatacaggtaccatcatctctttcacagatgagaagaattaaggtatagaagtttagtaaattgcccagcatcctaaagactgtaaatgagagagccaggatttgtactcagaaaaccaagcaagagaaccctcactcttaaacactgcataccccatcccatggcttattaggtcactcgtgatcttgccccactcgccactccatcctcatcttttattggatcctaaaaatacttacagttgctagaatgtgcgtgatttttgtgctgtgcctcaacaccagctgttactgctgcctagaaagctctctttttctctgtccatctggtgacgtccctactgatcttcaaagattatgctcacacattctccatatccttactgtctccccttccaccctccctctcccacagccaggactcctctgtgctaccacaacatacctgactcattgggggtgctcagccatgattgctgaatggatatataatatgaattaagaaaaatattcagttgtcctataagagagtgtactgtatttttggaagaagcctgaaccaagtctgataaattaagtgggggatcaggctgagtaatattcttttgggtccaaaaagaggtgtgataataaagatgttgattctttggcccataaaacgattctgaagataattccaaaagagtctgaaaatgttttgctcaattaaagtagggctagaaaaactggactgcttcccatgggaccagatttatttggtcatataagttcttgtatggagtgttttcattttctctttgtctcattattttcaagtcacatgggataaggcaattatccttttactaaacatattccatttcctaaagagcaagtctctgaaaagttattgtcgtttttcccctcatgctttctttcctcagtaactgtcttgacatgttcaagaaatattttattatcagaagggtgattttgcttatttccaaagagggaagcaatttgctacactttaatttaaacctacccttaaatccaaggaatgtttggctcatgaaagggaaaacaaggtccagaatctattaacttgtgatccacagccttcaaagcaatttacattcagtatacatttgagttcatttagctgtcagagtaaagtctaaatcctctgggtatcttgctagtaaaaaagtatactcagaccaaaactaggtcacaaaatgtgttacaatgacaatgtgtttcactcttccaacattttgagaaatttccaaggaatcacaaaaaagaaaacttcctgaaagaagtaacttcataccttaaatcacatcctagataagccctgtcccagtatggattaagggcatcattaaaacaatagaagagaactaactgtgccacagcacacattcagtcgtgctatttcttccaagtctaaatcttccaagtctaaatcaataagcctatctgtgtttaaatgtccttcaaagattttaatatccagatagtttaatttaaccagtttttcttgtgtcagaattttatagatttttacattatgcattttgaattagtttatacaaaggtttgatctaagcattagcctattaagtacatctctgttaatgtcatttactagtgtttcttagctgttactaggaggtcattctactaaagccaccttcttgtcctacatttaagtgttatttgagcataaggtcactctctgaagaatatccactgaaactaagatggaaagttgtaaacacagagcaatgctacctaaatggaggacaaaggtaacaccaccagcagctgaaattaacttggagaaaaaaaaaaaaaaactcatccaaaaaaaaaatttcacttagcatgcatgtatcagtttttttttctgtaatgagcaacagattttttgaaaaatataaccctaggaataaatatatatttatacaattttttaaaagttatagacatatggatatttaatcactaccttcttggtttgcatttctttgtttcaagtaaaagaaaaagcaaaattgacaaattagcagataacaagtagctctatgagatcatagtttttactgacttgtttcaagatacaaaaatgataacaaaccagatagtttagacagactcttagtcttttaaatcattctcatagaataatttgagagaaaataatattttataagttgctacgtgcataaatattgtttatttatcctaaacattgtttcttcagtcttggatattccacatctcttttctacattgtaaagatatacagtctatttcccttttacaattgaaagggaaaactgagttggtaagagtaggatattttccccttaactgtaaacacattattttttattcaaaagaaaatgatctctgtatcaaaattcaaaaaaaaccctcaaagtctataatttatattttagtaactgtttaatcatagaggtaaataaacagggcactttaaaatattccacttataccagttaaacttttttttaaataccactatcaagtcatgtgccaaaaatttatctccaggaggttagcttttagtcagagaagttatatcaatgaacagacagaaaagtatccataagcaggacatgagacaggtaacatggtatcccctgaactgaactgatggacaaactctaagatggaaatagggaaaaccaaaatgtggggatgaggatgatctaccaatagaaaaggcccaagagactatgaccaccccacatcgaacagactaggctgtgatgacaactaaacggtacttttacaaaaagtatgtatgttatctatagaaaagcaaactctggaaagacacaactggcagcatggctcaaccctgtcataggtgagagtttgtgaatgaaacttcctctcctacagccaaaatggatgcaactggcaccagagcttgaggctatcagacattaatctcatcagctaactcccctctccaggttccatgtccacaatgcaagtatcctactataacctggctttcccacagacaagcatgcaagggagacaatgatttggctggcagatgcaagcatacttgacatgtacagtttttactggaaaagaatgcattaacatttttgttcaaacctcagttttcttgtgaggtcgggatgagtctgtcaaccttggactcccaaaccctctatatatactaatgaaattgggcttctaggcatttagtgccaggtggatactggaacatggcaaccacatcacagaattggctccctatgtttgggcagccagccattgttctgactgcctcttaaaaaggccctggccctcagacataccttttcttcacactgtagcataatgtttctgcattttgactttaactcctacaacttttaacctataagaataaagatcaggactaccctggtttgttagaagaacttctaaagaaatcaactctttgggcagcacagatgagcacttttgaaaaggctaattgttagtttggtttatactgaattgttttggttatgaattgcctcatgggatgggaaatcccctgcagggccttgtcaaacacctcctcactctccacggaaaatcagccagacaacaacgggatcttggacaccttcgatgtgttaacactggaggtgctccagtgagcaaaactgtcccctctggaagttactggaatcactatcctgggagccactataacagatgactctacttttctcaagtgtgctagggtggaaattaaattgaaaatgactcgtcctgaatgatgacttgacttttcaagtgaattttgtcaacactgttagagaattttgttcctggctttagccatacaaagcccaaatttgtccaattcatctgatgtaagactaaacaaaggcattaatgaataaaaagcagaaaaaaaacagtgccaaaatctttgtatattttagtgcataatacatttatcttcttctaggcaaatggcatgcaacttgtttctaattcaaagaaagataatggaaaaaaactgtttacagtagaataatgtttaataattcatagcttgatgatctaatgaaattactttaaaatgccaaatgtcaaaatgctttatcaaatctcttcttttgcatttcaactctaagttaacattttgatgaaaaaggaattcaacaaatattaactgtgttttaggaaggatttgcccaacttttgctaagcccagttagcacactaatttttatagatctgctatataagagagttcttactttttataaaatgtcaccctaacaattttttaatgtctacatatcagtgaataaatccactcttattgatgaatgagggagagtctctctgttgctaagggaacccaagtgtgctgaccactttaaagtcttccacaggcttgggtccctcttaggacagccaatccctctgcttcctcctcttcaacatctagctcttccttctcctgccctctcttcctaactccagacacttcctcagcctttacttagggctcccaattcctccctgcttcacacaaatgtccttttcttgtaatagaagatcaaagctattgtcttcttctatatggatcttctgtccctcatgattcacaggaaagtgtcctcctcttcaagacgaaccctattcctcctgaactgtgcctctccacaatatgctaaatctgcaattcatcagcttttattccctttcattcaattcccctttaagtgttcccctcctggctccttctaatacacttccctatttcctcataacaacaaaaatgtttaactgtgcctatctctatcagattgtcattctgccagccacattccatgtcccccaatttactgaatgacagtctacactttgtgctacagtttctacactttgtgctacactttctcactccttagttatctattaccaggtttcccctctttctcttccagcgagatctgtctctcaaatggatagcagtaattccccactactggatgcagtctttaggctcttccacctcttggacgcacctcagataccagaatgagatgcctactcctccccgaaactctcccctcccatggcttccctgagagttttcttttacttctccctctacttctcttgtgtctgcttttctctctgcccccttttttctccttcaatcctaaatgcagagtctcaagtttccatagtctttttttttttcacttaaaatacaggatttcttgctcattcatctatttaatatacagggtcctatttgccagtgaccctgaagatctactacagacagcaactgtgtcagaggcaattttgaaccgcctgtgctgtgaaggttggcatgggtgaacaagtcacttagctggtgacagcctagtcatgtgctcagtaaccacactggggcattcgtgattttctccttattgtgggacaaattatatgcaaaagtgatattccaaatgtggggctcaaaaaagatttctatacatctcctttaagaatgccacaggttttccggattcctatctggatggagctctcaatttcctgaactttgactataactctgccttggctatttcctgaaaacacatgtaactcaacatgttcaaaactgagttcatcattgtccctccaaacctgctccttctgctgtgaatgctatttctaacagtgacatcaccatcactatcctctcactcaagcataaaaccataattcatcttgttgaccctacagctctgttcacctacacatctaactagctacccacattggccaattctaggacttaactatctctcatatgcaaaccttcctctcatttcaagggcactaccctaatttaggccaccattattttttctctctccagggaatggtcaatctcctaaccagttcacctgtctctagattccatttcaggccgctttaccctctgctatgattctgaccctatcgattgggcattatctccattcctcctcttctcctcacactgtggttaactcagcacctcaggttcgtctgccatacgtgatgtcattcatctccatgtatacgatgtgtctgtttcttttcacatcgttcttctcttgtttggagcctcattttcttgctcctgcaaattaaacttaattttgtcttctgaactggcctagaattgtgtctgtatctctgaatggtcacgatagctttattctttgtattacagtaattggcacaggtacacacacactttctctctccccactaggttataaactcacttaaagcagagattaaggaatacacaatctgacccactgtgtagtccctatagtaggtgccttgcattcagggggggctcaattaacctctgttaaaccaaaagtcatctaaggcactatttatgaacatgttctatgccatgtactgctattccctgtagcaacattaattctgggaataagatctaatatgtagctggatatcctttgcatctctgggcccatcccaaaaacatcttcgattcaggcaatctcattatccaagttctagaatggactctgaggaaacctaagaacagagacaccatagaagcaagcctcatttcttgggatgtatcctcagcctggtgagtatcaaggctctacttaattttccatccagaaaataacactttatcattttgtccaatatccagtaacttccgaaatgatggattaaaaatcattataaagcttccaaatctgttttacctttacaagcaagaaacttctcagatgtggaaccatctaagaaattctaacatgaattgtgtgagaaaagtcagtattattaaaatattttatttatatttaaatataaacaaaagaaaatagataaaaatttcaaaattagctaataacgacacttttgaatcaattgtaaattttatttcactctttttattttgattgggagcagagaacaacttttatttataacaggaattcctttctttaaacactggaattaagcttttagagaatggaatatttctgaaatttctaagaaatgaactggaaaaattgccttcaaagtttctttcttaaataactgtacatacatgcgtgctctctctctctctctatctgaaattacagggacatagaattttaaagctagaggtcatcaagccttagcccttctttttgaaaatgaggaaacaggcagggaatggttaaggtgtcctgcccaggatctctctgaactgctccctccaccataccactcttggccacataagcacctcccaaaattaatttcaagagagaaagaatattctctttccctccttccttccttcttccctcccttctctctttctctctttctttcttttggagtgcagtggtgtgatatcggttcactgtcacccccacctcccaggctcaaacaatcctcccacctcagcctcctgagtagctgggcccacaggcgtgcgccatcatgcctggctaatttttgtacatttggtagagatggggttttgccatgttgcccagactggtctcaagctcctgaccacaagtgatccacccgccttagctttccaaaagtgctgagattacaggtgtgagctgctgcgccaccccgcctctcttttcgtctcctcttctctcctcccctcccccccgttctctccccttcccttctcctttccttcccctccctccctcccttccctccttcctttcctcactttcttatttgtatatattcatggggaacaagcgcaattttgctacactgatatactgcattgtggtgaagtcagggtcttcagtgcatccatcactggtgcaacttacattgcacccatcaaacaacctctgatcatccacccctccatccagaactctgccagtctccacctctgagtctccattgtccaacattctacactctgcttccatgtgtacacattatttagggaaataatattattcttacaccttaaaaactatcaagtattcttcaaggaagcttctaaaatatttgaaaaaatggaaggaggtagatttcattcaatattctaatataactatcaatccttgcaaaggaattccagtttattaaaaatttgacctgaaattccaatacatccttctgggttagcaaatgcctctaattttctaaaattatgggctatgtgcattcagtattaagagaattctgtctacttaacaatcattctctcctctcaaagtccaggccaaagacataaagtgctcgtttacggtacaagcagctatcacatgtcttttaaactatccgactgttctgctttatgtacacagctgcagttcccaccgtttaggagtttacaatatatgatcatttcctctatataaaaatgcactactttttgcatgctttcattcctttaggtggtaaagtatgttaatgatggtgcccactcaatgctgtaaattagggtttctcaaccatggagctattgatatctgaggctggataacactgttatggggatactgtcttgtgcactgtagaatgtttagcagcttccctcacctctactcactaaatactaatcatatccctccatttgtgacaaccaaaaatatctggaaatgttgccaaatgtcccctaggagcaaaactgccttcagttgagaactactactatagagggccaattcgtcattctgcgttcttacagtttttcaaatatgcccttcccatgtacacccaatattaagatgactggcagtaattaatcttttcaagtacttcttgtataataactaatattatactgtatttgtacatatcatttcaatgacatttttaaagaaataggctatcttgcacaatcaaccacataataagcacttattaagtacttgcaatatggttagcagtatgtgaaccttcaataagtcacaggttttgcttacaaggagctttccctatagatgaggaaagaagacatgcacatgtgaataactaaggacactgtaggacaagatataacacaacactaaaccaggtgatataaacttcacaagggaggagtgaacgttagtactaaagttttcagaaatgctcccatggagctgatgacagccaggtgcaacctttgaagatgagtgaatatcacataggtaacaaggagaagagcaagtaagccatggagggcagccacatgaaccaggctggttggagagagcaagcaggctccgtttgagagccatgagggcagagtccccatttagaggacagtgtgggacatgaacatgtaagacggatacagatcacgaagagctttggaccacaaatcaaaaagtctgggtttgagatggtagacattcaagaccattttggggcacatgtgtgatgtgggaagaaggcatcatatgaactggaacataacccaaacgagagagagaaaaaagttactcatacaggtttatattgattgactcccgggacagtatgaaaagggggaaaaaatgggcaccaggaaatgttttaaagggaaaatctattagacttggttaatatcaaactatgacaagtaggataaattaatcttcaaggttcaagtctggatgagtagaaaaagaagtaaagcctcaacctatataagccatctaccgtattcatagatctcaatattacctaccttaattaatcttaagagtcacttctccactggtttgtttcatttgatcacctcatatagattagtgacattttataaatggaggcatgaaaagaaaaatataaaacataatataccaaccatatacattaggacaattgagaacagagatgaggcaatgcattcataatttagagggagctctgatttgaggtcttggttgcctggaattacctagaccctttcacttgagggtatgcatcccctcttataagaaccagtcactgagctaacccattccttaggcctcattctagttagcttccttttttaaacccctgattccctagcagggtccaaatacaactaattcacaaatttagccaaccaaaacaaatcaacaacaatttcaacaaccttcaccgtggattctagttctgagccacactcttaaggaaatctcacattttccagttgtctttaactccgtccatttcagccatctcacctcgctcccaatcaaacaattgtgggaaaagactatccttactcttggttttcctcttcttgcctattgatggtaatgaaaaatactaatattaggagtgctaattatatgaatgtgagcttgttaatgctagatggttggacttatgtgttttttccaatttatgctgcagacctttataattttttgccttctacaaattgttgttaactagtgtctttttgaaatgcagagctctgaatctcaggactatcagcattttgaaatttgtttgttgtggggagccatcctgtgcattgcaggatacttaacatcaataacctctacctattagatgttagtggcagtagtcgcagcactagtaacatctataaactctaccgccccagttgtgataaacaaaatgtgttcaaagactgtcaaatcccctggggaacaaattcacccctggttcaagaccactgctgtaatgtgatcttgggggacaaatactggtcatgtactgtttgtataattctaggttcaaagactgaacgaatgagtagaaaaattagataacctattaactctgaaagcctataatttcttaacctctaaataaacatattgccttctctcttgattcaaagagcttgaaatctcgatgaaggaaaattggccacatagcctatgcccttaaagtaggcatactaagaggggcatggctagacttgggatgagttggagactgaatcatgtaatctgcccactccacacccttcaccaccatcacgttgccacttcccttggctcaagtcactcaggatcaaagagatgctgctttgggggttagttggtaaaagcatcagcttgtgaggtaattatatgtaaggtatctcctagccatcataaagtcatacagcatttcttctcaatggtttaaaataaaaatccattttccgtcatgctgttccaacttttcactctgaaagcatgattttcccaccaaaatgagtgagctcaagatgtcactatggtcaagactgataatgttcatccatgaaacctactcttcataaactccctcagtgtaatcatgatgtgctatagttgaaattggaaaggatgttatgaccaaaaaaaaactaccatgaagtcttggcatgcagttttataccggtctagtaacacctacatggcttcaaaaggcttagtaaaacttcgaaacgatttaagaactatcctaaagcactccacagaggctcctggtatccagaacccctgttccaggagaccagaagtgtaatgattctcatgaaccttgttccccccgtacaataaaatccctctttcttgagctagtttcagtgggtctctattatttccaatctgaaccctaaggttactggctatggcataaactacctaccggttctcttctgattttaaaatgttatttaaaaatgtatcttcttgtaggggaaggggagtgaagagtcattgtttagtgagtacaaaatttcagtttgggatgatgaaaaagttctggagatagcagtgatggttgcacaacaatgtgaatgtacttaatgtcaccgcattatacatttaaaaatgattaaaactgtaaattgtatgttatgtttattgaccacatatgttatgtatattacctttatttaccacaataaaataagtttttaaaaaatctatcttcttgaaaaaagcatgattgaaatacactgtctacagaagcttctaatcctcaacgtgagataaacctagatagttggggcttttcttcctatacttatgaatataaatagaagtatgttcccaactctcccaaaattcagtaaagtgttctgagcctgtatccaggactatcaaagacgcccgttaaaacatgtacaattgtagattctgaagtgatcttttgttttgtcagtgattccccccaccatccctttacttttatcactacttatcactttattagcatctttataaaacgatgtaataaagtgcaaaatggatatgcacgtgtccacatgcaaagaggcagaccctggtgggaaggagtggaggatgtcagggaggaatgaagaacctaattttgtaaattgattaccacttacctatacatttaaagcagtcagttcatgttataacatgacaaaaatgtctgtgtaaccagatgacgggcacaggatatcgtgtatattaatgccaacaataaaaaccaatagaaattttgcaacatgcggaacagaccgacttctcttgttagcatgccaagtataacaactcctttgttcactctgacattcagagcactagacagaaaggctgtgagcctttacctgcgcttcactgcatttcttcattttgataacaactgttttatccatatttttctaccgtaagaccataagctagatgaatgcaagaaaaatttactttgtgtttcccacaagagacataatacgaagaggacaaacaaatacacatttatttaggttttgggcaagaggtcaacaatttaagataagccatactgaagttgtagcttataccaattttggagctgaactagttttaattctgtatcactcccttgaactttttggtttgttcaccacctgtcctctgttccccttaacctcatttattctttctacctaatcttgagagcctctagatccagaagtttttgccatatgaatttttacccttccatgatatttttaaaactttaagaaatcatttgttttcttaatttgatctcttctaatttggtcatcttttactctatctactttctgaaagtagatctatatctatatggagacatgtatatctatatctagagatatctatatctagatagagagatgtatatatctccagatttctgtatctatatctagatatctagattatatatctgtatctagagatatctatctagatatagatagatatacatctctttatctagacatagatacacatctccttataaatatatctacataattatatgtaagtttatatctatctaaaaataaaatgtatttaactctgcatctctctatatagatatatatcaatatatataataggtatagatataaatacatattatttttcttctggtttctcattattttattctccacctaaacttcctgcttgcccttcactagtactatctcaacctttccctccataaataaatttaaaaagtgaaattttatacctaaccaagcataattcagcaattgacttcgtgtttccattggacatgacacaaggccttctcttatctatcatgatgaacagtcaaacggtataaccaagcgaaaattttattaactataattctctagtagcaagcataggcatcattcatcataactaccattttattagggtacaataaaggatatatcttgaagtatcttctcaatgctcaacaaagattaaattatgagttttagtgttaagtgtattttatcacattctaatcctttgaaaaggggactcagaagagatggcaactttctaataactaagctttcttattaactggactgctctattcctcaattacgcaagttaacagatgactcccctgtaaattaaaaagaaaataaaaaaaactagacacctcatatggtatttttcttctttatgtttagtgatagttaagtagaactcctgctattgctcaatacacagaacactcattaaatcagcagatgagtaaaatgcaaagtgaaccaaaatgccagttactgtgttgctgcggggcagcatcagaagcctgcagtctgaagcatatgctcccaattctcagatttctatagcagcatctgagagaacacacaagaaaagagggaggtttctttgcttttgcctatattggccagtattctcacatttagaatgcttgataccataaggtatagtcggccaaatagtttggtagaaatgttacagacagatctgaaacaaatgattcacttaaagtgccttctataaagtaaatgctgcttaaataattcactattaattggacaggtattctgcctagtaaaaactgtgtttgtatattctgtttatctatcttcttgcattatttgctatttatttaaatcatcaatggagttaaatccaatgtgcaattttccaatgtcctgagcccttctgaaaattgtatgctttggaatgaaattcttcatgtgatttctcaagtattttgaggtagggtggttagatgaacaaccagaacataacccattttcagctgggaggatagtcaaataaacaaaaatatgtttctgaatgaaagatattcaaaggaatacatattactgcatattttcagtatgattatgtaacaagactccatttcaaagctaactttttgtttggattacatgtgcaaaaaggtcagggctatgttttctgtaggaatttttacttttgcttatttggaagcagttaaagggccagaaatcctggctatttagaggcctctgtaaagatgaaaacacataaacacatttaacaataaatatttgtattttaaatataggcatatttttgctatactatagctatttccttcactgcaaaccactggtttaagatttcctttaataatgaagatatatttctaaagaaatatatctagataatctataaaatggtttttaaattgtttcataaattgtaaaacaaattggctgtcaacatggagaaactctcaatagcccaggaaaactcaggcttaaaaagtttcaaggtttcctggaactttcaatgttttctgaaaattttcatctccaaatgtgctcaatgttaataattttagagtctaaaaattgtggctgatcctaaatataaaactaattgacaacgacaatctggtttcactcatggtagacctattctggaccattcagaaagtgatgagggacccaaggggcagatccacaattaccttcccttacttggccttactggtcactaagcctttcctaaaaccaaagctgcaaacagtgcaactgaagtttgaactccatttccttccactcctgccctacttattaggttgcacagaaacaataaaagaccaaatgagttatagcaggactgctcttacttgagaggtaagggtatatttatttatagtccagggtcaaagctacttccttagattgtgaccatcttaagaacaaaaagtatctaatccagtgtgaaatataatggttcatacctagtaccattaactaattaaaaacagaaaggaaagactgcaaatttttgatgatgaagaaaccaaaggttccctgaaactctcagtttgaaccaaggtcattcgatatcattagccagagtgtggctgaaaagagaaaccaggaagtgctgagtcatcgtgagcatatgcaacatcctcgtcagcacttctggtgccagattcaaaggtatgcgtacttcctttgacctgctactcttccatccttttctcagtaacgcagggtaggtcatggaaagctaactgccaccaagttgagaagcagcatgaaccctaacaaataacactacttaacactgtcaattctatatgctggtctctagatatggctatgaaaatagattgtttgaaaatatatatgcgtgtgtatgtgtgtgtatatgtatatcatttactatctgtcagaattaagccattatacctctagtttccagtaagtcaagatagcttcctcttcaaataaacagcatgcctttgtcagcatgcagtttatgtgcatttaatttgccaagcaggtcttactaaaacagtcaaatccaaatgacctttgcatgactgaaacacttgtagtattaggtagaaaaactatataataggggaaataacaccctggagtcaaaaggcttgtggtctagtcctgactctgccagcagacagttgaccttgagcaagtcatttacgttgtctgtttctttatctgcaagacgggaataacaatcctcccccagtctccctcactgctgctgtgaacgtaattatattaacagcacttaagaagtagacaactgtcatgacgaaaagaagtgatgaattcattacatattttttaaaaaacaaaacttcagtctcaggctagcttctatgcattttattagaaacatacaataattttactggatttgaatgtttaagttgtcacccaggttggaagtgacataagaagataaacagtaatagtaagtagatgggcagaattcaatagtaaagggctatataaatatacttcaaaaaaagcaattataggccgggtgcagtggctcacgcctgtaatcccagcactttgggaggctgaggtgggcggatcacgaggtcaagagattgagaccatcctagccaacatggcgaaaccccatctaaaaatacaacaattagctgggcatggtggtgcgtgcctgtagtcccagctactcaggagggtgaggcaggagaattgcttgaacccaggaggcggaggttgcagtgagccgagatcgcgcccggtgacagaatgagaacccccccagcgccaaagaaaaaaaaaggcaattatataggagaaatatcaaaataatactttattgagagaaagaaaatttgaagtaacataaataatcagtacccagcattttctcatagaatttccacaggtctccagcattgctttctgcagtattttactcattggacattcttcagctatataaataagcattgtgaacgagcctgggattcaactacagttataatgttgtatctactagaaatcctgagtgctcaaaccccaatgtagcagggtactttaggcaaacatcgttttagtcccttcaccatccttgtacactgagacacgtggctgaaaatatttacgccctccttaccgtgtgtaaaaacaaaatgaaaagattctttcttggcctttgactctcagaaggaagaacaaactggggtggcttcgagtgaacagtcttgagattaaatgtggaaataattatagcacttgaagatggcagaaggtggcattcaagatgacagtgtaactccatctaatagcaaccatttgttgaacagctcctatgtccgtagtacctatgccttgcccttgcaactactacctgatataatgtcacacttaaccagagaaaaagtaggcagacttgagagattcctaatggacttaatcattttgtccaagagaatgagagatgcacataatattagaatttgaagattttgtcaagttctgccaccaatcctattaacaaaaccacccccctacaaaatattctgaaggagaggaataagtaaggcaactaagtacttgacaagtatcaaacacttaaaagggcgaggcgcagcagctcatgtctgtaatcccagcactttgggaggctaaggctggaggatcatgaggtcaggagttcgagatcagcctgaccaacactgtgaaaccctgtctctactaaaaatacaaaaattagctatgtgcctgtaatcccagctactcaggaggctgaggcaggagaatcgcttgaacttgggaggtggagattgcaatcagccaagatggtgccattgcactctggcctgagcaacagagtgagactccaactcaaaaaaacaaaacaaaacaaaacaaaacacttaaaaggtacctaacttcagagacatcacttaatatgtgtcctaattttacaaatgaagacattgaagcttagaggtaggaagcataatggggttaagacacatagtcatgtggcagaactggaatgtgaacccacatttgacctcctctcttaggtaatcaataatatccaataatcaataagtaatagtgtttgttatttctgaggcccatgtgtagcttcagacttttaatttaaattttctcattcaattttttttttttttgagacagggtcttgctctgtctcccaggttggggtcaagtggtgtgatcatggctcactgcagcctcaaactcctaggctcaagccttgatcttcccacctcagcctccagagtagccgggaccagaggtgagtgccactatacctggctaaattttaggaaatattttttgtagaaatgaggtctcactacgttgcccaggctggtctcaaattcctggcctcaagcaatcctcccacctcagcctcccaaggtgctgggattacacacatgagccactgtgcctggcccacactcaaactttttaagatgacagcacagtacctttcacaaggatatcatatattgaattactgagctgtggttcaaaagtttgttcatggtttaccgtacagacattaaccactgctcaatcatttctaaaaacatatataaagttgatgccaattcacaatcaccagaatttatttttaattgtcatactaatttggtgatcagaccctcttctatgtcagaaacaaagggcatatatgtgagttgactgcagccttctgacaaggagcaattttcttctaagtaagttacaactaaattcccagccttggtctgtacacccatgatctaacaactttttttgcctttctcaacagtggccaagaaaatatatgcaattcatagtaattcatgatttgggattttatttctatgtaaaatgggataatttttaaggaccctgaagtcctttaaatcacaaatcactttagggtagcagtctattcctgccagaattcgtttactggaattacaaagtaaataaccgtgaaaagaagatggaggtgaaaatcaaggttgtagagaatttgagagggaaacagaaagggaatcatactgcttgcttttaaaaaaaaaatgcaccaaagctttcttcattcaagcagttggttttgttccctaactggtcccccacatatctaagtgcaatgagtacattcccaactcctactgccaagttaaaatgaaaacgttctcagtctagaaatgattgaggtggttttctttaatcaaattagagcagccaaatgttcctttcaaaggtaactgtctactctgcagctgtatgcaaactaccacatcaaatgtgagggaaaaaatagcgatagaattgtgtccttacagtacagagctagctgcagagatggagaaacaaaagcatttgtacagttaagaattacattcacagtgagcttccagaaatatgctgacttcacaaactgtgaacaatgtattgaaacttccagtacataattagctattttggggaggggaggaacatggggggaaatgcccccttaaaaacggctaagcagcaatagataccttgagtcatttaccctcccaaccaaagtttctcaatgagaaacattaaaagactggctgagacttcataggaaaaaaaagtctcatagaccttgctttttcacttcctgtctccatcaaaaacacaccacagtgagtaaacttgagtatcccgcaagcttcaattaagcttgtaatgattcatttgcatgcagaatttattcttttaaataatcagacatgggaatttcctgcaaagaattaattcatagtgggcttattttttcagtttgtttcccttaagaaaaatcaattggctaacattcccaatatgatgtcaaattagcttttctatgttacaatttatatcagctgttggtttcagggatggtatatcaacagtatgaaaacctagaagatgacaatgaatttatatagccaggtgcaatcagcaacagaagaatgaaacaatgttctttcttcaattatggatcctctccagatggttatactgtcctctaaattaaggaatgtggaataaataggggaaaagtatatctcatgtgatcccaatatttctccagagcagctgttcttaaacttttttgcttctggtgaaattagcagacaacttccttggttcacatgccctttgacattacccaaatttaagaactgctgcataacaaaaacttcccgcaggtaataagcaattcttgggctgcagcccttctgctcccaaccaggaaagcaaactgaattgcaaaaaaaaaaaaaaaaaaaagacattttgattattcaaaaatttattttaagaagtgtaatcagacttccagttcaaaatggtggacctatcacaaatatttgcctccattctttctcagtaaaagaaataaacccataattacaaaagggcgtcccacatacacaaaaaggagagaatttagtaaatttgctgggtgactgaaaataaacagaaataaggtgatggaagaagtcaccaaagagatagtagtctccaaagtgaagaacatataatcaggagatgtattaagaaaatatcttctatttttaggtattttgtaccccttcatttcaaaatcattatttttattaaatatataataatatatctgtatatgtacataatttttataattcagtgaatatcagtgacatgctcaaatatttttactagaagggaggccactgccctagaacaagccatgagggcaccgtggaggaagcagaagctggactacgagtcaacaggtgcaatggaaaaagggaggaagaagggcagccattttcttcccacattcaggggagtcaactaaatgtctgtatatagggtaactgcaccagttagcattcctattgccatccctgtacctaagatcttggagtaaaccatttcttattgtgacatttgagagtttttccacatcctgacagccatttttccagccacccaaaagtaaagcctgtgaagcatactcccatcccaagattcctatgccaaacaagtctcccaaaaattttactcagaaatgagagccagcagggaggaaaagatcctatttaatagtcttactagctaaccagtctttataaaaactaatggacatacaaggcagtaagggagcaagaaggtccagacttcttacctgccagaaacaactagaaactagataaacatatgaaacaactgctttcagatattggactataggtagtagaggactgtgatccctgagagaggggaagcaaatgaggtgagccctagattgccctagctttctgtttggaggcaatttccagaccacaggtacaggaaggaggaacctcagagttctgtaaattctgtagtcttgcccagctgggtaggcagagatcagagttgagaagacaaggaggccaaagtggctaaaatttggaagacacaatactgaagaagagctccagaaatctacatggggtctattgagtccctggctgaatattaagctacacatgtggaactgcatgaagtcaagaaaggtcagcttctgagaaaagatcaccaaggagttgtaagatgaatgattccagagctcacagagggcagaaaatgtttcaaactccttaccagccaaagaagagagactacaaaagagtaatgtcttagtagggctaaactagcctggaagcaaagcctacatacactagatcctctccccaacaacaaaagagacaaactaaaaataagccttggaagtataaaactgaaccacacataactttactgcctgccagaacaaaatccaattctctttaaaggagtagaacaaaatccagcagttgacaatgtcatagtcacaatgtttggcatccaataacacattattagacatgcagccatacagaacatgacccataagcaggagaaaaatcagtcaatagaaatagactcagaaatgacagaacttatggaatagcagacaaagaaattaaataaactattataaacactacaaaaatgcccaaggccttaaaggaaaacatggacacagtgaggagaaaattggaaatatataaataaaaaatcaaatggaacaagtaccaagataagctatatgttggaccaaagcaagtgttactatctttaaaaagtattagaatcatacagaattgttctctgatcacaacagaattagacagaaagaaattagaaaaatcccttacatgtttggaaatttaagaatccatggattaaagaatatataactaaaaatggcttaaaataacccaaattgaatgaaaattaagccacaacatattcaaatttgtgggaagatgcatatatttgaagatccaagcttctattttaagaagctaaaactaagaacaaattaaacccaatgtaagtaggaaaagaagataaaaacaaaataagtatcaagagaccacagacaaacagaagtgaaaattaatgaaacaaaaaactggattatcatcaataaaactgacaaaactctatctgtatgtcaagataaaaagaggaaaatgcaaattaccaatatcaggaataaaagagtggacatcactacatattctacagacattaaaaaagataaggagttaaagaatctataccaataaactaccacccccccaaaaaaaccctaggatagacaaatcccttgaaaaatacaaaattataaaaggtgatctaacctataaggtctcatatctattaagaaaatataatttgtagttaataacctactcaaaaataaatgctaggcccagatgacttcattagtaaattctgttaaatgtttaagaaagaaagaatgccaatcctacacaaaatctttcagaaaatagaagaggaagaaacacttctcaactcgttttatgaagccagcattacctcagaacaaaaatcagagttattataaaaaaaattataggccaatatcattcatgaatattcttaacaaaattttagcaatatataaaaaggctacatcatgaccaagtagggtttatcccaggaatgtgagcttggtttaactttcaaaattcaatcagtataattcacagcacaataacagagtttttaaaaaaataatcaattcaattcttcagaaaaaacactgacaaaattcagtacccaatcatgaaaaactctctaagcaaactaggaatataagggaacttcatcaatctgataaaggacacctaggaaaacttacagctaacatcatactttagggcaaaagtctgaatagttttctccttattattgggaacaagccaaaaacatctgctctcaccacttttatttgacatttttctagaggttctagccagggcaaaaaaagaaaggaaaagaaataaaagacatatatatatataggggggaaagtacaactgtctattctcagatgatgtgtctgtgtatgtaaaaaaactaaaatttacaaagaagctaccagactaataagggagtttttcagatcacaagacacaaggtcactatacaaaaaagactatagctctcaatgacaaacacttaaaaagaaaaaacaatgccttttacaataacatccaaaaacattaaatgcaaagagataaatttaataaaatgcaagcaagggcattacactaaaagctacaaaactctgatgagagaaattaaagacctaaataaatgaagagatacaccatgttcgtgatcagaagtcagtgtcaatatctatgccttcgccctaattaatagagattaaatgctatcccaataggagaatttttgtgttaactaacaagctgactctaaaatttatatgaaaatacaaaagaagagcaacaacaattttgaaaaacaagaacaaagctggaaaatgtatactacctgattaagacctatacattatagtaatcaaagtatgacattggcaaaaggatagatatatagatcaatgcaaaagaacaaagagtctaaaaacaggcccaaatgtatatgctcaactaatgtttagcaaagctgccaaggtaattcaaaatgaagaaagcaaagtattttcaataaatggtgcggaaatagctggatatccatacaggaaaaatgaacctgaactcttagctcaagccaaacacaaagacttgacttgaatgcatcacaaatctaaaataaaagcaaaaactataaaattctagaagaaaacataggaaaaatcctatatgccctggaggtaaacaaatatttattagataggatacaaaaaagcataagctatcaaagaaaaaaaaagatgaattggacttaggttaaattaaaatattctgtttgacataaagcattaaggaaatgaaaaggtaagccaaagacctgaagaaaatatttgtaatccatgtagctgacaaaagactgctcaagaactcttacaatacaataagataactcaattttaaaaaacggtcaatttgaacagaaacttcccaacagaaggtatcagaatggtcaatagccaaatgaaaagatattcaacaacattagtcatcaagtaaatgcaaattaaaatcacaatgtgttattagttcacactcactatagaatgactaaaaataaaaagattgacagtcccaagtgttcaggagggtgcaaatcaaatggaacctttatacactagcactggaaatggaacaaccagtttggagaagtttgacaatttcttaaaaattaaatacacaattgccataccagtcagcaatctacctgtaggtatttaccatacaaatgaagcatatgtcatatcaatacaaagacctgtacacaaatattcacaacagccttatttataacagccctaaactggaaacaacagaaatgatcatcagcaggtgaatgaataaacaaattgtggtaaatccatataatggaaaatgaactactcaaacagtcaacaacataaatgaatctcaaaaacactatcaatgaaagccagatataatagaacataatactctttgatactgtgtatatgaaactctagaaaggacaaatctataatgacagaaagaagattaggttggcaggggtcctggtagagggaggagattcactgcaaagggccctgtgggataatgcgagtattttagatattgattgtggtggtggttagtaggtgaataaatttgtcgaaactcataaaaagcacacacttaaaatgggtgtattttactgtataaaaattatacctttagctcgttttgactttaaaaaagccaaaggatattcaaagatcaccaggcatttaaaaaattcagccacaggaaaaacaaaaaagttaaccaaaaaaactaaacactgacagaaacagagataatgtggaggactttaaaaaaattcacagtaattcaaagaaatattacagaaaaccagaggaggatgctttaaaaaccaacaagtggagaacaaaaaatgatgttttgaagttaaaaatattaattactgagagtaaattcagtagacatttggaaaataatatagaagtttctttagaatacaaagcaaaaaccagagaaaagagatgaattagaaaaaagattaaaagaagagacacagagatcccaactgcaagatcaaatatctgactaacagaagaaccttgtaaagagaatagaacaaatgatgaagaagcagccattaaaaaaaataaaacgaagcaaatctgcacttagaaagattccacagaatgcccagcaaattaaatggtggcgggaaacccaccatatgtagacacatagtatttctggagaacacagattgtgataaaggcaaacatggcaagaaaaaataaaaaggcaattagaaactccaggaaaaacaaaatgatacaagaaagtcatggcctgaataaaaagtacacgaaaatagggcatattttaaacaagtgatgcagaataaggaaagagaatccagatgtctgtttttacaaaagaaggactccatcagcttcatagggttataatgttgaacctggagagaaggaaacataagggctgaatatttggcctagcactgaactctctctatatagtcagaagaatgtaagcactgtttaccagtgttcaacttgcaagggtcaacctttagaaaagcagggaagcctctgttgcagtacggaacagaatgcaaataaacaattttagcaaagtagctgatagaaattgtgatgttaaagggagaacataagtggaagaaaggttacggggataaaatattctcctcttactaaatggagaatcaagagatactgcccaaagtgaaagtatgaaaaattgaagtttagggatattatttaaaattattatatgaaataaaaatatccctatctcacagaaagcgaaggaaatacacagtaatattaacaaggtaagtcctcatttttcagagtagaaagtcaatagatattactgaagtttaaatatcaagaactagagcaacagcatattatctaaatttatggagaccataaacagaagcaccaaaaacagacagtgaaaagaagctgtatctgagtactgggaataggaatagctgtatctgagaactggggcaggagctttgcctttttatcataagccctttcatactatttagtattagtattaatgtcatgattacaaaaaagctgggggtgggggggtggaaattctttaacattccttccattaagaggtggtgtatgtctctacctcttgaatctctggggctttgaactcaaatataaacaacaaaacgtggcataattaacactgcttgttctcagggacaccaacttttaaagccatgagccaacatgtacattcaactattctgaagctttgatgctgaaagggaagcccaggccacctggtgtaggtcagtgtaggtgctctgctcaaaaacctgagttcagatcccagccttcgccaaccaacttgcatgaaccaccaggcttgaaagtgaagacgcctagaataatcaaactaccagtttttgagtaatttccagctaatgtcccagacatcttggaacagagatatgccattctcactgtgctctgtctgaattccccacctgctaaattcatgaatataagataatggttgttttaagcccctacatgttggagtaatttactacaagcaatattaaccagaaaaattgctttaatagaaaaatgtaattattttaaacaaaaaactgcaaataactctcctcacctgcaaactttggtactctactttattaacaacttccttgaaacatatctgacaactgactgggaacaccacaattttttttcttttctattctattactcactccctctcttcattccttctttccctttcttttccttaattctttcattactatatatattgtataaattatgttatatatataattagtttattgctatgtaataatatattagtattatcagtgatgtcacaacccattacgtgatcacaatcagctgttctaagcagaggaggaaggtgcttggaatggtagccccaaacagaagtaatgggacaaggttcataatgggactggccacttgggcttcactgcttataaaggcagtgatagccatttatacaaggctctttaggggaatgcatgtcaatattttaatatgacatacatattacatggacatccctacttgtaaggacagctatggccattaatataaggctctttagggaaatataaaatatgactctttagaagtcatattttaatataactaattttacagtaaaacaaaaatgagcagtcacagcccagagaatcttaaaccatgttcacaaacttccatcaaaacatgtaaattcaatctgcaaaaactgatatgatgatttaaaatatcactaaaatatcaatattattggcataaaattatgttcgtaatttaatgaaaacagtagtggatgaattagcttagaaagggtatatctcattgtccaatctacttgccaatcattacattattaaataactcctaattcccaggtcagaatccaatttactacctattagagactacataattttgaagagttttaaatgcaatactgagtgaatagaaaaataaaatatctaataaattgtagtgttaatttacatttttactgtcaataaagttgctgtgaaaacagtaatcttgagtcatggcttaactatttattcactcagtcatttactcaattgatatttactaggaactgttctggatgctggagataatgcgtgagcaaaacaaaaatttttgccctcagggagcctatattctaatgggaagctgacattcaacattaattcatacaactattcaacaggtaattgagtgctaggcacacggggcaatgcaaaaatgattaaaataaggtgcccaagaaaaagcagacagcaatgccattttatttttgcagaattgtaagaatgataatctgagtttactcgttccataagcactggtttgagggttttctaaatatggcagaattttcatctactttcagatcaccaggtttcagagtttgaagtttatcaagaaacttcagatctactcactatcccaagttctcttactgttttttctattttctctctcattgctaccttaacttagcttatcttctaccaccgtcttcccttcttttaatgagcatgttgtcctttcagatacataaatacaactccagaccattttctatttgcctaatgatggattcacctcttacttttatcaactaaagtgaaaaaaaaaaaaaccaaacctataccatctttcctaaacaaagatgtttctcttgactcatctcaaaagtctagtttttctaggattggattggtaccaccgagtcagtcacattcatacagctctccttgaaatcagttccatcactttgagtcagtcaatacttgagtagtaatgtctgtgaaacagacttcttcccttcacaaaactttagctgagaaccaagtggcatcagttctcatctaatcagctagaagttaaatagccactgattaagtttcatgggcttaaaataatttgtaagaattagcagaatgttaccactcttcttttgagtcttaatatgtaaaaaaaaaaaaaaaaaaaaaaaaaaaagtcatttcaaagaagctatgttctcccaggtcaagggaacttacataatttgaatgtatttcattcatgatcagcactgggagtcccttctagccccaatctccaaacctgtctcttggtttctcaaggttcaacaagaaaatatcccattttaacccaagattatttaataactttttaaagtgattctacatggttgaaatgtatactatatcagctaaaactcccaacttgaaacgactcagacagtctcttgggttcttctaaaaagttttaaaatgtactggtctgagtaaactaaacttttaaactaaagtttaaaagtctacccttgaaatgcaaagatgtcttttttcagaaaaagtttttattatttgtagagacagggtctccctatgttgcccagtctggtctctaacttctaggctcaagcaatcttcccatcctagccttccaaagtgctagaattacaggtgtgagccactgtgcctggccttcttttgtttttcttgctctgctgctggaaaggtgtgagagttaatgttcctaacattatactttgaaccttctaaaaataaaagtattttaggataaatgaatgtttttttttaatcattaggaacacctaccacagaaattatgagattactttgcaataaaaggaagcaaaggaaaaaaaaaaagcaaattcactaaagattagtgcccctaaaaaagaactgcttcattgctgtgaatagaactcttaacgatttaaacagaggacacagaacaaaattttaaatgtcataagtcagtcacgccataggaacagcctcagaaaataaacaagcagaaattccaaagtatgacaaaaatgaataattctctttgagattttgaaattaaaaaataaaagaaagaaagaacaagcaaagaatccaactcctctttgggttaatttgaatagtcaaatacagaagaaatcatcaagctcccatcagttttgacaatgtgttctcagcagcatttggtccacagatactctcacaataaacccattaataaacaggaaagaccactgggtaaacacgacaccaatatccaatacccaaatgaaagattattttttactttaattactataaactcaatacacatcttttcagaagtacctagctccattcatactttcacaacgtgaggtggaatgaaagtgctaccaatcagtaatacagatatctgtgtacatgtcagtttcttccaggaaattataaactacttgaaagcaggaattcattttgttaataataccttatatttgtataatattggatctttgtatacataatttcatttgatcagagtaaaccactaaggtctaaagagcagtagtaatttctatttttattgtggggatatggcagccaagagacatgaggaatttaccctaggttactcaactattaaataataagcagaggaatcaggataagaatcagttttctgactcctagcccacaagcaggaacatttgaaaaacttattatggaaaatttcaaacatatataaatgcagagagactagtacaataaaactccacagtttcaacagtgatcaactcatagttcattcttattgcatctctaccccattgtgaaacaaattgcagaccacataccattttttgggtaaacatttcaatatgcactttttgtgactactgccttaatcccatttaacaaagcgttgaatataacagatactcataaatacttgctgaatgccagagacctcacctgtattttcagacatgattactcatttctaactaaaaaaaattaaattctgaatttctaaatggcgcatattctgtcatttagaaatacttattcagggttacaagacaccagacatcatgctaaatgcttgggatactgcaaggaacaagacaacacagtcccttctttcaagaatcttgtactccactgttctgcatgcacatgcgtgcacacacacacacacacacacacaccccaaccatatgtgtcttaagaaactggaatgaattcaaactggaagtatacttcttaattaaacctaccagtttgtcaagatggaatccaaattctctgtacacaaattatgaagaggagtagaagacaaggctcaaatgaaattcagaatcatcatcttttatagaaattattaggaaggttttacctaattctgctaacaggttttccactattgaaagccaaagaaattaaaattaatgggaaaaataaaagaactcaagcaattgatcaaaatgtatttataataccttactttcttacatttgaaatgttcaaatcattttcagcttttgctgaatgtatgctcatttcctaatgttaatgtcttctttgcagtatataaattaagtccaaagttgcacagttaactataagaatgaattatacttaaactttcatataaactatgtagattggagtaagacaaaaatgaaacttccttttttcagtatttcctaaattatttcccaggaatcccaataagtgtaatccaatatgcagatccgttctccctccttgacactccttagtattaacattatttcacatgatagaaataattcatatggtgtcttcctttataactggaccccttttcaatgatttcactcacttgttacgtattcaccttatatccaatggatacaggatataaacgaatgtaatcacaagacactctctgccttaaagagcttacaaatagggtgtgaaagagtagagagtcagaagagggctgtcatgggagttaacattccatcttacataacagaaataatataaggggacagatacaagctaagtgccataaaggaggtccaaagttaccaggactcaaaggaagcagaaatgttatccaaatcgaggtattaaggaatacagaacaaagaaagtgacatttgaggttggccctgaaggataagcagaatttcaacaggtggagagtggtgcaggagaggtaccaagtgcacattcagagatctgttcaaattaaagtaatagaggtggatggcaagaaatccattagggcaaatggagtagtccatctgtctgtaggatacatgttaacaaatacagaggaagaacatgagaatatcctgtcaaagccaaagcaagtacaatattgaagataaaaaatgcatagtcaggaaaagtttaaatatgagtaagtatttgaagactcttactaaatagacttcacatgtgtatgccttacagttaatacccacagatctcccaatgtcaatagtccaagatacttgctaatgcagtatacaactctaaaacgatgaaaagtgcttatctaaggggtttaaaatttcaatcaatcaggaaacatatacgggttaaccaatggttatggacaccatgttatttatggatataaaatacacaatcctggttctcaagtcagcaaacataaagtcactaaactgaaaatacttttacatctcaagggatttttttctggtatatccaatgaccatcagtcatcctgtcttaccaatgtttaatataaacctctgtctgaatcttagccatcctcaatcagtttatatctacaatgcatacaatcacagaataaaactgttcactaacagtgagataattttttgcattcataaaacaactcaaattttattattataaaacagatcaaagggggttgcactaggttaaatctaagacttcttccaattaaaaaaatccttatgctgtgattctaattctactgaactaaatcctttaggaaggccagagaataggaataatttaagtggctacttaaattacaaagccagtagatatccaaatttcggcaaactactatagacaaaggagatggtcaaaaatgtttaataataatcctgactcaaatggacttccagactacaactgtacacttgcatagattcctgccacatgccttgcagtccctccggttcacctctcaggcaagagcagctacatgtgcagctggtaaaataaaaatcaggtatggcagcaaactggtgatattcaagaaaactacccagcagctcttggaaaaatctctctgattgctggcctgcctgctccaccaaacctagcatctatggatcatcactcaaatagtgaccttcatgtaagtatgcttgttatcaaccaccggtgcgttttcagtgctgcctcctggatcttggacaaagcccaacatcatacacactaacttctcctgttaacaattcactgacacccagatttcatctctgctgtgttctgttacatcaagaagctcacaattaatttacttcctatgaagacagagcaactcatctgaacctcatgagaaagaacaatagtgtgattagttcctcagaaggcatggaaaacacatatttgcttatgtgtctgatggttattatgccatctaatttttaagtattatgatgtttttatttcattaaccagaatgttacataatgtgccagagccacattatgtaatatttcattcatcagacaagtactaagtgtttcaatttttcctactcctctttgtctaaaatgaattcaatattattaatgaattacctgcataatttacctgtatcatcatttaactatagctattttaaattattataattaatttaaattatcataattatagcacaacttccttaaaagaagaatttactggaataatactcttgtagagatatacttcagtatggcatactgcagaattcaggaatttactgaatttttattcatttatcgttatgtcattcattcctggcaaactgtcacttttgtctacatacagttcattttttccaaactagaaatgtactcacccgatttaactgcttccatcaaacaaacaaacaaaaattgctacttagttttaagaacaagtcaataactttaaaatggcatgacagacaagtagcttgacctccagagtgtcttccaaccctaatatccatggttttacaatgataggctgcatgtatgctgtgtttccttcttaaaaaactttcctaagaaatcattaatagtgagacatttgtttttttaaaaaagaaataatttatttttaataggaacctatttgcatagatattcatttacccatgtcttaaacataggaaaatatcctcaaagatattcaagtttatacaagttttcctcttatagaccttttttgtccttgattccatagagagattctaataattctatgttgatagtggttgtataaaagggatataactgcaatgtcaaaaattcagcattatcaagttcttctgtaggaacaaaaaatgagcagaataccattgtgaaaatgtttatttactaaacaaccttgaaaaatcagaaacttttcaaggaactctcagagacagaaagaacaaacatacttttaacatactgatatttaaaaggagaattaaactcctgcttttcctgcttttattgaaaaaagccctagtaaatgtattattcaaccacacaaatagcaattttattcagaaggattctcatgaactaatccaattgaagacctggctttacagagtcaaatatgtcatgtttcttttaccctgttaacaattaggttttccagagaaaatcacatttttactcaccttttatgcaatatattactaagatctttaaaaaagagagaaaattagaaaactctccttgaataatcattaagctttacagccttttctttgggttttttgttttgtttttaaagcagtgactattctaattataatatttaaacatcacaagtttattcactgatatgtaatgacttttagtttccagagccaatacttgaatttgaattgcttttactgttacactaataaatataatccctagaaacaatacaggtaagcactggcttgtatctttcttacagcacatgatcctatcatgtatcagggttatggtgatcatcttattccttcaaacatgggaagaactgcttcaggagagtagctaggtatgatttaccctggtatctttcccagcacctagccccatggtttttaaagcatatgcccttcctaaatcctttttgaataaatggagctcaaatgttcacttatattagctatgtgtcagtatctcatatagatcaatccctatgttagggaggtaaaatttaatcttcaaaaagcacttgattctgattagccttttggttatgttgcctactcaatcaggaaattcctggtaaccgaattatcagaaatatcagttgttctataaaactggttaggttaagtataacaaaacaaggcaattaaaacaaagatgagtaaatttttaaagagaagaaagaactgctcatctcattacaaggcaagttctacaagtgcggagacttttccaggcttgttcattgctatatccccaccttctagaagagtctggcacatagtggaccctcagtaaatatttggtgaatgaacagactgctgacaaaacatgctataattttatctctattgtttttagttcaggctgttcaaacaggatccatttgtgcagtgcagaaactccaatacaggttcacagtgaagtcctattctggcaaaggttccaggatttgggattaccaaatgtaaaaaaagagtaaatttacttcccagacactcactggctgatcaggcgagggcctgggatacatcaaatgcaggtaagcaagaatttcaagtcattatccctgtgcatgcaggcagtaccagtgccagcaataacaagtcagcttttctggcaaatccatcaaaattaaatcttaaacttttgaaaaaactaatatgtttattatgctcctgttagcttagaggcttaactatctgtgggggagggcctataattatgatcaattacttatgacttgaaggtacttataaaagcatctgcccttttaagaaaccattaaagaaccaggcttaagactgtaaaactaatcccaggggcaatagtaaatcacaggtttggggacccaactttgacaactctcccttggaaagaaaagaattgctgtcaactgtccttatttcctgaccctgtctgagcaaatattcgcagcctctaaaatccagaattcttagtctggccaagcaagtcatggggaccaatggttgtttcaaggcagaggcagaagagaagaaacaggaaggaaacaaaaagggaatgaagatctgtagctcatgagggtgacatcatcaataatttcctcaagtatcactgaatttcatggctcgtgactgagagtcttttctgacatcttacaggctaattatcctcaaggatcttcttggttccagagcctgtaatgtctgggtttgaatatgatttgttctacaaaaaaggtcaggtgaattgacccctccctgtgaagctgctccatggcaagagaccatcaatctgctgaaacgcaaacaatcctttagatatctgaagtactttcaaatttacaaagtgctttcacatacgccatctcattttattctcacgactttaacaggtaggtgccatcatcaccttaacacgtaaaaataattttagaaaacaatgcctttgtcttcagttcataagaatatcctcctgaaattcacagtacagaatccaagtcatgggtcagttagaaacgtctagaaacacatcaatctcaggaggataaatcaagagaataggatggatcagacaaaatctacaagcacaatggcagaaagtgtgcctctggtataagaatggcgtaagctttgtaaacaatagtgttatacaggggtgcctctgtagtacctctacgtttggaaggacactattcattcatatacatgataagcacccttaactggatactccataggtaacagacaaaataaaacaagaacttccgtcttaaaattgtagtggtggaattcatccttcgggatgtattaggtgattcccctaggacgacagctgagttacagggggctaaatataccctccccttttccctccaatatcacaaagagccccaaaaacggattttgttgtttttaacaaataaaatacacatgaaaaaaagtcatctataggtttttatatataatctcatcttctaaaacactcattctccttcactagctaggccgaggtataatgcggtcttaactttataaccatttactgccttatttatatatttatgattctttgatgccttctagcttgagtctaaactgcgttgggaacaaagcaccgcacaaatcaccagcctgggataagaggagacaagttaaaacctcccaagaagattctgtagatatttggtctctctgagtctgtagagagtttggtatttcaaaggtcagtcttgggtctctccactttgatgactaatgttaaattgtttgactttttacaaaaatatttagctgtgcttatttacatcatttcatcctcagcgcacacagtaggcatgtatttgttgaacagaagccctaaatggatgagaaaaaagatatttctgctacacattttctcaagatcgagaaaggtaaaatcacaacccaatttgcagaagtttctaggcattccttttcaatgtaaagctatgcatctctgtttaaaaaagaaaaggatgacacaaccaaacaatgtcaaccacacaatggggaaattccaggatcactaagaaaacaccattatcctaagtcacacattttcatttaatactggttaccacacaggagagagtaagaactgctgtctccccacccactcgcacaatccatctgggaaaagcatgggcagaacatttatgatctaaccataccacatcttggactcacatttaaccctttggagaattagtctaaagagtatgtccgcccagagatataaagtaaaacagacacagggataacagttttggaagaaatttttatgacgctgtttgagattgggcatcagcactcaaactccttagaccaccaggagtcattcttactacgcaactttaataaagagaaactgagagtatgactggcaaaaatattatgatgtttctgcatcttgttaacctgatttacacttggctccacccataaagttcccactgattatcacacggcatcctcattctccagtctcacctactctgtctttcaaaaattccccaacggcatggccacgaaaaatatgcgggggctagcggggcatgtctcaggttggcttatcctgtccctaaaacgcacccacttcccccagaccctccttcagggtgggcagggagaaaacgcttctaagttgcacagctgcagggaagcctgctcaggtcatgtttttttgacttgtctttcggctcgctgtctggcaaggtcaccggctctggctcgcggctctgtcgacaaaacttaactctcactctgtaagaccaacaggtcgcgcaggacctccccagtcgccctctgccccgcacctttctgggcctgaggattcccggctcggccctccccgcgcgcgcgaggccccagatggcgagggcgcagctccctggctcacctgaccacgttggggtgctcgaaggtctccaggtgcctcagcaccgccacctcgcggatggtggagagcggcatgccctcctcgccggtctgcacccgcacgcgcttcaacgccacgaaacggcctccgttcttcaagtcgcgggccttgaacaccttcccataggcgccctccccgatctccgccacgcattcgtactgctggtcagcgcggcacaggccgtccttctccatgccgcctggacgccgcccgccgcggcgccgctggggcgggcggggggtgcgctcaactagctggcggccgccgctcgcctactccggggctccccggagatcggtctagctttacttgctccccgccggctcaggcgctcgggcgctggggctttcgccgctgcagaagctggatggagagacctccccgcggggctggcgtaaccctggtgccgccgccgcgaaactccgcctgcagagtcgccgccgccgccgccgccggaggagcgagccgatccctcctcttccctcctcgaagcgaagtcctcaacacagacacgattacatagcctctgcccaagcgcgtctcagtccagaatcattgcacctaaaggaggagacgggaggataagaagaaagtgcaatcagacagcccagaagccttcctcggggttcctccagactcccctcctcctcctttacgaagcctccatcgctaccctccgcgcgctcctgccctctcccaagccgcttaatccttcctggttcctccgagaaaagcgaagttacttttctttccctgcagggctgaagccgtcttcgcgcggagaggttgcaggggcccctcggggatgagcgagcggcgcgggacgcagtggaacgggagggggcgtgccgagcagcccagagtgtgccgggagcgcgggggaggggaggcgccgggcacgtcaatgtcacggcttaatatttatccctatatcattgtgttgcgccgctaccctccccgcctcctgaggcccggacgtgcagggagacggggtccaggggtgccggagggcgttcaggggtcgcgcacaagctggagcggaaggactgtgggtccatccgtgtggggccgcagaatgtgggtgggggctcccaggaccctgtaacccgatgctgggagtgtgcgagaaggggtggtcagacatctgctcagaaattgcttcctttctttctactttcagtttttctacgaggagacatttaaaaacgactcgcatacacaaatggtctttttggggtaaaggagtctcggttggaaacggaattctctctccggctgggaggacctccctggtggaaaccttgggaagaccagccatctggtcggggagggttggggcttatcgggggtgggcgagcgagcggtcctgggggaggggagacaccgtcccccacgggatcccaagggtgggagaaaggggtgttcgccacaatttcgcttgtcgtctccttaaagaataacttcaggaaggggatagcataatcgcgcctcgtccttaagttttaaactgatttcgacctgagcaaaactcaacctccctttcaaagggtggggggtggggggttaaatcctgcgcctccaggggtgagagagaaggtctctgtcctcggggcccggactcgcgaaccttttcccattcccaggacctccccgctgtaggtagcagaggtggctgccccattccccctccggctaaaggcccggtccagtctgcagccggacgcccccggagccctctgcacaacaaagcgccagagtagggtaccctaactttccctccccattcagcagctatctgggacctagggggcctccctcctccagggccgccgcggcctcggcaggactttcaccacgacggccgcatgtccggaattcccggggcacctcggaattacctgcctcgcaaccgctggcccgctcgccttttgccaggaattaaacaaacggcgcgacccccacgatgagcgggtggagcggaccgcggcgagagcagagcttctggcactcactacattcagaactttccttaaaagccgaggaaagagcccccagggactgcccgggggtctgagccaggtcgagggccacacaggtagccggggagccgccgccggccgcccaacccgcctgtcctgcatccccccaaccccctcccgctcgagtctagccccgggctccgcagcgaaggaagcgtcggggacgtcccacccccgcagggaactgcgcctgctgcccccgccgggccccgcactgccctggctctccccccactcgccccccagacggtcggcttcggcggagagaaacgggagcagcaatgccttttccccccctctcctccacttttttttgttgttgttgttgctttcccacgctggctgaatgtgacttgaccccatttcaaaaaaagtttgacatagtgcttcaacatttccgcattcctccgcgactacaaaggctgcagccgcctccttctgctttctgtctctgctctctgtcttcacactcaatgaaatccttcatgcgcctctcccgaagcctgccaagcaccacaagggtcgccaccagcacagcgacaagaggccacaccggggaccgcgactcccgcgtgtgcgcacacgcagatgcgcccatatgcacacggacgggcgcgctgcggggaccagggctgctcactgcggggcgtgtgtttaactccaatattttaaattataaaagtaaacttggaaactacagcaaacgtgcgtcttcgcggggctccaagcctgggcactggccggctgcgtgcacttttctgtgtataacacgcccgcaggaagcctgcgttaacatttatctcgtggaggggaaggtggagcccacacccacacctcagcgagctggagagggagttttcgagggggaaatgcaagcacattctccagcatggagtccctagaggcagtgcattttaaaccctaaatgtgaattattatgtgagtgtccgagtagagttccagttccgtttggagaaactgtatgaggcgtgttccgtgtgggtgtgtgtgcgtacggatacgtggaagcaggatctcggtgtcgcgggtgtccctaggctgggatctccccctctcatcagataaggagaatcctctagctccccaaaactggcccccataaccaatcccgtctcagttcgtaaggggttaaccaaagccgattccaaggaaacacaggtcccccccaccccccgccaccctccacttaccccacccacagttctgcctcggaccccggccaatcccccagatctcccccgggaccccccaccccgcagcccacccacccgagcgcacagctcctcacctgaggggcccagtcgcgtcgggcctcccgagggggctgcgagtgtcagtcggctctccgcacgtgtccgcggcctcgcggagcaggtaatcagactctggggaaggagttaccagcactctctccggcgagggggtgggcacagcggcggagggcggagggacggcggagggcgccgcccgcgccgctcgctgggggcggacgggggccgctgggctccggccggcgctgggggccccagccggggaggcagctggggcgaccgtgcggggtgggggcagggacccgcgaagccaactctgccggagacccaccccccggcggggctgggggctcgtggcgcagtggcaagaaagtgtgcaaattaaagccttccggagagaaatgaggcggccgagtcccggcagtgctccgagctccgggctccctagctcccttctacgagtcgggggctagaagggcgcggtgggggtgggggtgggggggagagttaaatgaaaatttccggctttcgctgaaactgtagtagggggatcctgcgactaaaataagcggcattagtgggagagagtgggacgtgtcgtcgggagtcggcggagtttccaaacccagggtcgcccagagttggggttttgacagggtgaagcggggggcatcctcactgtgtgacgtggacggatgggaaaaacacaaaacaaccaacaataattatgagcggccaatgggggtggtaaataccaatactttccaagaaactgaaaaatcagaccaaaaaataactcttctcttaaaaaaataaagaaaaagtttggcaggatgccttgcagaaaagaaaatactaatctatccaagcacttttcactttcagcatgagctacatttgttttgttttccttcgcttcctttctgcctcacaaagccctatcttttccttttagacagaggatatggtttggaaattgtcaggcactcttatggttaacgatctacttgaaggggctggcgggctcacaattattaagtggttagtaactgctgagggttcactaacgtatttcagaggagctaaaaagactaaaatttagtgtaaataatagaactgcagatagtagatacatacacaaaaagaggagtgctcagtttaaatgcattattggaaatctgaaatttgaaaccttgtaagaatgtatactttacctgctgagaaacccttgaatacaattatttcaggtgaaaattagattttggagaaaaaaaagtctttaaaactttctacaatggagtaaaagaaaacttgaaatagctgtctttttggaaagaatttggtgttctccccaaaatctctatctgtagaatacttgaaaccctttaaaacatcttaaagcaaaacttttcacaaaattatttacttaagtgctttgtagaaaaattaaaacctggcaaaattctgtttgaattggaaatactacttctataaatcttttgactttaaaaccatgttactaatctcacagtaaatcaaatttttgcctttataaaactgattctatgttatagtgtgaggtaaggctagggaaataaaaattgatgcattttcagtagcacatattttgcaatgcattataatacttttttctttaaaaataaaagtgaataattgtatgtctttaagcttaagataattcataaaatacatttgtgttaagagcatgtcttctaaaataagatccagttttctgaacaaaatttgtatttataaagctatctataatctcatataccttataaatttaagaaggcaaatcattagattttatatttacataaaaatattggatcactacaagtcactaattagactttaagccagagacacaagtgggaatcctccattttgataattgttcacacttatcatttgccttttaaaacaagatttacttgctggtaattaacatgtttatataatccagaaataattgccagcaaataggaagcagcacatcatggctagaatttatttgaataaatcatttattaaaaaaatagtaagctacaaatattaaattaacagagaagtgtcttttctacactgggttgaatttttagttactgaatttgacaacaaccattgctagatcagaaattccatgatttaggttactagatcatttggacaatgtaaaaaacaatgaaactttatttaattatatatgttagtactgagtgttaactctctgtcctcttcttttcctgatactgctatcttttatgttaatttatcattgttcactcttcctgcttatggttcacattaagtcccagttggtgaaagcttcagacccaaggcagttttacaattgattgtataaaattagtaaataccagattatttttgtttatggataacttctgctgtgggtaacaggttatcataagaaaatatgttcaaactttttaaactgtgaaccaaattccaacttctttgtttaggagtcttctgagaattaatatatagaactcaagaataatgactccaaccagtattttcacactacataccagatattctaaagttgcaaatcatcttacaggtatttaaaaattacatttcatggacttatttccaaatatggtggtgtaacttacactgaaagacttcttaatgtcacacaaggaatgtatttcatgtgtgaacatttatatatcaaatacctgtacaattttgttttcactaaaataaacataaaattttaaattttggtctataatttttaacttgttaaggaaatgtgtaatttagttacaaataataattatataatgtacacctaaatctaattcatttctgatttatattggctatttgagtttataaaatatattttccagaaactcagaaatgagattttgctataatgtactacacaattattttaaaatacacttctagtttaaccttgaaacaagttaccctactttttaacctgatttatgtgtttgtgtacatgttatctttattgagtaataatcatgagaaactataattttaacagaaatagcataatataaatgcagtacattttaatgcattcttctttcccttctcagacatttccaagatattttcttgggttttcccctgaactatattaccgaaagtttgctaaatagcttaggaaaagtcaattgtattatcaactttttgcattgtaaaattctgagctttaaatgatttttaaagttcagtcttctaaataaattctttctgtcaatttggaaatgacctgggtttttctgtttttactgttgcatgtgatctattgcactgcatttgagcagtgaaacttgaaatgattttgatatctgccatgagggaaaaaatagatataaagtagtagcttataacatttaaggaggaaaaaacaaacattactgtcttttggaacatgctgcttccattggttctactactctataattttctttgtgcaacatgtcagtactatgttcatatttgtataattgccatcatcttttttaatttttcccttttgatagacacccatatcttctttttcctttgtgtgtgtgtgtgtgtgaatacctgtatgttcttggcatattgttatgacatgtttgaaacatgttcttaagattctttcatcatctatattagaattctgagtaatcagaaaaataactatggaaatatacttacaaaagatggtgataatcacgttaaaatacctatattttctttctatttacagtgacctgtaattttcactggtttctaacatttcttttctgagataatacttgcatctcagctgcacacatggcctaaaaattgtgttaccatagctggttttggttgagctaaaaggtgtttacatgctttagatagaccattcagttgcagcagtggaggtataacacagtgggagtgaacgatgataaagtgggatctcagaggtaggaggagggacaaagaaggcacccggggagaaacttctatgaatggcctggcatcagggacaagtgaaggaagcacatgctgaggtcgtggggctgagagatgcagcctcagtgcttataggtatggcgtagccaggcaacccgattctttcaggatgaatggccttctgtgtctatcctattatgcaattaaatctgtcttattaaatgaggttgtatactgtatgactccatattcacatgtaaatctattttatgttgtcttattctggatttttcccgaaaataacatagaatggaattctttgcagaattctttgaatgcctagaagaaaatatatcatagcatatttctgtggatcaaacattttccataaattgaagcgatagtttgatttctaaaccttgttataaatttgttcaaaattactcatatctttgcatccccggtacctagcacagtaactggcaagcattttatgtccaataattgtatgtcaacagaaaagttgactttgcatcctttagaccctcttctttggaactgcttaataaagtttaaggatctacgtgctgatttcaggacctcagaaatgtgttttctctacctacagctcttttccttgttagccctcttctctaagtcctatcatccttgcacgctcagctcttccataaaacctttgagattccctcagctggaagacatccccctttgctctaactccttgaggcaatttgctttctaccttactaagccaccctgagtcctccccagagcatccagcatgcttatccctttagcaatcctccaactccttgttgtgtcctctggccctagtaagtggtcaataaatgcagtaatagttcttgtccccttctaggagtgttactgagtcaagcggccacagaacagactggtacaccgtgacataactagaataacatttgaaagttgaggaccagtgttccatgttgcttaaacaggaaagagccaggtcatcctgctacttggggtaaatttggtgtgttttttcttgtgttgccgatattagtcatttgaaacatttttgtctgaaagaaaatgtgtttaggtacatttctacatttgtttgaaagacaaattcctgaaatcttggctgaaagaaagtgtgtttagataaatgtctctgtttcctcaaaattccaattaaataaattttattttaaaagagcaagtaccagactttgaggtaaactagatactatatagcccagagtttggaaagattgctaattttatttgccaatatccttaatatctatgtgactgtgtcctaaaagataaaatccttgatttctaagtcagaagacttgtgttttcattcccagttcttcctctctcggtacttactattcattgcatcttcggtgaccagtcatttaattcttctgaccttcagtgtctatgcctattaaacgggttttctaatcattcagaaagatattataaaatagtctggagagagacaacaaataattttatcttcacaagagaagatatggagatataatggaggttgctgttctgggtattgaaagacctgaaatttaaactggagttggccacagactacctgtatgaccttgggcaacacactaaacccctgggctttaaggtcctcatcaataaatgagatgattggactggatgatttctgtagctgctgcagcttgaaaatgctgtagttctgagcagcgtgatatgccaggtgccatcattatagatctgtttttataaaccccctaaacaagagtaatatcagaggatatgactctgatgtctgcaacctagagaggtttctggatttcaaatgtgaattatattgagttatctctaacttaaccctgtaggtttttaagactgaatagaaatgacgacttctagaaaaacattagggaaattcactagtgttttcattagagatggggaaggagcagctaggcttgattatttggccaaagctaaaagtgataaattaatcagccctcattaacaaaaatgtgataaataaattacaatagtatacatagaaccaggatatccaagattagaaatcttgggttatcacagaaattcttcaaaggtgtcatgaagcttatttgtaaactattaaaaacatcagtgccagttggactccagtgagaaagtgggaaggtgggggtgggagggtcaaaggcaatatactgtgaatttgagaggttccagcatatttctggagctattgattaaaagccgttattaaaacgtgagtagaggaacagctgttctctctgcgttcttattttccactgcatcagaccatgtgcattgtttgaaggtcctctctagatgttcagggaagggaaatataggtaggtaggacgagatagtcatggattgaaagtctggctttattgtgtaaccttgggctaggttcttaagctttcagatcaccaatttcccttatcaataaagtagggatactataatctgccacattaggctggtgtgagaattaaataagtgcttgctatatgcattttggatttaatggccatttaataaatatttgtgtacagtcaatatccctttcacaaaatcatattttcctttttttttctctttcgggggataactaatcctttaatggacatgtctttcttcttaactggaatgaaacatccactcattgcaggaaaagcaacccaagaaacaacatacccaagattatcttgggccttgacaaaaaccacagctgactctaggtatgtgaggaatggaggagagggtggattttctcattggagacctctccttcttgttcagatcttatcccagtactgctgaatctccttagtctgttccttgctgtttttcttacccttttcgttccatgtagttctgtttttccttttcttactgctttggtgtggcccaaggaccaccccattatgtcccttaaatctataccccatatatttgctggcatttgtctttaaaaccccataatttgctgcctaactgcaaaaggtccctcattggttactcttccatagtcactatgtcccctcccatttctgttgaagtgctgagtgtccccctgtttgtcgctgatatggtttggctctgtgtccccacccaaatcttaaattgtaatccccatgtgtcaagggagggaggtgattgggtcttgggggtggtttcccccatgctgttcttgtgacagtgagttctcatgagctttgatggttttataaggcaattttccccgctcttgcttgctctctctcctgctgccttgcgaagaaggtgcctctttccccttccgccgtaattgtaagtttcctgaggcctccccagccatgcagaactgtgagccaattaaattcctttgtttataaactgtccagtcttgggt

SEQ ID NO: 500 - DNA, 38339 bp, Homo sapiens
tggctcatgcctgtaatcccagcactttaagaggccgaggtgggcagatcacaaggtcaagagatccagacatcctggccaacatggtgaaaccccgtctctaccaaaaatacaaaaattagccggtcgtggtggtgcacgcctatagtcccagcaactcgggaggatgaggcaggagaatcgcttgaacccaggaggcggaggttgcagtgagccgagattgcgccactgcactccagcctggcgacaagagaatgactccgtctcaaaaaaaaaagaaaaagagaaaaatcaaccccaagttttctcaaagatgtgaaaaggagggaacccttcctaactgattctatgaggccagaattgtccttacactaaagtcaggcaaagatactacaagaaagaaaactacagaccaatatcccttataaattttgctgcaaaaatcttcaacaaaataataacaaactgaaactaacatttacagatttttattatttatttatttatttattaaagacagtcttgctctgtcagcacgctggagtgcagtggtgtgatcatagctcactgcagccttgaactcctgggctcaagttatccccttccctcagcctcccaagtcactgggactttagctgcctgtcaccacgcccagctaatttcttgtttttttttgtagaaatggggtcttgctatgttgcccaggctagtctcaaactcttcggctcaagcaatcctcctgcttcggcctcccaaagggctgagatgataggtgtgagccaccatgcctggttctgaatcaaacatttaaaaaagtattatacaccggtcgggtgcagtggctcacgcctataatcccagcactttgggaggctgaggcaggtggatcacctgaagtcaggagtttgagaccagcctggccaacatggcaaaactccatctctactaaaaatacaaaaattaggctgggcacggtggctcacacctgtaatcccagcactttgagaggccgaggctggtggatcacctgaggtcaggagttcgagaccagcctgaccaacatggagaaaccccatctctactaaaaatacaaaattagccgggcccggtgggcatgcacctgtgatcccagctacttgggagactgaggcaggagaatcacttgaacccacgaggcggaggttgtggtgagccgtgatcgcaccattgcactccagcctgggcaacaggagtgaaactccatctcaaaaaaaaaaaaaaaaaaagagccagacgtggtggctcacacctgtaatcctagcactttgggaggccgaggcgggcggatcacgaggtcaggagatggataccatcctggctaacacggtgaaactccatctctactaaaaaatagaaaaagtagccgggcgtggtggtgggcaccttagtcccagctactcgggaggctgaggcaggagaacagcctgaacctgggaggcggagcttgcagtgagccaagatcgcaccactgcactccagcctgggcgacagagcaagactctatctcagaaaaaaaaaaaaaaaaaaattagccgtgcttggtggcagttgcctataatgccagctactgaggaggctgaggcaggagaatcacttgaacctgggacggggaggttgcagtgaactgagattgtgccactgcactccagcctgggcaaaaagagtcgagactccatctcaaaaaaaaaaaaaaaaaacggattatacaccataatcaagcgggatttatcgctggaatgctgacatggttcaacatatgaaaatcaaagtaatacagcacattaacagaatgaaggacagaaaccacataatcctcatctctttttgtttgtttgtttttgtttctgggacagcgtttcactttgttgcccaggctggagtgcagaggcttgatcatagctcactgcagcctccacctcctgggctcaggcaagcctcgtccttcagtctccccaggagttgggactataggtgtgccaccatgcctggctatttttttttttttttagtatagacaaggtctccttgttgcccatactgatctcaactgatgcagaaaaagcatttgacaaaattcaatactgtctcatgataaaaatgctcaacaaactaggaatagaaggaaactagatagacataatgaaaaacatatttgaaaaatgaaaaccaacataaggatgaaagactaaaagatttttgtctaagattaggatcaagacatggatgcctgctttcaccacttctattcaagatagtactagaagtcttagagcagttatgccagaaagagaaatatgctcattcaaatttgaaaggaagacataaaattatctctatttgcagctgccatgatcttatacatagaaaaccctaaagatttcacaaacatttattagaatgaataaacaaatttggaaaagttgcagaaaaaatcaatacacagaaatcagttccttttctattcaccaacaataaacaatctgaaaagaaaattaagaaagcaattccatttacaatggcatgataaaaatacttaggaatagacttcaccaacaaggcaaataacttgtacactgaaaactacaaaatgttcctgaaagaaattaaagaaaacatcaataaatggaaggacagtctgtgttcatggattggaagacttaagatgccaacactactcaaagcaatctacagattcaatgtgatcacgatccagataccaatgatgtatttttgcagaaatagaaagatccatcctaaaatgtatatggaatctcaagaactctaaacagccaaaacaaccttgaaaaagaagaacaaagctggaggattcatacttcctcttttcaaaacttaactaaagctataagaatcaaagtagtgtgctactggcagaaagacagacatatagaccaatggaatagtataaagtgcccaaaattaaaccctcacaaatacggtcaaatgatttttgacacagatctcataaccacttgtgttaggccatttttgcattgctatatgggtaatttataaagaaaggtttaattagctcatagttctgcaggctgtacaagcataatgctggcatctgcttggcttctgtgaagccttagggagcttttagcttttattcatgggggggaaggtgaagtgagagcaggcacattatttggtgagagtgggagcaagagagaaaggagagagatgctgtaacctttgaaatgactagatcttgcacgaactaactgagcaagaactcacttatcaccatgggatggtgctaaaccatttgtattagtctgttctcatgctgctaataaagacatacccaagatgggataatttataaagtaaagaggtttaattgactcacagttccacatggctgaggagaccttgcaatcatggcagaaggcaaaggagaagcaaaggcacattttatatggcagcaggcaaggagaagtgcagagcaaagagggggaaaagccctttataaaccatcagatctcatgagaacttactcatcatcatgagaacagcatgagggtaaccacccccatgattaaactacctctcattacaaatcaagatgagatttgggtggggacacagctaaaccatgtcattccaccgctggcccctcccaaatttcatgtcctcacatttcaaaacacataatcatgccgtggcaacagtcttaactcatttcagcactaaatcagaagtccaagtccaaagtctcatctgagacaagttaagttccttccacctatgagtctgtaaaattaaaagctaactagttacttcctagatacaagggggtataggcattcagtaaatacacccattccaaatgggagacattggccaaaacaaaggggccacaggccccatgcaagtccgaaatccagtagggctgtcattaaaccttaaagtttcaaaattatctcctttgacttgatgtctcacatccacgtcatgctggtgcaagaggtgggctcccaaggccttgggcagctctgcccctgtggctttgcagggtacacccccttgtcctggctgttttcacaagctggtgttgagtgtctgtggcttttccagttgcatagtgcaagctgttggtggatctaccattctggggtctgaaggatggtggctctcttctcatagattcactatgcagcaccccagtggggattctgtatgggagctctgaccccacatttcccttctgcactgccctagcagaggttctccatgaggactccaccctgcaacacacttctgcctggacatccaggcatttccatacatcctctgaaatctaggcagaggtttccaaacctcaattcttgtcttctgcacacctgcaggaccaacaccatgtggaagctggcaaggattggggctttcaccctctgaagccatgacccatgctgtacattggccccctttagtcatggctggagtggctgggttgcagggcaccaagtcctaaggctgcaaactgcagggggaccctgggcctggcccaggaaaccaatttttcctcctaggcctccaggtctgtgatgggagaggctgccatgaagacctctgatatgccctgcagacatgaagacattttccccatggtcttggtgattaacatttggctcctcattacttatgcaacttcctgcagccagcttgaatttctcctcagaaaatgagattttcttttctattgaaatgtcagtctgcaaatttcccaaacttttatgctctgcttccttttgaatgctttgccatttagaaatttcttcctccagataccctaaatcatgactctcaagttcaaagttccacaaatctctagggcaggggcaaaatgacgccagtctctttgcatagcaagagtgacctttactccagttccatcaagtttctcacctccatctgagaccaccttagcctggatgtcattgtccatatatcactatcagctttttggtcaaagttattcaacaagtgcctaggaagttccaaacttacccacatcttcctgtcttcttctgagccctccaaactgtttcaacctatgcctgttacccacttctgaagtcgcttccacatttttgggtatcctttgtgaaaggaaaatatcttgggcccccaaaatcactaagctaaagtgaaaattcaagctgggaactgcttaaggcaaaacctgactcccattctattcaaagttatccctctgctcactgtgataaatgcatatctgattgtctcctttggaaaggctaatcagaaactcagaataatgcaaccgtttatctctcacctatctgtgacctggaagccctctgtgatgattaatactgcctgtccacttgattggatcgagggatgcaaagtattcatcctgggggtgtctgtgtgggtgttgccaaaagagattaacatttgagtcggtgggctggggaaggcagatccacccttaatctggtgggcacaatctaatcagcttccagtgaatataaagcaggcagaaaaacatgaacaggagagatgggcctagcctcccaacctacatctttctcctgtgctggctgcttcctgcccttgaacatgaacgtctgactccaagttcttcagttttgggactcggactgacactccttgctcctcagcttgcatacagcctattgtgggacttatgatcgtgcaagttaatacttaagagactcctctttatatatatcctgttagttctatccctgtaagataaccctgactaatacatcccttttccgcttttagttttcctgcctttgcttcaagttgtcctacctttccagaccaaaccaatgtacttcttacatatattgattgatatctcatgtctccctaaaatgtgtaaaacaaagctgtgccctgacctccttgggcacatgtcctcaggccttcctgagtctgtgtcatgagcacacgtcttcagcttggcaaaataaacctttttttttttttttttgagatggagtcttgctctgttgcccaggctggagtgcagtgatgtgatctccgctcactgcaagctctgcctcccaggttcacgccattctcctgcctcagcctcccgagtagctgggactacaggcacctgccaccatgcccggctaattttttgtatttttagtagagacgtggtttcaccgtcttagccaggatggtctcgatctcctgacctggtgatctgcccaccttggcctcccaaagtgctgggattacaggcgtgagccaccgcgcccggccagcaaaataaactttctaaattaactgagacccgtctcagatattctgggcccatatttaataaccataaagggattctgagtggaatgctccccacctctgacaaatctagcctctgacaagctagatttgacaagcacctattggtgcttggtaccagcatgagcttactttatggctcaaacctatgggacaatttgctgaggtctgagagcaacccacccctcacccctccgccccaccaagagaattactatcttcccaaatttggttgaaatctaaagtttattttgctatacaactttttttttttggagttttacttgcttccaacaagaaaggcaagttttcctgcttccatgatgatggaagataggtaactcctttatggagtttgagctcacttccaacagggaaggtgagtttgttgttgttgttgttgttgttgttgttgttttgtttgtttttctgcttctaggatggtagagagtggtctacagcctgagatccattcctagataagcaactgaattggggtttatcttggctaaagttaagattaaaaaccagctggtctttatttctccttaccattacagtgctcaggaattatgttaagttgtgagattgtttgttttgcttaacttttttgttgttgttgatgtttatttgtttctgtttttgttgtttcagtctttctcccgttgggtttgaccaactctgtccaactcaatcaaatccgaaggaaagttccaaattatgaggaacaaggcctctaaagtggctaaattcccatacacaaaaaaaggtggtatagtgaggggagaaaaacggccaacaaaagaaaaaaaataaataaaaacttttttttttttttttgagacggagtcgctctctgtcgcccgggctggagtgcagtggcgcgatctcggctcactgcaagctctgcctcccgggttcacgccattctcctgcctcagcctcccgagtagctgggactaaggcacccgccactacgcctggctaatttttttgtattttttggtagagacggggtttcaccgtgttagccaggatggtctggatctcctgacctggtgatctgcctgcctcggcctcccaaagtgctgggattactggcttgagccaccgcacccggccggcaagaaaaatgttttatttttattacttaaggggttttatttacataacaaagcctcctttttgctaaccaggccaaactgaaagcaatggctgtccccctactctgcagttcaatagctaaggttctgcctttttttttctcctgtcttcatgacagcctaagtttggttcctaaatcaagtcctttctggtttgatagttggtacttctgctttttttttttttttttttttttttttgagacagagttccgttcttgttgcccaggctggagtccaatggcgtggtctcagctcaccgtaacctccgcctcccgggttcaagcaattctcctgcctcagcctcccgagtagctgggattataggcatgtgccttttgaatttcttagtagagatggggtttctccatgttggtcaagctggtctcgaactcctgagctcaggtgatccaccagcgtcggcctcccaaagtgctgggattacaggtgtgagccaccgcgccggaccaatacttggtacttctgaaatagcagcaatttgtcctagctgaaatataataataaaattttgaattttttttttttgagacagagtcttgctctgtcgccaggctggagtgcagtggcacgatcttggctcactgcaaactctgcctcccgggttcaagcgattctcctgcctcagcctcctgagtagctgggactacaggcgcgtgccaccacactcggctaatttttgtatttttagtggagacggggtttcaccatgttagccaggatggtctccatctcctgacctcatgatccgcccgcctgggcctcccaaagtcctgggattacaggcatgagccactgcacccagcccaagattttttatttttaaagacactcaatagttaaaagtcaacttaattaaaagctaatatttaaaatgtatgtgtatgtgtatgtgtgcataagtgcatgttcatatttaaaaggccttcatggttttgtttttgtttttctctgctaggaccttgtctttttttgagcaaaaactttttttgttctcaattgactcaattctgtttccactcgatttttttttttttttttactaaaatagttattgcaacagaggctactcttgggtttttaagaaagagtatagtttagacacttagaaatgctttgtttacaaaaatgttttaagtgcactgtaaaagcatcatgtggtctagcctcataataattctccctttttggagacccaggattcagtgtgggctctgcccagagctcagagatccagttaaaaaagaattggtagtccctatctaaataacagtggtctccttatacaatccagtgataaatttctataattttatgttcaattggcaattaaatctgttttaatttccctctagctcacagaatttctcttcagaccttataatgtaaattttgctatctgactttcacctgagttgtttcctttaatatgcaaatttaagactatttagctgactactgcctagcactgtgaaacaggttatcaagaatctgaaagtctaagataaagaaaaaaggtttttatgaatctgtaagatgtacttcttctatcagcatgcctaatacatctatgtatttatatgttatgtatacaatgttgcactcctgaaaatatatcaaagagctctaattaattgtcttaaaaaataaaagcatttacatcaaatactttattagaaaaaggaaagactagtcaaatgctttttcaagttatgtgacttaagtaaaatctttaataaataagctatctttaaaattattggtaaagtaatattagaaatgtcttaggaattgccagcatacatttttatttgcgtttattaatcaagcaatttcatacttaaccctgccaaatactattaggtgtcaaaatttggcacaggctataaacccagcccaagacagaatgatctctgctcgtgtaaccattaataaataagacattgatactggtttaatgaaaatagctacatcttgatttagtaaaattaccataacttctaatcttgtggcagtctaggcagtctagtccacaggcagtaaggagttttgttttgggaaaggactgttatactttgtttcaaagttaaactataagtaaacttgcatgggaagagaatgtttaattttgtgaaaaacgaccaaactgtcttccaaagtagctcttagagacaacctgtccacagaagaacgcagcaagccccctcccctaaatgccctgcagcttatttcttctgagatgctgcccctacttcacgttaccagaacttaggtacagctgtatccacccccaggccaaaccacatcctggtactctaagccaggtggggcaagaagtgacaaacaactgcaggatgtagactaacctcagaaagcccctaggccctcaaagccctatataagtccctcaccttaaacaccctgggctgcctcctctgactgttatgcagcaggccggcaggtcaataaacttgcttgcctgactttgagtatactcgtcttttctcttggccaaccttacggtagctgtaccagtttgcatttccaccagcaatgaatgagagttcctgttgctctgcatcctcaccagcatttggtgtggtcagtattttggattttcaccattctaataggtgtgtagtagtatgctattcttgtctaatttgctgttccccaatgacatatgatgttgggcatattatcatatacttatttgccgttggtagatcttctttggtgagaggtctgctcagatcttttatccatgttttaactgggttattctttttcttttttttttgagtcttaagagttcctcgtgtgttttggataacagtcctttatcagagatgtcttttgcaaatagtttctaccagtctgtggcttatcttcacattctcttcacagtgtctttcagaaagcaaataataataataataataattacgtctaatttatcaattatttctttcatggattatgctttttgtgttgtatctaaaaagtaatcatgatgcccaaggtcatctagatgttttgtcttctaggagttttattgttttgtgtttttacatttaagtccatgatccatttgagctggcttttgtgaatggtgtaagatctgtacctggatttgtttttgtttttgcatgtaggtgtacagttgttccagtgctcattgttgaaaagactctttgaaccattgtattgcctttcttttttcgaaaggtcagttgactgtatttacatgtgcctatttctgggattcctattctgttccatttatctatttgtttattctttaactaataccacactatcttgattactgttgatttatagtaattcttgaagttgggttgtatccgtcctctgacttatttgttcaatattgtgttggctcttctgggtcttttgcctttccacataaactttagaattagtttgttgatatccacaaaataactagccatgattttcactgggatttcactggatctacagatcaatttgggaagaattgatatcttgataatattgagttttcctgtccatgaatataaaatgcctctgtatttatttagtccttcatagatttctttcatcagaattttgtagttttccttatgtagaatttgtacataccgtgttagatttatacctaagttttataggggggtgctaatgtaaatggtattgcatttttaatttcatattccacttgatcattataggtatatgggaattgacttttatacattaactttgtatctgcaatcttgttctcattgcctcttagttccaggacatcgatttggcaattctttcataattttctgcatggataattatgtcttctataaagacagaccattttatttcttcctcttcagtctgtacaacttttatttctttttcttggctaactgtgttagctaggatttcccgtacagtgttgactaggaatggtgtgagcagacattcttgtgttattcctgattccactggaaaacgatctaggttttcaccattaattcttatgttggctgtaaggttcctgtttatgttctttatcaagtggaggatgtgtccctctattcctagagtgccgagactttttatcatgagctggtgttggattttgtcaaatgctttttctgcatctagcaatatgatcatatgatttttctttagtctgttggtggattatattaattgatttttgaacattgaactagccttgcctagctgtaataaattccgctttaacctggtgtacaattcttttgatacattgtgggtttcaatttgctaacattctattgatgatttttgcatctatattcacaagatatattgttttgtgttttttctttcttgtaatgtctttgtgtggttttggcgttagggtaatccttgcctcataggatcagttgggaagtattccttttgtttctatcttataaaagagatggcacagaactggtacaacttttttcttaaatatttggtagaacttatcaaatgaaaccatctgggcctaatgctttctgtgtggatgttgttaattattgattcaattaattagatataaacatattcaagtggtctgtttcctcttgtgtgttttggcagagtgtgctttcaagaaatgtgtccatttcgtctaggttatcaaatttgtggacatacagttattcatagtattcctttattatcattttcatgcccatgggatctgcagtaatgtcccttatttcatttctgatattgagtatttgttttttctctttgttagccaggctagaggttaatcaatttcattgaccttttcaaaaaatcagctttaggttttgttgataatcttttgagtttgttttcaatttcattgatttctgctctttttattattttttctcttctgtttaatttgatcttaatttgttcttcttttatagattcccaaggtggaatcttaggttattttagatctttcttcttttctggtttgtgcattcattgatataaatttccctctatacagagattcacggatccatccgggtggtccgggcaccactggcgcccctctgcggctattccccagttccattttctgaagccacaggtcagaagccgctgtacaacgctttgccgaactccagaatcttgaaggagacgtaaggtgcagccacctgccgcgcaggcgcaagcctttctttcggcacaaagaccgtgggaggaggggtcggcgcaagcgctcggtgtctctctgaaaagaacttcatcatactgcctcctggctgacggagcgcagcgcaacgcatgcgccttgaagacttatggaacttatttcacgctcagggcggcggtgacgtgtgaacgagaaggaggtggtcaaggaacggaagccgggagggaacgagggcggaagcggaccagggccaggcttgtgttcgcagccttgccggggctggggttccgatgtggtccccggagcgggaggccgaggccccagccgggggagacccggcgggccttctgccccccgagtgggaggaggacgaggagcgcatgtccttcctgttctccgctttcaagaggagtcgcgaggtgaacagcaccgactgggacagcaagatgggcttctgggcgccgttggtgctgagccacagccgccgccagggggtggtgcgcctgcgtctgcgggacttgcaggaggcctttcagcgcaaggggagcgtcccgctggggctggccacggtgctgcaggacctgctgcggtgaggggcgggctggggccagggccgcgagggcgggcgggggcagctctcggagggccgggccctggtcctgttctctgcacagcgcactgcgcccagcccagtgtctggcccagagaaggcatccagtgtgtgttcagaaggcgaagaaggaaaataaggaggctgggctagggaggcttggagggagaggaagaggggatctgggggaagattggggggcggggatagtccgattagacgagttccagagaagccagcctaacagaggtgacagtaatttgcctggactgggaccccgttatgttgttgtttcctaagggcctccaaatttgaatggcccgtggagcagaaggtctaagagataggattcattaacctagggaaggttagagctaaaaagcgggcattcgtggggaagaggcctgtaggcatcttgccaacaacccctggcacagctcattcgtctggcttgtccttggcacaggctttttggagcagagaggacgtgaaggagaatgagggctttgctgagtatctgagtgcccttaaaaggtctgtaggagatacgtgtgcgacaggtgcagttttggcggtatctgagggtaacattgataactaatacatgtacagtacttcccagcatgcagatactttgcatgcaccatttgacccactcagcggtcttgtggtgaggtgatagaattatcctcagcagacagaagaggaaactgagtttcagagagatcaagtgacttactcagagttacacagctagttaaaggtgataccgggactggatccctggtctttggataagtcatttgcacttcagtgtacttatcattctgagaccagcctagcgtgatacctctctcagtgagggaaggagaaagtcaactctgatgttttttgtttggttggtttttttttttttttagtttgctgctctttctgattaagagatctcccttctctacttttgttcccagtaccttcccattggactggacattgatattgcccaggatggtctcgaactcctgcactcaagcgatcctcccacctcagcctcccaaagtgttaagattacaggcgttgagccactgcacctggccaacgaggctttctgagatggcatacagtggaaaccgttttcgttcatgcctgaagcagggaacaggagaaacagtagttgaagaagtcagtgagggaagggaccagaatgggcctccttactgtattggaagtggatcatcttccacttccaattcagacactttaatacctctatggtggtattaaagtctcttctcctgactgctggtgctccactgaagcttcctggtgcttgcctgggtcctgaagaatttctgaggatgatacttctccacggaggcgacgtggcatagtattagtattaaaagcagtgtcaaaaatcacaattacttttgcaccaacctaatagttaacagcttttgcttgagggccggctggcctaggcctgaatcctggctctgccatttgctaaattatgtggccctgcacaaattttatgctgtctttagcaatcagtttgacgaattctaaaatggtgatgataattgtacctaggtttattgtgaggatttgaagagatattccttatatagccttcagcgtagtgactggcccgcggcaagcatttaataaattgagctgctgttactgttaccagcaccaccaaatagttacatcgtatcctcacccttgccttggaagagcaagaagtccttctctgtacatctttgttttctttcttatgtcttgcactcgacagtgatttattttcattttattgttttgagcaccaattgtaaaaggagatctcaccgaaggcccagaagccgcctgtgtttctgttgccttagtggagcacttgccttttggttccagacctatcatggtgtaaatttggcctctctgcttaccttctgagtccctcagttttctcattcgttaaaatgctcataataccgcctcccatgcagaagtgttgtgacgcttagagctggagtataaacaatgctgcgtgtcgttggcacagcgtaggtgcttaacaaatggtcgtgatgataatgataaaattcctcttttagggtaaagggggagctagagactggaatgggacattgcattaagtgctactacacgcccttctttttcttccctgcagtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggtgggtactcagaagggggtgtctgggtgtcacctggtgtgatcacagcatcctccacgtcccttgtgtgcgttcttgaaaaaagaccgtctctttttttacatggctactgagttgataactgagtttatctgctctcccttgtacttgcactttgtaatattcattagtgggacttgtacatttcaaggggttagcctttgtgtcggaattttcagttaacagtggattattttctagtatctgtagggattaatgttaagcagcagtttaggaaatgctttgccttctgtagtttactgacaagagtttctcaggattcctgaggaccttgtggctttcagcattgccacctctaaactggcccactcagctccactttcctactttgtgaccgtgccctttccccttccagctttctgatggcctgccttctgctgcacatgctcttctccctcgaagaggccactggggccatggtcccgtcctagcctcctggtcagtcagcctcctcccggcctgcctttcccacagccttgatcgcatggctcattgctccactcccttcctcagcaacaccctcagctcctttgcatctcctttggtccacaccaggagactcccagcagatccgtagccctcgatcagccacatggggtttaccacccctgctggagaaaatcgcctgtcatcagactgcggtccccttcatggtccccagctgtgggaggccctcggagccacaccacagccttatttttctttctctctgtcccctcacacgctcattccatcctgtgtcctctttgctctctgcgggcacttcactgagaaagtagactcagcattcctgagtcggtctacagttttctgtcctcttaccccaagcctgacctcctcagagcccacctcctcctgtgctcagagtgtagtgtccttcctctgcctctcgtctgctctgcgtctaccctgcccctcttgtccctttgtcccatcggctggcctcttgcctggtatgttccatctcactctcagcctgtaaacccaaacccactcaatgcttttccgaacaccgattgtctcttttgtggtacctgggccctgcctagtgactgctgtttccttctcaaccgacctttgtgtcaccacttcctacctcccattcactctgtcatctggtgcagacctgcttcaaccaccccctccacccagactgctgtggatgaggtgataggggcctgtgtgtgtgtgtgtgtgtgtgtgtgtgtgtgtgtgtgtgtgtgttgactgagcacctggtgaccaaaggacactgcagagaatagttatttttgaaattcacagaccaagcctgacctcagggcccttgcatagccctagaggcttcacacagctggagccagcccagaatccccacgcctcaccccgggagaagcacccatttctcctcaccttgagagactccagcccactctgcctcagattgaggaagaggtctccaaaatctgccaatctctccctgtctcccaggattgttgactaagcagcccacattttcttcagggcagcccctctgctccatctgcaccccttccccgcacccatgcagttattcccctgcccagtggcctggtctccagggctcagtcagggtccccgcaaagactgcaggatggtttgggtggttctgggccaagctcaggtcctctctgcggtctttctgtcatctcacattgtcctgcagcctggggcagaggagaggtaaacccatggatccccacagatgaggtttgtactggcaaacaaagaaagcctgctgttgaggtaaattttttttcccaagtccagacagagaaacagccagtaactttttacttttggatggtattgaaaaataaaaaaagcaaaaattgtccattattttgttatttaaaaaaaatacaaagaaatgaaagttttctttctgttcatccaacttttctctctttgggtactctcttcccatttgtgtgagagtgcgtgagtgtgtatgtttacagatttatgtttccttaatggctttgtcaactctagttcttcctgaaaatcttattcacttgtttcttgtctgtctttcctactagaagggaacagtgccatgggccctgggaccctgggagcagtgcctgatacctggtagacagtcaataaatacctgttgagtgagtgaatacacacgcacagacacgtgtacacatcactccatttttttctagaaatggaattggtgtgcaccctgctttgttttctttccattgcattgtatcaggtgcctctttccaggccctacacagtatggatttactcgattctttttgatgcctgcatgataatctatcgatatgccacaatttatgcaacaggtgctccgcagatggacatttcaatcattccaatttctctctccatttttccattacaaaaaaatgccacttgtgcagagatctatgtacttctccctttatttttatggaattgatttttcggaaatgcatatgtgccttttcaattttaacaaaaattgccaaactacttttcaaaagtttgtaataagttgcactttcatcaagactgtattagggagtccagtctccccacatccttgtcagcacgggatgacatcagtcttttaaatcttaccaacttattgggaaaaaaaaaatgatacgtcctgtttgtgaattgagcatttttttcacctatgtactagccatttacatatctccttctgtgaattgtctgtttatatcctttcctgttttgtattgtgttatcttttttttttttttgagatggagtttgtcacccaggctggagtgcagtggcacgatctccgctcactgcaagctccgcctttcgggttcacgccattctcctgcttcagccttccgagcagttgggactacaggtgccgccaccacgcccggctaattttttgtatttttagtagagattgggtttcaccatgttagccaggatggtctcgatctcctgacctcgtgatccacccgccttggcctcccaaagtgctgggattacaggtgtgagccaccgcgcctggccttattgtgttatcttttatgttaatctgtattctttatgtgttagagatagatatatataatgtatttagtattaaggatgtaaatattgtttctcagtctgttgcttgcttactttttatttatgatgtcttttaccctatagaaggtttcatatttctgtagtcagatctctcagacttttctgtatggctattgaatttcaggtcttgtttaggaaggcatcttctgactcaagcttaacttattactttgtactttaattttttccgtttacatttccttcaatacttatttttgtgtatgtggtggggaaagctctattttcttccaaatggatagccagttgtctcagtatcttttcttgatgtcgtgtaacattaatttatttgtgtgtggttactgtgcagttactgcagtggttgcatatctggtagggcagtcaaatcaatgaaaactcgatgtctgtgtcttattaggctcttttctaccctttggcactgttgacgagtcacttcttgaaatgtccaatttccttgaatttgtttacatgacgctgcaagttctccttgattcccccaaagcagtccttctgtctctcttttgtggcttccttcacttcctaaacagtggtcttccttcagcttattactttcctccctgaatgtccttgggatctttgctgtggatatgctgaggactttcaacattgtatcgctgtcctgctgtctcctttgagtttcagatttgtatatccactgataggttgtatacataatcttggatatagctcagacatcttatttatgtatttatttatagacagagtctcactctgttgcccaggctgtagtgcagtggcacaatgttggctcagtgcaacctccgcctcctgggttcaagcaattctcctgcctcagcctctcaagtagctgggatcacaggcgctgccaccatggccagctaattttttgtattttttttagtggagatggggtttcaccctgttggccaggctggtctcaaactcctgatctcaggtgatccacccacctcggcctcataaagtgctgggattagaggcgtgaggcacaccgtgcctggcttctctcagacatcttaaaacatcataaccaagatgggatattttgtctttactttaaactaggcttttcctcctgaattttttcctattaatagcatcacatccaccagtcactcaatccatagtgactttccactagactttttcttccaaccctatatccagttaccagtgttatcttctgaattttgtttgtctccaccactcctctttctatgtttattattcaaatagcctgttgttcagacccacataatctcttgtgtaaatggtctccttgcctctaatcttaactctacaatccatcgtctcccaattggcagttagctttctgttaatctagccatgtcagtttccttcagtgaccacccaccatctacagaataaaggatcatcataagatattacactttctataatataggatattacactttctataatataggagtgcttctcctctctctcctttcccctctacatttgtacacgtgccgcattgacccacccttctatgctcatgttcctctctcttcccgagatacccgtttcacctcttcacctaggaacttgctcactcttcagaattctgctcaactttttttttttttcaagaaatcctgaatccccaggcagtccttccctatattttcatagcatcccatggacacctcagtctttcttgtttctggtagtaatttccatgtatgagcgaaatggtgacattatttcttggaacttatatttcttactcttgtcactaatcttatcccatctgtttattatgtacttttctttgttttttgttttgttttgttctgtttgagacagagttttgctcttgtcgcccaggctggagtgcagtggcgcgatctcggctcactgcaacctccgcctcccaggttcaagtgattctcctgcctcaacctcccaagtagctgggattacaggtgcccgccatcacatccagctattttttttttttgtatttttagtaaagacagggttttgccatgttggccaggctggtctcgaactcctgacctcaggtgatcctgacctcaggtgatcagcctcccagagtgctgggattacaggcatgagctgccacgcctggcccttttcccttaaggctttttacagagtcaataatgtttgtgtttgcagtatagccaattggcaggaaaatggagagactacaattggaagggaattagatgtcatttcatccaccctcttcagagagtgatactgaggactagtgaggctgtgactggcccaaggtcacccaggctaggctggaaatcaggcctcagctctcgttcacagctgttctacctcacctcacctcctcagtcttcccttgggaaaccacaggccagtgagaggcaggagtgtaaaatccccgatgggcgtgcagcgcagagctggctcccagcatctcatgtgcctcatttcatgtggagtcaccaaactttcctccaaggcttaaaaacacagatccttcctcctttttgaaaagccgctactttggggaggatggggttgggattcccgggtgcttgccttgtgtgatcatggttttgaaactcagggtcagggtccctgcatcccatggcagtggccagggcctgtcagccaatgttgcctttcccacaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaaggtatggaggctcatctgttcattcactgactcagcagtgattgattaagtacatagagtagtgagcccttatctcagattttggtttccagagtttcagtaacctgccgtcaaccacggtccaaaaataataagtggaaaattccaaacattaacagttccatagatttcagttgtgcactgttctgagtagtgtgatgggacctcgtagtatcccgcctgtatgcgcatccctgctttgtccagcatctccccgcctgagtcacttaggagtcgtctcagtgatcagattgactgtcacagcattgcagtggttgtgttcaagccacccttattgtactttttttttttttttttgagatggagtcttgctctgtcgcccagcaatggcgcaatctgagctcactgcagcctccgcctcccgggttcaagcgattcttctgcctcagcctcccaagtagctggaattacaggcatgcgccacggcccctggctaatttttgtatttttagtagagaaggggtttcaccagttagccaggctgtcttgaactcctgacctcaagtgatctgcctgcctcggcctcccaaagtgctaggattacaggtgtaaaccaccgtgcctggcctattatacttaataatggccccaaagcacaagagcagtggtgctggcagtccagatttaccaaagagaagcggtcaagtgcttcctttaagtgaaaaggtaaaagttctggaccaaataaggaagaccaaatatcatttgctgagtttgctaggatctacagtaagaatgaatcttctataggaaaaattgtgaagaaggaaaaatgtttacatagctatatgtatagggttcagtattctctgagggttcagacctccacaggggattccattcactggaacatatcccccatggataaggggggcctgctgttctcacatgcccaccaccagcgctcctggttgggaatttctcagcctttgtggtagcagcagtagtaatttctccctgtccctcagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtaacttttaaccctgaactgagcctcctccccactgttgctggcccccagagccagcaaaatgttagtatatgtgggcttttaaaaaataggtgggttttttttttttttagctaattacaaaagtactcactgctcaatgcagaaatcatggaaagcacagaatatcacaaaagagaaaaaaaaatgaggcctctttttttttttttttttttttgagacggagtctcgctctgtcacccgggctggagtgcagtggtgcgatctcggctcactgcaagctccgcctcctgggttcacgccattttcctgcgccagcctcccgagtagctggtactacagccacccgccaccacgcctggcgaattttttatatttctagtagagatggggtttcactgtgttagccaggatggtctgaatctcctgacctcgtgatccgcccgcctctgcctcccaaagtgctgggattacaggcgtgagccaccgtgcccggcctttttttttttttttttcctcaattgagacagggtcttgcactgtcccctaggctggagagcagtgacatgatcttagctcactgcagtctaactcctgagctcaagcaatcttcccgccttagcctcctgagtagctgggaccacaagtgtgcaccaccatgcctggctaatttttaattttttgttgagatggggtctcaccatgttgcccaggctggtctcacactcctcggcgcaaacaagacccccacctcagcctcccaaagtgctgggattactggggtgagccactgtgcccagctgaaaacgtgagtcttaatgcttcccccacagaccatgactgtgaatgttatgtttatgctcttccttgccagtgtccattcaactaatatttattgagccaggcattgtcttagggactggggatacagccgtggacaagacaggtccctgcctttgcagaggtctttctgaggggctcttcccctgcccttccccctgaatgactgtacaaggaatccctaataaagacacaccctctggcaggagaacacagacattgaagtctgtcttccaggtgggaaagtctagccttgttgggaggcagaggatatgtccgaggtcattgttggtgttaacagttccttccctgtctccccaaaacaggaagatgtgtataatgtgccctgtttgcatgttctgtccctgtgggttgaaaaagcttatccttagtcagcctgcttgagcctgccacaacagactgtcaacagacttgccacaagagtttttgccgtcagcatcagttttcttgccactgggtattgggtttagtcttcagatttaaaaccaccttaactgagtgctgctctcagggaccctttgggaccctgccactcccatcctgtggcacagtaatcttatctgtccctttgtttccaggtgtaaagaagaagcccgccgggcatgccgagcaggaaagaagcagctggtgagttcttgtctcctccagacccatagcagtgccccaggcaggcctggagcaatgcccagcagttcagagagcagcttgctggggttttgaggggggtagagtctgcagggggcccaggcaccacagcttattttacagatgggagggaagaaagctgggacatccttagcgtctgggaagggctgtcttcctcttgccctttggctcgcccagttcagcactgacctaagtctccatgcctccaggcactgaggtctctcaaggccaagcaacggacagagaagcgcatcgaggccttgcatgccaagctggacactgttcaaggcatcctggaccggatctatgcctcccagacagatcagatggtagtcactcccctctactccagcacttggctggtctctccgtgtgtgttggtcacttgcagcttcggcttggctgtttggaggatccctgggttctttcgggatgtggctggggttgcctttgcctttccagtcaggaggtttggcctcggtgggtatagggtaaattgagcttgggtgccaaaaaaaacaccccaaagctgccttttggagttgaaacaatattgtatgtattttgccaaatgtctgtcatttgcactgatagctttgctttgtctttaggtttttaacgcctaccaggctggggtaggagcactcaaactctccatgaaggatgtcacagtggagaaggcagagagcctcgtggatcagatccaagaggtacagaaaggggccagggagggacacacagagaaggaggtgacagaggacagatttgacttcattgcacatcctctttaacgaaacctgacttgtgaccttgtgaacttgaggaagctttccttgattctcacttggggcaggattgctttgtaaccctagatattttccaccaaagactgagatgctcagagccaccatgcccagctcaaggctttgcacttgtctcttacagctctgtgacacccaggatgaagtttctcagactctggctggtggggtaacaaatggcttaggtgagtggacaaggtggttatttttatttttattcattttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcctgccactatgcccggctaattttttgtatttttagtagagacggggtcattttttttttttttagatggagtctcactctgtcacctaggctggagtgcagtgacgcattctcggctcgctgcaacctccgcctcctgggttcaagtgattctcctgcctcagcctcctgagtagctgggattataggcgcccgccaccacgcctggctaatttttgtatttttagtagagatggggtttcacctgttggtcaggctggtctggaactcctgacctcgtgatccgccggcctcggcctcccaaagtgctggggttacaggtgtgagccaccacacctggcccaaggtgagtgtttcttcctttcatcctggaagacttcgcttccctgtgctgtgatgagtttgacagtagatttgcttttccgggtgcaggcaggcctctcctagcctgccctccctggggctcatctgcgggagcagtcagggaattgccatttcctcctcgacagctgtgctcatgacccatctgtgctgcggcattcctcattcacaaggcttctgactggaggatcctccttcaagggcagtgggaatcagggtcaggtccatggtgttaacagaatacacctccttggtgacttagcttggagtgtggaagaatcatctctgcttgaagctaccctcctgacttccgggatttttttttaatctgcaaggaggcctggcatcttttgtaaagctaagcgggttttggtaacctcagtcctgtactcattaatgcatttctcccttgagtttatgcatctttatgttgtcttttctttccagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtatggagctgttttccaaggcctttggagggcatatggccttctggctgacagagttgatgggcccaagcccaattactccatttgccagagtaccagagccctgtagggagttgagggttgtttatattaagactcagtctcttaatcactggaatgccttcatcttcaagattttcctgttatagtgttcagtcatttctttgccttgcaggtttggtcccaagcagtaaatctccaaaaaggcaattggaaccgactctaaagccattgtaggaccctcaagtgaaggaccctcatgtaaaagagagaccaggcttgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacacttgtcccgtctcctctttaggttttatcaagcgtcttgttccttggtgcgtccccacgcttccagcttctgcacactttggttctttctcttaaggccacaggagaatatggagagcctgaccgtgtgagctttaagctgcggcagctgctgctccatccaagtggccgctctcactgagctcccctggggaggactcattctttgaatggcctccctggttttagcagtgtgccattgctactgttttccattgcctgggctctgtaagtggcctaatttcttctgcccatgtgattgtatcatattttagtctggcactggtatttctcagcccctcctccagggatggtgtttgccacaccctgtgagggagaggggctttgaggctgagggcagcattaggaataggctaaacaactggccgcagcactaggtctgcagctccaggtaaggcagaggtgaactggccaggaaaaggtggtgacagcagcggctcagaaagccctgggagaatctaaaggacctgatgagaagggcgagggactggagctcacaggccctgcggaagagagggcaaccgctcttccattccttctgctggaaggaagtggcctggacctggtgaaccttgttaatctgatttaaggttactttttctttcactgtcctgagccactgaagaatccttgttaaatgatccagacttactctttgctgtgctacaggaaattaaaaggagctgttgagtctgcttggagcagagaacaagaaggggtaatctacaggactctggtggtggcggctacagctgccagcatggaattcccatagctggacaatcagggctgagtggcctcaggagtcggcgccatggagggattcactcctcttgagagttttcttttttagtgttttttttttttttgagacaggatcttgctctgtcacccaggctggagtgcagtgtgagatcaggggtcactgcagcctcgacctgggatcaagcaattcttcacacctcagcctcccgaggagctggtactatagatgtgccaccacacctggctaattttctttattttagtagagatgaggtctcaaactcctggcctcaagagaccctcccacctaagcctctcagagtgctgggattacaggtgtgagccactgcacctggccaacttctcccttctcttgaatccttgctgcctcacgacaggtgtcagagcggcaccaccacaccgcaaagtgaagagatgatgccgtgcctgggagggtggctggagagtcccccatcactgctagtatgggaacggtgatggtatgcagagaggaggtgtggttagaagggtaagtgggtatttggaggtgaggggaagggtgctacctgggaatctcctgggcctgcctaaaagggttgtgtaaccagagtcctgggaccggggtgggctttgcagtcagacatgctgttgtgagagagacgaaagggttacactgcggttctcactgcctgcctgaagtgacagccgaaggctgagcagacctccgggaagtggtcatgaggatctggctcgatctgctgaaaatataatctaggccatcagaaaagaggagggaagagctggagctgtgaagaaagatgagatcactgagagctgctgagtcccaaagaatcaaaacgaagccctgctctgaggcttgtgggtgagcctggtgaccttcctttcttttgaactgtcttcatgtcttctcatttttacgtagttgtggctactctttggggaaagtgtggctgcttttctctgtctgcacagaagcaatgcaaggttatagactccggaacatgagagccagaaggagccacgagaagggtaggggaaacgtctgttttacagaggaggacccaaatcttaggcagcttgctgaggccacagagctcacaggggaatttagtttgttgacttccagcttggaattctttgtcacacaagtgttggggctcataaaataatgcccaaaatgtggcacttgacgagctgaactaaagcagcagcttcaaggtttctctctggctttcccccgccatcgtgtgtctgtgaccctttcttttcttttcttttttttttttttttgacccttttctaaagcaccaggagcatgctgtctctctgacctttttcttttcttttcaaccctttcttttctaaagcaccaggaggacctctttctctggaagttcccttacctgattaagaacacttctaaaataaatgcagccgtcttaaagccccctccctatgaatctcattaaataaccaggaatgattaatcacccaagaaaagactgaaaaagaagctacagccaggataccatacccagacagacttttcgtcttttcttctgagggaggttccaagagataacctgggagactgtatctgcataataagacaaccttagttcacagtgcagtaccacccctcaccttccatgacttgtccacaagctattgtttgtccttcagtcccattcagcatccaaagagaaccatttgcaaaccactgtcaggtatttgggtccattcatttacagccccccagctccctttccctagtgaagagagtatttaagtgccaaccattgggcctttctgtgtatgttcatattttttatatggcttccctgcttcatgcatgttaataaatttgttatgattttctcttgttaacctgtcttttattataagggtgttggctgtgacccttaataaggtggaagaaagagatcacccctttccactcctgcaccaggctactcctaaccacactctcagaaacacattctcatgaccaggtgcagtggctcacacctgtaatcccagcacttcgggagaccaagatggatggatcacttgagcctaggagttcaagaccagcctgggcaacatagtgagacccaatctctaaaaatggaagaagaaaaaagacactctcaaaagataactccaaaagtactttctgtggtgggcatgtgccctgaccccatgtcagtgctttcagttggcagaccagcttcctttggctgacatttgtgcagtttcacagacttctacagattggaaattacaggctgggtgcggtggctcatgcctgtaaacccagcattttgggaggcagaagcgggcagatcacttgaggtcaggagttccagagtagcctggccaatgtggtgaaactccatctctactaaaaatacaaaaattagccaggcgtggtggcgggcacctgtagtcccagctacttgggaggatgagcaacgagaatcgttgaacccgagaggtggaagttgcagtgagctcacatcgcaccactgcatacctgcctgggcaatagagtgagatcccgtctcaaaaaaaaaaggaaattgcctcccaggagatactgggtagggctgtgcctcagaatctccccatttttagggaaaccaaagaaagtattaagattgttttgttgttgttttgctggtctgcaccctgtagataacgttttcattgtattttgcagcaggctcttcaactgtacagaaaagagctggctactggctgcacagcacttcctgcaggagttggttcacaaaagcagtaaagctgtctttattcacaggtgatacaattgtgtatgtggtaatccaaggaacctatagagaaactacttgaatggaaaatttattttagcatggtcactggatacaagctcaatattttaaatattgagtagtatagttcagtattaaatattgactatttagtatagttctatatactagcaaaattataaaaatttaaaagaaatgatctatgctagcccctaatatattgaattctgagaaaaaagtttaataccctttaccatggcttctcaaccttggtgctactgatattttgagcctataattatttgttatgggaattgtacattttgggatgttcagaagcatccctgcctctaggcacaagactccattagcactgtccatcccctagcataacagccaaaaatgactccagatactgccctgggggacggggaggatgggagcaaaatcacccctagttaaaaaccactgcctacactgaaaactataaaatattatagagaaaaaaaaagttaaagatgtccatccattcttccaaaatttatctatacggtcaatgaaaacccagtcaaaatgccagcagattttgtgcatgtgtgcacgtgtgtgtatgtataaattaaaaagcaactctaggccgggtgtggtggctcacgcctgtaaccccagcactttgggaggccgaggcgggcggatcacttgaggtcaggagtttgagaccagactggccaacatggtgaaaccctgtctctattaaaaatacaaaaaattagctgggcgtggtggcttgtgcctgtaatctcaactactcaggaggctgaggtgggagaatcacttgaaaccggagccggaggttgcagtgagccgagattgtgccactgcactccagacagactgggcgacagagcgagactccgtctcaaaaaaaaaaaaaaagaaaaaagaaaagaaaaagaaaagacattctaaaattacatagaaaggcagagaatgaaaaatagccacagcaatcttgaagaagtgaaataaagctggaggactgctgggcgtggtggttcatacttgtaatcccagcactttaggaggccaaggtggaagaatcagttgagtccaggagttcaagaccagcctgggggaacatagggagatcccgtccctacagaaaataattttttttaaaaatttagccaggcatggtggtgtgcatttgtggtcccagctacttgggaggctgaggtggtagtattgcttgagcctagaaggtcaaggctgcagtgagccatgattgcaccattgtgctccagcctgggcaaaagtgagactgtctcaaaaaaaaaaaaataaaataaaaagctggaggacacacttttctctatgtatgctgtacttcaactttttaaaaagtgaataacactaaaagatgttgaatgaataacttcccaaccactagtgggtataaaagggcaataagaataacagtacaggccgggcgcggtggctcacgcgtgtaatcccagcactttgggaggccgtggcgggcggatcacaagctcaggagatcaagaccatcctggctaacacggtgaaaccccgtgtctactaaaaatacaaaaaaaattagccgggcatggtggcgggtgcctgtagtcccagctactcgggaggctgaggcaggagaatggcatgaacctgggaggcggagcttgcagtgagccgagattgcacaactgcactccagcctgggccaaagagcaagactccgtcttaaaaaaaaaaaaaaaaaaagaataacagtacaaagtacaatagaagacaggaaaaatttgaaacagaagtacagaaactcttgtttaatagaaagtactaaattagacagtaaaagttaataaaaatatgtcagtaatcacaaggagtgtaaatgaattgaacttgcgagataaaagacagatgttggtccgggcgtggtggctcatgcctgtaatcccagcactttgggaggccgaggcgggcggatcatctgaggtcaggagtttgagaccagcctggccaacatagcaaaaccctatcgctactaaagatacaaaaattagctgggaatggtgatgcacatctgtaatcccagctactcgggaggctgaggcaggagaatcacttgaacctggaggcagaggttgcagtgagctgagatcatgccactgcactccagcctgggcaacagagtgagactccatctcaaaataaaataaaatacagatgattttaggtttaaaaaaatacaattaaatcctgagctatttgtaagagatatatttaagttcatacaaagattttaaataggctgggcacagtggctcacgcctgtgatcccagccactttgggaggtcgaggtgtgtggatcacgaggtcaggagatcgagaccatcctggctaacacagtgaaaccccatctctactaaaaatacaaaaaattagccaggtgtggtggcgggcgcctgtggtcccagctactcaggaggctgaggcaggagaatggcatgaacctaggaggcggagcttgcagtgagctgagattgcaccactgcactccagcctgggcgacagagtgagactccgtctcaaaaaaaaaaaaaaataaaaagattttaaatgaaagtatcaaaaaaaggactgtatctgaggtaggaagtgggattggactccagaggcggtgtttgggtactggaccaagttgaggattagctaaaacagggacgaggtggaagcagcttttcatacgacatgtccaccaatgtgccatgtcagtttaccactgccatgcagacacccaaagttaccacctctttccatggcaacaacccaatgacccggaagttacagctctttttctagaaatgtctgcataacctgccccttgatttgcatataattaaaagtgtgtgtaaatgactgcagaactgcctcacctgacctcaaatgatttgctcccctcagcctctcaaagtactgggattacaggcgtgagccactgtgcccagcccagacataattttttaaaaggtgaaaacgcaagcctaaaaccagaaggaaacagtttcaactcataattgacaaagtcctacaaatctaaaagaaatagaaaaccccaaaggggatagggggccagcaaggtgcacgagcaatcgattctcaaaagggaaaaggcaattttcagagtgggaagcgggaagagtggtgaggagggtgccttagtcaggtctggctgccttaacacaatacggaagactggatgcttaactgaaatgcactctttcacagccctggaagctggcaaaccaaggtcaaggtgctggcagggtcgattccttctcaggcctctcgttggcttgtgggtgaccaccttctccctgtgtcttcacgtggtctccctcctgtgccagtctgtgtgctaatgtcctcttgtaaggacagcagtcatactggattaagggtcaccctaatgacctcatgttaacttcattacctctttaaagcccatatctccaaatacagtcacattctgacgtgctgggggttaggacttcagcatatgattttttttttctttgagatggagtctcactctgttgccaggctggagtgcagtggcgcgattttggctcactgcaacctctgcctcccaggttcaagtgatgctcctgcctcagcctcctgagtagctgggactacaggcgtgcaccaccacgcctggctaatttttgaatttttagtagagacggggtttcactgtgttggccaggatggtctcaatctcttgacctcgtgatccgcccgcctctgcctctcaaagtgctgggattacaggcgttgagttaccacacccggccacaccatatgatttttttggggggtggggagacatcagtccataagagaaggtttgcctaagtagagagctataggagtagccagttcccaggtatacactggagccagaacccacaggttcccgaaggcttaaggtagggcgggaagggagaaataaagggtgatggatacactgtgggcttgaaccagtgggtgggctctggtgccatatattgagatggtgagaacctggggaggaataaacttgaaggtcggcctgggatggagcctgaggcattccagctgttagaggttgagtaggagaggaggagccagaaaagaaaaccaaaaggggctggggaggaaaatggaaacccaaacctgtagggtgatggaaactaaaagagaatggccatcattgagttctgctgagaaccaggcagtgggagccctctgttccaggggcaggcacagaaggaggcattgtttgcagatgacagaaaaacaagaagagaacccagtctgcttttcactatcaccgtgtgctgacaattctaaacaatgtgggtgatttattgttctaagttccaaataactactgtggttatctgagcttcagtgggcacattcctatctcttgggctttactaacccttgtacttggaagttcatccagagaactcacaacgatactgggggctgctctcacatactcactttgcaggtaagttcttaacggtttggaatcactagagctcattgtggttgcagcttgtgtcttcaacacttaggataatacgtattcctgtgtttaaacagtagattcaaagtaagccaggacagtgtagtaattgtaaagaccaaagacacagagcatgagttactgtaattatgtcattctctatggccacttggagttttgcttgtgtttaacatttaaaacagtgggccgggcgcggtggctcatgcctgtaatcccagcagtttaggatgctgcggcagatggattacttgagtccaggagttcaaaactgacctaagcaacatagaaagaccccatctctacaaaaattaaaaaattagccaggccaggtggcacacgcctgtggtcccagctactcaggaggctgaggtgggaggatcacttgggcctgggaggttgaggctgcagtgagccatgattgtgccactgcacttcagcctgggcaacagagcaagaccctatctatctcaaataaataaataaataataaaactgtggaaaagaactaaccatgtggtatacttttatttggtaagtgaaaattttagttcatgcatgaaatattttaccaaatttgaatatctttaaatggaaatttattcttttcaaagtgttcattgttgttcagctaaagaacaaatcaagacagtgctgattattacttattactatgtaattattaccaaaaataactctgttgtatggaggaggaagatgtttaaaaatgatcagctcccctggtgtcaaatatgctagttatgccaccaaaatagtcaatattttatcttcaaatataaatacataaaggcaaagcttactatcttctggaggggtatttatccttttatttatttgcttatttattttgagacagggtctcactctgttgcccaggctggagtgcagtggtgcaatcatagctcactgcagcttctacctcctgggtccaagtgatcctcccacctcaacctcctaattagctgggaccacaagcatgtgccacctcacctggctaatctttggtatttttttgtagagataggttcttgctctgttgcccaggcttgtctcaagttcctgagttcaagtgatccacccgcctcagcctcccaaaatgctgggattacaggtgtgagctactgcacctggccttatccttttaattgcagaagttggtgaggaaaataattcagaggttattctggccaacacagagaaattctgggtgagttgaggaaaacgtcatatgaactgtgtcagcgttcatattaaattagctgatggccccatctgtattttcacagaaatgactcgtgtggtgttttagtttattgagtttccttgaatattttctctttttccaaagctataaaaactagtgatttcctaatatttccctctcaaagcagtaaaggggctttaggaaattgaaaggagggaattggaaagttggtctccaagcctctcagcccagcttccaccagaacaaaccccatttaaacattaaagtccaggtgttatgggctaaattgtgacccctcaacattcacatattgcagccctaaccacccgccagtcctcctccactcagaatatgactgtatttggagatcaggtctttaaaatggtgattaggttaaactcaggctattagtgagaggtgacagcgtgctggcagtcctcagagccttcgcttgctctcggcacctcct

SEQ ID NO: 501 - DNA, 130391 bp, Homo sapiens
atgagaaataataaacataaactttaggcattcaccctttctagttggtaagattcgagctgtctttatccctcttacttgtggttgatggataatttcatgacttacagatggaagaaaatagaatctttatatgtgattcttatattgacataaaatgagttatattcttttatacttaaaatattagtgcaagttggacttttattaatagaaattgatgttgctttaaaaattaaatgatctgaagaaattttcttctctaaaattaatttacatgtagttgaatatatccttgagacactttgagtgagtagaaaactgacttcaagggacaaaattattctcatagatgctaaattgaaggcctttgtaaatctggaggttaaaaagtataaatagttgagaatcagcatttgtagaaaacatcagattttggatgttttaatcttgaattatatgcagtattttaagagtttgtgaatatgaaattaaatctcctgctttggtgtgctaataaatggcactgggtgggcattattttagttacttgtgttcagttgaatactaaaccctgttctaaagtgctatgatgatgcaattcagtataatttggcatatgaccttattctgttaaggaaaagaaccccacgatactgtgatggtaaactgctttttaacatagcctttctaagcactaaaaaataagcaagaggagtatttaaaattatgggcctgtgtagattatatgacaaatctaaaagttttgacctttccatcagactccctattcttccgtactttttctaggtctttcccctcggttacctttcctcttaccaacaacttcattctttctgcctccagtctttcgctttcagctttaagacatacataggtcttctcattcttgaaaaatactctttatttggtcctactggttcttctgtgcatttttcctcctttttccatgctaaaattcttaatttctagtaatgtttacctactgctggcattatttaagacatttcatctcattcctgatgcctttagttatccttgtcttctcattattatcttcagtttcctcgtactcttctggtttcttcctgtctctctatatggattcttcacttttgtgggtgaaaggtgagtgggatggtggtgtgaacatggaaagtatatatattggagacacacatacataaaaactgttcctttgtttttttcctgtcttctgtttgcttttctctttttctgttttctttttctgccaaatttctcatgcaagttacttcttttttcttttctttgattttttttttttttttttttttttttttgagatggagtctctctctttcgccaggctggagtgcagtggcgtgatctcggctcactgcaacctctacctcccaggttcaagtgattcccctgcctcagcctcccgagtagctgggactacaggcgcgcaccaccatgcccagctaatttttgtatttttagtagaggtggggtttcaccatgttggccaggatggtctcgatctcttgaccttgtgatccacccacctcaggctcccaaagtgctgggattacaggcgtgagccactgtgtctggccagacttcactgtatctttttctaaaccatccacttgggccataactccctgcattgtcttccattttctccagtattgaacctctaccttcaaaggacaaatcagcttttaagttaaaattaaagttacctttctgtgatatttaacattaactgcctctcttcgatataatgctttcttctttttgatgactttttattattttcctaagggtaggtctttgaccctctgtaatttttcagaaaccttatccacatttatgatttagacttaacacacctatgctgatgactttcatttttgatcaccctctcccttgaattctatctaccttattaggcagttcatagtatatcaagcttttctgtatacataaatctaataaagatattaggctgacccatctgaaattgcaatttttgtaggttaaaaactgttaacatattgacagtatcaaacctaaaaaagaaactgtagctctcattttaataatttttcctttacatttgcatttaacattgcagaaccttttgatggaacaaatacagccagagcagtgcacgaaaagcagaaatttgatatgatcaaggatcaatttttaaaggtaaacaatgcattagatcaaccctagaaacattagtagactagtatgctttaaacaggaaaaaatacgtgtgtagtaggacagaatggtttctcttctgtgaatccattaatatagcatgatagagaacttattatttgaatttagttaaacttttccttcaaagagatctggctctgtttttattcacattgctttcactttcatagaaataagcattttctcttttctttttgagacggagtttcactcttgttgcccaggctggagtgtagtggcacagtctcagctcactgcatccttcacctcccaggttcaagggattctcctgcctcagcctcccagatagcttggattacagacgagtgccaccacacccagctaatttttttttttttttttttgtagagacagggtttcaccatgttggtcaggctggtctcaaactcctgacttcaggtgattcacccccgtcttcctcccaaagtgctggtattacaggcatgagccaccatgccctaccgaaataagcattttcgtagtgagcttattaaatttccaaaataagtgaataaaacctaatggactcttttccttccttagtgtattggggaatttattgtggccttagaaggaagctgatgtctgatccatgctttttctaatgtataccccactgtcacaggaattagagtgctgttttatctttgtttatatttaggaaagttaaaatttatgtatatgtctgtgtttatagtatgaatttattcatcagtgatgttgctagatgtggtcttaatcttcagggacttcacaacacattgtagaaatgccttgatatatgtattgagacatggaggggagggaaagctttgtagaagaaaaagatgagagaaccgcaaagatcattttagaggcatactttttcattatctagacattcaagtggactttattttaatgataatttaaaatgcaagtattgaggcatgagtatcactggaaccaggagttcgaggctgcagtgggctattatcaagttgctgcacttcaagcctagacaacagagtgagagactccacctctaaaaaaaaaatgaataaaaataatggccaggtgcaatggttcacacctgtaatccaaacactttgtgaggccaaggcaggaggattgcttgaggccaggagtttaagaccagcctgggcaacgcatagcaagacatagttcacacacacacatgcacgcacatgctcacacacacacacacacacacacacacaccccacctcacctcaccccacccctgggtgtagtggtatgcacctgtgtcttagctactggggaggctgagtggagagaaaagccttgagcccaggaggttgagggtgcagtgagctgtgattgtgccaccgcactccagcctgagcatgagtaatagagtgataccttgtttcaaataaataaataaatagataaaatataagtattctattacaagctgtcgttcaaatgagactttcttaatttggcaaccagaatagaaaatttgtcttatagaaattctttaattttggccgggcgcggtggctcacgcctgtaatcccagcactttgggaggccgaggcgggcggatcacgaggtcaggagatcgagaccatcccggctaaaacggtgaaaccccgtttctactaaaaaaaaaatacaaaaaattagccgggtgtagtggcgggcgcctgtagtcccagctacttgggaggctgagggaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaagaaattctttaattttaaaacaaatattcaagagagaatatttttgtttatcagattaaattgagaactcaaaattagcaatgctacattggtgttcttattgatgagtgagctttcatttaggattgtttagttgtaaaaccaatacttttagacaatcgaataactgacatgagactagaatacaaagatctgcagtcaccaagtagtgagacagatttttagcttgtgaacaagtttcttttcttctccttatcaattcaaatcaccatttgaattttccagaggcatacataaagtgccttattgtaaatttactctctccttcataaatactatatatttttttgagacagggtcttgctctgttacccagactcaggcagcctcaatctcctgcgctcaatgatcctcccacctcagcctcctgagtgctgggactataggcgtgtgccaccatacccagccaatttttgtattttttgtacagacagggtttcaccatgttgcccaggctggccttcagctcctgagctcaagtgatctgcccacctcagcctcccagaattctggaattataggcatgagacactatacccagtctcataattattgtttttaatgcaaaaagctagtaaagatgtaagacagtcaatcaaataattgaaataatcctctcttctcaaatccaaaggttttgtcttaattaccttgctacttttagattgaattaatccgtgaataaatattaatattgtcagttgtatctttcagtaccacctatgtgcccatttctttattaatgaattggaaccataaaaatatggagtttttaaataacattttcttttctgatgacagaaacaatacttacactgtgttaaaaacttggaaaataaaaacttagccagcctgggcaatacaatgagaccttgtctctacaaaaaaatttaaaaatagctgagcgtgatggcatacgcctgtagtcccagctactcaggaggcagaggtgggaggatctcttgagcctggaaagcggaggttgtagtgagccgagattgcaccactgcactccagcttgggtggcagagtgagaccttatctcaaaaaaagaaaaaatttgaaggaaaaaattattcaaaatttatcacctagagagaaccaactattaacattcttttaaactctcagtcttttgttctgcataaattttaggttttaagaatgatttttctttctctcccagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggacattgttgaggtgccttttttttctgtgaaaatctttgctttgagatgagaccgaggctgtagttatcatctagaactgaactaaatctacttattagccagctaacgacatcaatatcttatgtctctggcattatgaggaatgaaagtttacacatagtgaattttttagattcctgatgtgtaacactttttatgcatttgagcttttcatattttgggggggaatttttcctaaaatttacactgtgcatctcttaatcagaatgtactgagtagagttaatattctagtgatgactgggtaatcattataagcattagtcatagtactattcagtaatactgtgcaactttcagggatgggtaagtatgtaccctctgcctctacagtattatgacatttcctaataaaaccccagaatttaccatggtgtgggttccttcactgtcactgttttctcagttttcagtggccccacacttactactgcttttctttgttttaccacgaaaaacagatcaagaagtcactaaacttagacccaattctatatcagtagactgaggcctgaaattatgcacacataactggccaaatatcagataagtgaactgttaatatatgagagaattttctggacttttaagttattaatctcaattatttgtgtggtgagtactaaattattttctgtttgtgttgatctgtccatttctgtatatagttgtccctcagtatattgagggattgattccaggtcaaccccgtcctcttcagataccaaaatccacagatactcaagtcccttatataaaatggtgtagtgtttgcatatatcctacacacattctcttgatactttaaatcatctctaaattacctgatacgtaatacaatgtaaatgctatgtaaatagttgttatactgtattgtttagggaataataatgacaagacaaaaagtctatacctgttcggtacagatgcaaccattctgcctcctccctaccccctcccaaatatttttcatcctggttgaattcacaaatcctacatggttacggagggttgactgtatttgcatatgttgttaaagtggtgtttaaaatgtgcaatctgtactacaattctaaattttggattgatttgaactaggatctttgcaaataaatctcatagacattaatgtttgtaagaaatttttaattaaatgatggaaggaacatagaatggctacctgtgattttgattagtgtttaacagattgccacagctgtgattgaattccttttgtactggatgagcatggtcatttgggattactgatggtgaagtctagctggtgttaagagaataaatattgctgatgctaaacctggtttagtgagctgtggaagccttgactctgctgttttccctccttatgccccactagctgatgtatctgtactgtaattcaatgatttacagttcattacctccagacataatgcatgcataccagctcgtgtaactggtgaataatccccagcttacagtcatatttaacaactctgtgacttgctataattaaaaataaatgttaactcttctagccatcaaatcattctcatgaaatgaatatctttattgtaaagttacctccatttgtacatagcagttctggttctgttctcttcagggagcatccattatatgtacctgctatgtgctagctactttgctagtgtgtaggcttgtaagagatggggatgatgggacaaagaagagtagtaaacttacgaagtctgctggggaaggagatacaaacataatttgaatataggattatgtgggaacctggaagagaggtactgagtttaactttgggatttcagtgaaaggtggtgatcttgaatgatgggtatcctggtaaaaatgggaccaacctttgaggcagaaggaattgtgttaataaagacacagtggagtgacttgacaatgttgggaactcctgacttctaaagacacctgaccagctgggcgtgggggctcacacctgtaattccagaactttgggaggctgaggtgggcagatcacctgaggtcaggagttcgagactaggctagccaatatggtgaaaccccgtctctactaaaaatacaaaaattagctgggcatggtggtgcgcgcctgtagtcccagctactcgggaggctgaggcaggagaatcgcgtgaacccaggaggtggaagttgcactggaccgagatcgcgccattgcactccagtctgggcgacaagagcaagactccatctcaaaaaaaaaaaaagagtagacaggtaaaacatggcctgttaggcaaccgttacctttgtgagggtgttggggttcagtctttgagcagtgggaagccattgaggggttttaaccacaacttgatccggggaaaggtttggggcatttgggccagtttcagacaaaacttagctttttgctaacgtgggggaaattgctcctcctcaaggtttaagatgagtggagataaagtttcctggctcaataacagggaccactgagcaagaaaatacacagtatattgacttgcgatataaagagagccgggacggaacactggttcaaaactgggcttttgagcagggcacgcctagctttgtttctcattgggtcattttactagcaatgacagcctgagctgctggagctcttcggagtctcagtttcctcatctgggaaaccagcactacagtaaaaccttctacaggtaccaccacagaatcgaggtaatgaaagcgagacccttagcagagtgcctggtagttaagtgcccagctcagggtattgtttgggataaagggtccagaaagtagctcagctcaaaaccgaaaagactcactctggaggaaataagagacggggctaggttgcctttcctcctttgaaccccctggtgcagccggagcccgcgccccttaaagtgatctccagttgtccgaaaggcccgccagggatctggcgaaacgggggcgggggagggctcagggaagaggagaagctgagcccgggccccagaagctcggtggcgaaactttgacgccttctatttaaagtcgcggggctcgcccgcccccggcgccgggaacccgagccgcccccgcaggggcagggctggggagggcaggggccagagcagtcggagggagaacaccaggcgcggcgcgggcggctccggctccggccccggcccaggcccgggagaggcgatggcgagccgcgatagcaaccacgctggcgagagctttctcggctccgacggggacgaggaggcgacccgggagctggagaccgaggaggagtcggagggcgaggaggacgagacggcggcggagtcggaggaggagccggactccaggtagcgcgagcctctctcctcggcccagggcctgcagggcagctagcagcacccttgcttgtttgctttaagtttttaagctctggggttcgtttgcctcgagctaggcactttctctctgggtgcactgtcgtttaaaagaacttgaaggtgaaggtgctcgctgtcagctggagtgacaggcccgcctgcagcagagttcattacccccgcccccagctccttgtgactcgctgctcttgtttattcctgaggatttacttaggtcctgcataactgccgaaatgtgctggaacacgtacatctggcccgaggcacaggaacaatcgcgaaatcctgcgctagaggagaagggggtggggtggaggcggtgaaggcgcactggtaccttccgatgaatggcggtctccccgggggcctagcagtaggctaggctgcaataaggtgaccttattttgatacaaaggcccataaattctttgggggaaaagaagcatgagtttcagtaatccctgttcttcaagtcctggtcccaaatcccaaatatcagtttccgtgaatgcgatgaagtaatactatgtacaaaagatgcacctcccacccttcgatctcccaccctccgtccctttaagaaggccctaaaatgagaataatagaaatcatctaatgtctatttggattagcttctaccttcacttgttttccttgagtatgagttttgggttttttcctgactgtgtgtcagtcagtgatgtctcttcctcagtctgttcataacagtagaaaggctttgaaggtggcaggtgggtgtgtaccatctcagaacgcccagcttacctaatcaaagccagcagagccgatgttgaagaagtagcccatagaggggcattgaggaggatggatggtcagacaagaagtcctgaatgtatgtcacctgtttatcaaacagctgccaagtgggaagcaagcacagtccctggcctcaaggaccttgtggaaaaagtttccctaactttttcccctatggggaaacgtttccctaacatggggagtgtgagactatatagaggtggaagggaggactatgggtactgtgcaagggcagaagagggagtgttgggctggagctgccttgaagtagtgggcagggactacaaacaggaagagcagaggagaaggcacctgtaggaagtggatcagggagtaggggacctgtgatcccttggcagtgttgagaaggggaagtctgtcaactcagcttttataacctttcccttactgttgtctgggatcctcatatccttgcccaaccacaatttacaaccaagagaatctgaaaactcatttacactaaaatgtgagcagctgaccattcactctggggttgcattgccatttgacaaaggtcaaggccttcagaaaaggatgtgatttgtctgcagtaaacttcagcctgttctgactacagacagtaaggtggacaccagggaaagaggtcagaataaatagagtggagggacacatgagggaatatggaaaatggaggcctggaaaaagcatccaatttattttttattggatgacaagggtaacaggaagtcagcaaaacttctggatttaggaaaaacacgtatcgacgaaaaagcatcaaactctgtaaaatatctgaagagattggttctgagccaaatatgagtgaccaatggcctgtgacacggcctgcaggagatcctgagaacatgtggccaaggtggttgggggacagcttaattttacacattttagggagacatgagacctcaatcaaatacatgtaagatgcacattggtttggtccagaaaggtgggaaaactgaagggcatgggggcttctaggttataggtaggtttaagttttttctgattggcaattggttgaaagagttaagttattctcttaagacttggaatcagtggaaaggaatgtctgcattatgataaggggatgttgagaccaaagttttatcatgcagatgaagcctccaggtagccagctggagagagaatagattgtaagtgtttcttattagactgaaagagttgttctatcagtaattccaaaagggaggggggtgtagtgtagtgaggcatgttccatctccccacctccaccatcacggcctgagtgagtttttcaggttagctttggaatgcccttgctgaaaggaggggtccactcagatggtcgggggcttagaattttatttttggtttgcaaaccttcatttttaaaaattcaaaagacacaaagtaatctgtaaacgttcctttaccctttcaggtatgatatatataattatctatagttacctttctgaattgaggaaaaattctctttaattataaaatgcttttgtagtgcaggaaagctcatcatttacatacaccaacatggatattggatcagagaactatccttctgatatatcatccagtgatatgaatgtgacatgtaacatcaagaggcctgtgaatcctattagttgttccataatgggaaaatcctgtcctctttgagcccaattttctcatctgtaaaataataagaattcctaattcataaggttgtcataaggattgcataaattatgtgaatgtgtgtaggagtgcttggttcttagtaggttcccattaagctttagtttcttttattccatcagatgagtcattattagcaggaaggctctaccttctgcccaccattcatccatgaagggagagatggtctcagctttcagtataaataatgatcctatttcactttgtattcattcattcactaaacattcatggagtgcctactattaatatttgccatagacaatgcgaggtgctggggatacaaaaataagaatccattactgtcctcatattcaccttctagttggagaaacagaaaaacgtaattatgtcattagctgttagaagagatttaaggaagaaaaggtgtgtatgaagcacctcaaagtcttgggatacatgctacctggaagggttggagaagccttcatcattggagcagtgttttgaatcataataaaatgcctcatagtgcttgtagtttgtggatatcaaaaaagatttttatgtttctaaaacttcatgggagaacttttgtgaaaggcagattataaaactcacaggattttagagctagcagaggctttggaagtatctgttctcaaccgatctgattttagattcagaaactgtcaggagtcgtttgttcaaagtcacacaattttttttttttttttttcttgaggtaggatctcactctgattgcccaggctggattgcagtggcgtgatcacggctcactgcagccttgactaaccaggctcaggtgatcctcccatctcagcctcctgagtagctgggactacaggtgtgcatcaccaggcctggctacttttttgtatttttataagagacagggttttgccgtgttgcccaggctggtcttgaactccttggcccaagcaatccatctgcctccagcctcccaaaatcctgggattataggcatgagccaccgtgcccggtcagccacagaattttttggaacagaattaggagtagaccccaggtgtctggactccaatttaatgttcattaatgtattcatttggcagatatttattgaactcctacaatgtgccagagacttcctaggcacaaggaatacagctgtgaacaaaatgaataaggtctctgccctgctaaaactcactccagtttggggagacaaataaaacatatagtatgtcaagtggtaagaaattatgaagacaaatatagcaggataaatgggtggggtatatttggatgaggtagtgaagaaagcctctctgatgaggtgacatttgagcagatactgaaggaatgagtttctaggcaaagggatgaccagctgcaagggcactgagggagggatatgtgtcttatttgaggaacgcaagttggtcaggatgctggaacagagtaaggtaatggggcgagtggtcagagtcaaagctaagagatagttgggttgcagatcatgtagggctttgtagcccatggtaaggactatgaattttattctgagtaaaattggaagctatgttgtgtctactataccagtcaggataaaaacaaacaaacaaaaaacaaggaaagcacagtgattgcaatattcctttaaataataagcacctatacatttgtattttcatttgactaatatttatttaacacttaccatgtgccaaactcatggtttcctgtatggagaggagacagaagtaaataggactgttacttttgtatttctcttgctgtagaccagtgaaagccaactctttcagcctttcccacagatcacttagaaacttttcagcatttttattttcggtcattctctgttggtcaattttcatttctctatttaagcacagaggatttttgccacagcagtacccaaaacttaaaaatcaccttcaattgcagctttgccagtgcttctataaaacaggtctgtctaagctgacagaattaaaattattagtgacattcacatttaactagtccttgcaggaataaaccttttggaaggtgcaaggaatttgtaaatggttttcattatcagtacagagcactctgtttccatatatctatttatatggtgtctcccacagatgtgcttacctaggtgttttgacaagtgtgttatttgagccagccttcttctgaggtcagtggaaagagctcagaatgggaggggttgactgctcaggatgccagaggctgagggaggatagaagataacagagtcacttgtagccagaaactgaagagctatttaagtgttggctgcatggatattttatgtccttggtaagactttgactcaacgaagagttaaactcagcaagagttggaattattactattttttctttagaaaggcaaacttactaaaaagtgtaggacatactgataaaattttacacacaaaaaagtccatagtccctggatattctgaaaacaggcttaatgaaaacctaattttttttagtcattaaaccaaattccccttcctaccaacatgacttaagagaatcaagtacaagagaccagttgtggctgtacatgaaaataacctttgatttagcccagcattatcctatagaaatataaggtgagccacatatttaattttaaattttctaatagccacattttaaaaagcagaaagaaacaagtgacatgaattttagtaatcacttaacccaatatccaaagtattaccatttcaacatgtaatcagtgtaaaacttattagagatatcttacattattttgtactaagtctctgatgttttttaaatacttacagcacacctcaattcatcctgcctaaccacatttcgagtgcttcatagccacatgtagctagtggctatcatactgaacaatgcaggtctgataatacctagaaatctgttagcttcattggaatctagagaactgctgcattggtaataaattctatatgccaggccctgtgctggataccagggacacaaagaggattggatgacacagttgttttccctcaaggagctcagtctggtgagtggaagcggttaatttcaatgtaatatcataagcattacactaaggatattaatagaggaatatccaaagacattcttcctaaaatgagatttagaaagattcctgtagagtgacactgcagttgggcagaaagatattccaggcacaatatgtggttaggtattcctttagttcctggttccagctcttgtgctgctgattgctgctttgtctaaactttcttgttattatccagaatcatctcaggattttttaaggttgagaatatttgttgatcggataagtgaatggtgcgaataaataaatgaataaatgagtgcctgagtaaagggcaagccttccagacttctacaagaagcaagtttagttggaatattgaacttgttagatcaggtaagatttttgttggttgttgacagttcatttaccagggattgacaatgcccagtgaatctggaaagacagtagcttggagggaacagtgataagtactgaaggattgttcagttaaggtgtctgcagtcatcagtgccgccttctgtgacttgtcagaaagccatccctagactgacccttcagccagatcatagacggaaaaataagaataggctttgctttttgctcagaaaatttttctattaagacaaccaaagtggattcagttccaaaattcttcatcctaatctgataaagtccaagatatgtgggaagattaattgatgctactgttcagtccaccaaactaaatactcagagccctctcagggagctgttaatgtgttttcttcctgtaagtatgcctccttttaagaaaaattcacttgctaaatagaaatttacattcactgttatataccataaatatatacaattttgattttaaaaaacttttaaagaaatttacattcactgcaaatttcctcctaatggctgatttcactagggcacttaaattgttggtttataaataaaattaatttcttccatttaaagaaatgtttttattggctggacgtggtggctcatgcctataatcccagcacttagggaggccgagacgggcaggtcacctgaggtcaggagttcgagaccagcctggccaacatggcgaaacccccgtctctactaaaaatacaaaaattagccgggcatggtggcaggtgcctgtaatcccagctacttgggaggctgaggcaggagaagcacttgaacccgggaggcggaggttgcagtgagttgagaccatgccattgcactccagcctgggcaaaaagggcaaaactccatctcaaaaaaaaaaaatgtatttactgtaagaaaagagacttattcattcaaaagatatttactgtgggcctactgtgtgccacgcaatataaacatgtagtgaacaaaacaggtgaagttattaatcctcaaagtttagcctctgggaagggcaggtattaaataaataatctcataagtaattagctacagcaaatgcattggtacaatgaatcagacctaggaagccaaggtaggggcctgctaggaccctcaagtcccagtcgctgaagcctccttgctcattcccctgggagttttcagtcagcctctgggtccctcttgttagtcctcctccatctgcctacagcaaaaggtttcactgtcttgtaatgagagtctggcaagacagcctggctgctgatgactcttatcctagaagggacttcagacgtcatctcccttaccctcatgcttctgatgagtgaacagaggcccagataagaggagggaaaccgtcacttagtcaaggaatatctaatctcttccaagcactatcacttgttattttgagttatttttacaatagctctctgatataggcattgttttcattcccatattgagtaatttacctaatttcagacagctggtaagtagcacagctagcattctaactccagtctactggcagggcctgtgctggaaccatcatcatttcagggctcacctcaatattatgtaatatatatataatacacacctgtttttattagccaatttatttcttttatatttgagtacaattttgctattttcaaataatcatttcaatttacttcaaacttttttaaaggcagaagcatcaaagacccaaaaaatctacatagtagctaatcttgactagcatcttagcaatattaagtttcctgatgtgtaataaggagagtaggtcttatgtttaaaaatagacattaggcaatccagtgtgattgcattttcgtaaggccaaagatagtagcacccaaataacttccttatatgctgtatgggatcatgtaacaaacttgcaacagttatttaccataatatgtataaaattcagatcctctgtttaaaagacaatttatattagttttggggtcatgaactttgaagtttttctgtttatttattttttccaagaggacatgagaagagattgagacaactgacttcggctcttcttagaattttgggagctccaagaagagcttcaataaatcccctagtcatccatcaccattttgggcataaatcaggttacattgcattaaaaaacaaaaaacaaaaacaaaaaaaaaaacacctgatagaactgagaagaccaagattatcatcctggctgtgccacttactagttgtgtgacgtggggcaggatacttcacctgtctgtgtctttaccacagctttcccactttctccctgactggcccctgtctacctctctcagctcatctcaagccactgtgccattttcactacatgcaagccagcaggctaatgagcttgttcctcatccaggtctttgctcttgctgtctgctgtctctggaatgcttctttaaatccactcttcaggttttggtgcaaatgacgctttataaaaggggctttcctcaactgccctgccacatgggcttagttcactcccttcttgtcttccgtggtcacatcattcattatttcacattgcgcttcatagcacctatcgttatctgcaattttatttattattgacaccaccagaatgtaaattccatgagggaaggggccttgcttctctgttgcattgccaacagctagaacgcagtgcctgctacacagtaggggcctaataagtggtggttgtgaccggacacggtggctcaaggcctgtaatcccagcactttgggaggctgaggcaggtagatcacttgaaatcaggagtttgagaccagcctggggaacacggtgaaaccccatgtctactaaacatacaaaaattagctgggcgtagttgcgtgcacctgtaatcccagctacttgggaggctggggcaggagaatcgcttgaacccaggaggaagaggttgcagtgagctgagatggtaccactgcactccagcctgggcgagagagtgagactctgtctcaaacaacaacaacaacaacaaaaaaagaaaagaaaaagagaaaagaaatggatgttgaatgaatgagtactgggtttcactataacattttatccctaggatctcagctccttctgtctgatgaacgccattcatattaccaccctcctaacaaatcatcttgttctttattatccttgtgccaagataataaagggcatggagaatgaaaactgagcagtggtcattgaatctggcaaaatgcaagtccatagggagagatgaataactaatagaaatgcagacacctttgagagggtttaagcctatcagcatctgctttaaattgaatccatttttgaatagatcctttcaaatacaggatctaggttactttcctgagagaagaggacactagaaagtagaaagagggaagtgggtgcctagaagaggagagggcatccagagcagactgggtgatatagttgtgcctcagtctatcctgctaacaggagtgaaccgagggtatcacccagaaaactgcagaaaactggctacaaactggcctcagtcactgataactgcaggaaggggtgacattcttatttccctgactcctcagagaatccgaaacagaaggagaagttgagcatggacagagttaaccgtgttgacttataaactagaactgcctgaaaccaaatgtggagttaaagcatctgatagagttaggacccctagtgcatttacatacttgactcattaaaagaaaattctggtggagtccctggacaccatcctaggtggtcagggagatgcaggataatacagcctttgtggctggagggccaagcccaagagaggaatgctggcatctgaagatcaggccttatttatctgaataactgactggaatcagtggtctactttaccttagagagaaatggcaagaaatggcaaccactcttatatttttctttctctttctgttcagttcatacttgctgctcaacctgctacagttttcacttgtcaatctcataagtttcctttgactgagtttgcatagtttaacactttagaatcatgaattcagaaacccaggctttagtgacaacactgccaccaaacaggtttcagtttgctaggaaagccttacgtaagttattttctgtaggtgagaggtgctgccttgggttccagaatcttcgccagttagttttgatttgcaatagaagtaaactgctcaatttaagcagaaaattggttggtagctcataaatcatgggaaggttggagaactagtcattaaacaggaacagcccctcaaaccatgccttaaaactggtctgatgaattatttcaactcaattttaaaaagacaacccaatttaaaaataggcaaaggatctgaatagaagttctctaaagaaaatatacagatgtccagtgagcacatgaaaagatggtcaacatcattatccatcagataaatgtcaaataaaaccacaacaaagcctaagtgtctattaatggatgagtggataaggaaaatgggatatatagacacaatggaatattattcggctataaaaagcaatgaaattctatcatttgcagagatgtggatggatctggagatcattacgttaagggaaataagccaagcacagatagacaaatatcacatgttctcagtcattgggagctaagaaagtagatctcatgaagatagagagtagattggtggttactacaggccaggaagggtagcagggaggcagggatgaagagagattgattaatgggtacaaatatacacttagggctgggcgcagtggctcacacctgtaatcccaggacttcgggaggctgaggcaagcggatcacttgaggccaggagttcaagaccaacctggccagcatagtgaaaccccatctctactaaaaatacaaaaaaaaaaaaaaaaaattagccgagtgtggtagtgcatgcctatagtcccagctacttagacaggagaatcacttgaacccagcaggtagaggttgtagtgagtgggattgcgccactgcactccagagcaagactctgtctcaaataaacaaacaaacaaacaaatacacttagaacaaataatacctggtgtttgatagatcagtagggtgattgtagttaacattaattgactgtacatttcaaaatatctagaagaaaataaattaaatgttcctagggtaaagaaaaaataaatgtttaaggtaatggatatcctaattaccctgacttgattgtaaaatgtctcaaatgatcacatgtactgagaaaatatgtacagctattacatatcaataaaaataaattaaaatctcacacacacaaaaccacaataagataccacttcacactttctaagatggcaaagacagatgttgggagaggatgcggaagtatcagaatcctcatataacactggtaggaatgtaaaattgtacaaccactttagaaaacagtctggcagtttctcaaacagttaaacatagagttaccatatgactctgcagttccactcctaggtatgtactcgagagaaatgaacacatttgcccacataaaaatctgtacattaatattcatagcatcattattcataatagccaataaatggaaacaacccaaatgtccattaactaatgaagagataaagaggccaggcgtggtggctcacacctgtaatcccagcactttgggaggccgaggcgggtggatcatgaggtcaggagatggagaccatcctggctaacacagtgaaactccatctctactaaaaatacagaaaattagcggggcgtggtggcgggcgcctgtaggcaggagaatggcatgaacccaggaggtgaagcttgcagtgagctgagatcttgcgactgcactccagcctgggtgacagagcgagactccatctcaataaaaagagataaagaaaatgtgggctgggtgcagtggctcacacctgtaatcctaaccaatactttgggaggccaaggcaggaggatcatttccacccggagcaacatggcgagaccctgtttttacaaaaaaatttaaaaattagctgagcatggtatagttctagctattctggagtctgagatgggagggttgcttaagcccagaagtttgaggctatggcaagctatgatcggccactgcactctagcctgggcaacagagcaagaccctgtctcaaaaaaaagggttatattcatacaatggaatattatttggccataaaaaggaatgaagtactgatacatgaatggaccctgaaaactttatgctaagtaaaataagtcagatacaaaggaaaacatattgtatggtttcatttatataaaatgcccagaataggcaaatctgtagagacccagagtagatttgtgtttgcctagagctggaagggagatgtggaagggattaggggtgatgctttaggggcatggggtgtctttttggggtgatgaaaatgttctaaaattatctgtggtgatgattgcacaactctgtaaatatactgaaagccattgaatggtacactttaaaagggtgaattttatagtatgtgaatcatactacaataaagcagtttttaaaaaatcatctggtgaggaaactgttgccatggctggggcactagatgtcacaatttgtgctattgccacatccacaccagcagttccatattgcagcaactgggacccctgctactgccagagagaacaaggagctgcacatctatttctttcctcagtagctctcaagtcggtctaaaaacggatgtgaaggtcttcactaggagagtatctggtgctgtcagctctgtctccccaggccccccaaggtggggaattcaccaactgggaagagagatcatttgctcaactgtctttttggatgtcagatgtctgctggaccagcagggggccccgggctaggcttttcttcagattttgttacctgaccctcagatcatttaacacaggatgcagtatattttgctatttctgtggatgtacaacactttgtttaagcaatagaataaactagttaatatttcccaaggaaatttaattgaaaatacaacataggtcagtgaacagataaaaccatatgaggttgaagttttcccccattaaatatcagctgaatctgagtattcactgtttattccagcatggacattccattttacaataagaacaaaaaagtctttcactctggcctcaatatgacctgtcttacacaccttggtatttctgctttgaggtttcaaaactcctttgagatcgtatcactgtttgctattatcaggaatttaattccttctaaagccttttggtctgtatgcctagggtaatcctcctttggagaattgtcaccatctcacaggtgggctataatagagtgtatgtatgaccctggttcaggggagaaatcagactccagtagtgtcagattgtcttctctggtaagttggaaatggaggcagagattctctttagttagcttggaggtttgggggacatttctcaactttttggagatctagtcaactttattttgatcttttcttgaaaattattaatttttctgtcagtcaaaaaatattctagggccgggaacagtggcacatgcctgtaatcccaacactgaaaggctgaggcagaaggattgattgagcccaggagtttgaggccagccttgtccacatagggagacccccatctctacaaaaaattaaaaaattagctgggcatcgtgatgcgcacctgtagtcccagctacttgggaggctgaggtgggaggacgatttgaacccagaggtcaaggctgccatgagctgcgattgcaccactgcacttcagcttgggcagcaaagtgagactgtgttaaaaaaaaaattctaaatgtacatctgtgaaactgtccaaactgtccaagatgtggtaaagaagaatattagctaaaattgctgagcataatttggtatctaagatggtgtccaggaaaaaaaaaaaaaggtatttaatgctaaataaaaactctctgtcaaggcaggaatcccagagtgtagaagggtggggaggtgacaatccatagggaaagggtatgacccccactgtgggtctgaatgctgtatcacactcaagtgtgtttctgaaaccttaaaacagttcacccaaagtagagcgaccagaatcctgtgagcagaccctgtgtgcaagggtctgaaagccattcgaactggtcctatcacccaggagaggctccatccttcatcaaagcaagtcatgccaacaagcagaagttttcctacccctttatttttgttctcttggatatagatattagaagagggaaaagcaataaaatatcttttctgaaagccaggagtccctgcctttgttcttggttgatctcttaatctctttgggaaataattttctgttactgagggtgccatttggggatagctatgttgagagagagagagggagagaaagagagagaaagagggagagagagagaaaatacttgtagagacaaggagagaccagagccaaattgacacatcagagatagagtagctcccttgactcctgatggttttcctgtttccccttcactgggaggcctaaatatacctctggcccctggaacctatgagaagtctctatttctttaaaataaaaaccctctatttaacctagcctgaaagagtttgttccttaccaccacaagtgccttaaccccttcttaacatttctaacagcttttaaacatttttctcctggcttggcgcagtggctcacgcctgtaatcccagcattttgggaggccgaggtaggcagatcatgaagtcaggagttcgagaccagccgggcctagtatggtgaaaccctgtctctactaaaaatacaaaaattaaccaggcgtggtggcgcacgcctgtagtcccagctactcaggaggctgaggcaagaggatctcttgaacctgggaagcggaggctgcagtgaggcgagatcgtgccactgcactccagcctgggtgatagagtgagacttggtctcaaataaataaataaaataaaataattttctcttgcaggccttggcaacacatgtgctctaagccagagctagccaaaagaaccccttaaaactggagttatgcccaacatgtccagaaatactataaatagatagatagatatagtattttttttttttttacaatcaggaatgttttggacatcaataataaccctaacactgaaacccaaagctaccattagtccttaatcaccacaacatgcctgcagaaaatttttaaaaacctgcttcagaattgaaagaacttttatttcccacccacacatcttcccactgcaaatattttaaacttgattgaacagagctacagacctgaagaaaggtctatattgacctaacaccaacttaagcatatatcatccaggagctggtagagaaaaagtcttgatcaatttcagtttgatctcaccaatcagcgtctaggactttctttcaatctctcctggagttctcttggagaactgaatactagcagttctctggaatgcactgttgatagccacttgacctctttgagcctcagactctgaaagaagcaggtactgctacctgcttcacaggtacctgtgggggtaaatgagaatggagatacacaaggacatcatatgttcctggcacagagtgggacatggacgagtgtcagttttctcttctctcccttccccatcatctactagtaccctgaactattgcaggatctggccagcagcccgcaatgcaacagggctctttctttgttcccaggtggatcggcaggtcgagaaataatagacacacgcaagataatgaaagctgggtccaggggagtcaccgccttctggtcctgcgatgctgccaatgtgctggatataccagcatttattattaagtttagtgagggcgggggtaggttagtgagggatttagggtcatttgattatgaggtgagatggtcacatggggatgaagtaattctttaacataacatctgtatgcagaagtacagtatacagagataagaatttacaatatagtgtgtgcatctgtaatttctaacagagccttaaaacagaagcacagtctttccataacctgtgattagcaagatattaatcagcagtaacagttgcagcaaaagctggttacaaacaatccatagaaacaggacgtgaagctagacaaccggttagaccagaaattctcagaacggagtacgccttaaccctaaagaggcctagaagagtcatggcaagatcagggcgtttatagccctatcttatccatatgaacaggtgcccctcatgcgtccgtttataggctctccacaagggtctcattccattcccagagctatgaacatctgcttttctgggataggaatcttggtgatgtgaaacctccctgactgcacgtccattcataggctctctgtggggggaagcacatcacgcgctgttggctcattctggcagtgcaacctggcattgtctttacacagtcctgcatgcaattttgtatttacaataatcaggagcatttcatcttttattctgtagcaatagtttcagggggtctccctacactgaacatgagttgtttcctaggttcatgttgccatttctagcaatgctattcttcagccagcactccttaccctgcacccttagttgagctgcactcctagatgtacaaataactcttcttagtttttttgcttcgttttaattttaaatcaaaactaggtgtgaactccagtgtggactgcacctatcctcactagtgtcttttctctaattttcttggtgtggcttgttggaaaatgttaaagctttctagttagtatttgaatacatttcagggtcctaaatgatgagtgttaaagccccactgcaagaattgtcagctttgaacagaatagagccaggaatgatgcacctgcagccactgagacatacaactggaacggcccactcagcataactttatgaatgtttctagcactagaaaggatttcattttacatttctatttgtttaaggactgtgtgtagcttgccttttgaacacataatacacactcaaagatgttgactaagttaatgaataataaatgatgatgaatcaatgaattcaatgaataatgaatgatacagggaagaataattagaagacatattaattttgcttagttacactttccagaggtaatcattattaaagaggtaccttttggcttaattataggcttattaataaattaaagtgagtttacatatcttcaaaatttggacttcacaaggttaattcaacactgaaaaggaaaaggaagagaagaaaaatattttcatttgtcatttgcctagtatgacacgagatgttttacatatcatttccacataactaccttataaagtagatatgagccacctgttgaactaatgatgaccttcaagccccggaaaggaaggggaagtaatttgcctgagctcacacagtgccttagtctgtccgtactgctataccaaaatacctaagactgagtaatttagaaataacagaactttatttctcagagctctggaggctgggaagtctgagatcaaggcactgcagattcagtgtctggtgagggcttgaacctccttgctgagtcctcacacagtggatgggcaaaaggccctagagtgctcccttcagcctctttcataagattgccaatcccatttgtgaagcctccatcctcatgacttaatcatctcctaatgaccccagctattaatactatcacattagtgattatgtttcaatatatgaattttatgagacacattcagaccatagcacatagctaataagtaatgaagccaggatttaaacctaggctgctctgaagtcaaaaatgctatttctaccatgctgtttctatcccacggacttagcactgtggggtatattaagataatgacacatagtttctgtctcaagaaacttattgttaagtagaagacacatggcaaatactaatcataataatagaaagtaacatttggccgggcatggtggctcacgcctgtaatctcagcactttgggaggccgaggcaggcagatcacgaggtcaggagattgagatcatcctggctaacacagtgaaaccctgtctctactaaaaatacaaaaataaaattagccaggcgtggtggcgggtgcctgtagtcccagctacttgggaggctgaggcgggacaatggcgtgaacccaggaggcggagcttgcagtgagctgagattgtgccactgcactccagcctgggcgacagagcaagactccatctcaaaaaaaaaagaaagtaacattttaaaaaatggagctgggtgtggtggctcactcctgtaatcccagccctttgggcggttgaggtgagtagatcaacaggagttcgacattagcctggccaacatggtaaaaccctgtctctactaaaaacagaaaaaagttagccaggcgtggtggctcacacctgtaatcccagctcctcggaggctgaggcacaagaatcggttgaacctgggaggcggaggttgcagtaagctgagatcacgccaccatactccactctgtcactctgggtgacagagcaagaccctgtctcaattttttttaaatttaatttaatttagttttttaaaaatggtagttaccagagaagtactctgctgaattccagtaaatctgaagtattgtatttcagagaagaaagtgaggtaagagccggctcagtgacactttggttttctacaaacaggtatcaaggcagggctcacatggtacccagtgttgctaagagtatgggtaagaatgtgtggctctcgtacacactactgataggaatgcaaattaatcaacctctctggagggaaaactgtcaatatgtgtaaaaagcctgaaaaaattattttgcttttgagtctcaaattctactaccatattattctaagaaaaaaaaatgtgctgaaagatgtatctgtaaggatgtttatcagagttattatagaggaaacttggaaacaatctaaatgttcaacaacagggtactgggtaaagaaagtgttacatgatggaatgctatgttaactattaaataggaagttgtggaactgcagtgatcagtgatcaaagtatggttttctttcagggcatccacaagatccaaactatttttatagtagttctaagacattatttgcattttccactttcattctctcatgactgtatagaggatgaaaagctcattgatttttttttttttcagagtccacattgcaactaatctttaaaaaaacgactactttttaagttttggtgtggtataaagaaaatatcagctgggcgtggtgactcacgcctgtaactccagcactttgggaggccaaggtgggccgattacttgaggtcaggagtttgagaccagcctggtcagcatggtgaaaccccgtgtctacaaaaatacaaaaaaaaattagctgggccttgtggtgtgtgcctgtaatcccagctatttgggaggctgaggcaggagaattgcttgaacccgggaggcggaggctgcagtgagccaagattatgcaactgagctccagcctgggtgacagagtgagactccatctcaaaaaaaaaaaaaaaaaaaaaaaaaaaagaaagaaagaaaaagaaaatatccagaattatctaaaaattactccttccttttccaactacatatctctgtgaggctagattttctttatatattcctactaacagtacatattcacattttgaatgcagaagcagatgtgagaattcagctgtcttctgctagcccaaacatttaaaagatttgcaaaaatataaaataatgtcattcttctcactaaatgtttttgtttgtgtgttttggaaaataactttttataaaatatgttattgatgttgacatgtagtaggttattattacgatttttagatgaattaataaaaattttaaaagttctgttttaattgctactaccctaaatattgataaatataacccacatgaacaaaagctttttgaggtcctcaataatttttaagagtataaagtagttttgagaccaaaagttttgagaatagttgttgtggaaaagtatatttaatagcatgaaaaaatgttcagaatgtattttttaatttaaaaaaagcacattacaaaacatatcatttgtgtaaaagaggcacatctcaggatagattaagaatgaagaatgctgatatattaaaagtggtcatctgagtgctgggattactggttgttttaattttctttttttgtgtgcttctgttttcctatatatcctacagtgaaatttatatttggttattagaaaaattttttatttttacaggtaggacctaaaaatcttgaactttcccctgagttcaactgaggaatggggcaaaatgtattaacaagggtggtctgtattatggtttttaaaacattttactggatcaaatgcacatcatttttagtgggtttttctgtctttctcttttgtgggtgattaataagagaatcttatgggaaattcagcttaatttttagaactcctgaagagatgtaagtgctatagtcttataacaatgattttggggatgcaaagttttccaataatctaacttattccaatacagtcctctataaaaacaaagctattgaatctccaattctgaggttttacaagtcagaaatcaaaaggctactagcaagttatttcctaatgtatcagtaaggattttacttaatctctttgttttttccccctgtggaattttagagacttctttttataagttctattttactgttggttatgttttaggtaagaggtttcttgtgtttttctggtggtgctgtttgagcctgatgatgggtccatcaggtaggtcgtctgggtgcttttcactggcagctccaccaatagccaggctgctgctgatctgctttcaacttcagagggatcaggcacccctgccaccaaccgtacctggcagaatttgtctaaagtggaatagccactaaaggtggtacagagagaaaaagaatgtaaactacgtagacaattgcttggaaagttgaagaggacagaggcaaagtttaattgtcaatataggttttgttagcagactttgtaaattatgttcttgagaaatgaatctttcaggtcgcaaaggctacattggagaaagaaattaaccactttcaaaaaaagataaagattcccatatacccttatagatcattggtttgagaataaataaaaaaatgggggctgggaaattttctaaacattttatgtatgcacaaaagaacatactttctaatactgtacttgaagaaaacacaaagttaatggcgctaataagttatcatccagagctgatccagcagaaaatatttgaggatttgtcagtaaccataatataatgattaatttttcttgatgaattattggcagcattaattgtgggcctagattgaaattcagtggaggagcacccagaaattgaagagaacgtgtatggttgtttttcaatcacaattttcagtatgatccccttccatcttcactccctcttcgcatatggtacagcagtatctcaaggatgcttctctccgtagctggagagtgccatcactgggcctccagaggactctctcttaggtttatccaaacaggcccggagaaccaacacactgccacccaagtctgtctgctggcaccaggcaaaggggtcctctctcctgaaactccagggctgggatgtacttcacctatccctgttcatcccaggagcatctgctggagtgagacattggtgttttatttatttatttgttgtttgtttatttatttttgagttggagtcttggcctgttgcccaggctagagtgtggtgcgtgatctcggctcaccgcaaccttagtctcccagattcaagcgattcttctgcctcagcctcccaagtacctgggattacaggtgtgcaccaccatgcccaggtaatttttgtatttttgtatagatggggtatcaccatgttggccaggctggtcttgaactcctgccctcaaatgatccaccctcctcagcctcccgaagttctaggattacaggcatgagccaccacacccggcctattttttttcttcttaaaaaatgacagagaaaaaaaaaagtgttgccaaacactatattaggtatatggacaaaccccgattccatctaatagatgagctgggctttatttttaaatgtattactattattattttcaaggctacaatgtaagggctctttctctgttgcaaatttaatacaaaaaattgctggaaggccatgaaggaaatctgatcagatttcttctactttttggactgatttgccctcatacttcatgtttttatggagttataattgtattaggaaaaaaaagtcagtgtaacaggtggggagaagtctatcatggctcactggtttattttaaaaaagatcccaacctgacatattctattcagatgaagtgctctgtctcttagtaaccaccactcaacattcatgggaatttgacagcagtggctggcttctgctctgtgctaatattcagtagctgttgaagaattccagcactaaacagttaagcctatttaactcctttgctgggagtcccaggaacctgaacattctcatcctccatggtttttcacttgtatcctcagccaaggttggtgttgcctatggttgagtgtcttttctcactcttgagtctgccttcaccagtggttctcagctattacatatctgaagacattttttattgtcacaacctgggatggggtactaatggcatctggtggatgggggccagggaggccactaaacattctcagcacacaggacagtccccaccccgctgcaccccgcccccaccccccacccgccgtcacaaagaattatcttagctcctaatgtcaatagtgtcactgtggaggaatgcccacctcccaagaccacaaataattgagtttcctatgttttggtctgaagcagtcactaagctatgtaacaatgctgtcacaccatagcttatttattttggttctctggacctggcgtctctttgtccttagttttttataatagtggagaatttagtggttgagttttatgcttttcgctggcagactcggatgtgtgcttgcagtttatgtaattgaataacagccccagctcatggccaagacctgaatagatagatactccctaaatatttataaattgattgtgcatgctaaagcccaaatggctcttttttaactctggagagaaatgatttttgtaattccagagttctcgatgggtcatgttaacacctttacctactactacgtagatacttcctacttggaataaatggagtttatgcatgcggcccacatgtagtattttggttcgggaggagtaggggtaggaaagaagatactcactacttcgaaatctcctaccttcacatggatcgcatcttcatcttgtcctggttgtaaggacaggcacatgtcttagtcactcaatgactcaagttatcttggctgttaataacaagtctatgtgtatcccaccgttagccaattatcaggactgtccaaagccctaggaaagacagaatgatggtggttttccagtctgcttggaggttggagtagcatttggaagcatctgcataatactaacatatgtatcactgggttttacaactttcaagaagattacagacttgcaaaggtgccccaaagaatagccagacacaccatgtggtttcacacccctcttcttttgcacatgttgttccttttacctgaattgcttctaaccacctgcatcctggttttcctggaaaactcatttttatcttgcaaaacctcacatcagtctgtcatactctgtgattatattccagaccctcctctcacacacgtattcaaacagcatgccccactctatcccaaagtttaaagatgtctttctctgtaccacatctgatatcttttttctttttcttttttttttttttttttttgagatggggtctcgctttgtctcccaggctggagtgcagtgctgtgactgaccatggctcactgcagccttgaactcctgggctcaagccatccttctgcctcagcctcctgagtagctgggactgtaggcatgtgccaccatgccttgctggtttttagaatttttttgtagtgatgggatctcactatgttgcttgggctggtcttaaactcctaggctcaagtgatcctcctgacttggcctcccaaagtgctgggattacaggcatgagtgaccatgcgcagcctcacatgggacgccttttgcacattctattgaagcatatgtcacactatatgataacagtctgtttttaggtatatctctatgctagtctctaatttcctggaaggtaggaattgtgttactcttctttatattcccattgctttgcatattgtgggtacttcttagaacttaaaaacagaattcttattatttattttgcaaggctcatttaaaaaatttgtgaaatgttactaattaactgggttatctctggtaatgggacagagatagaggtgatggtaattaagggagactatgtagattaattttttataacaagaatgtttttatttacttttgtaattaaaatgaattatgtatgtgtatatggaggttttgtttgctgctgtatgctcattgcctagaacagtgtggtccatggtgggtgttaaatatttgttgactaaatcaaataatgaatctaagagccaaaggcaataatatatgtgcaggtatttggagagtcattaagtgatatgaaactatagcttattgttattttaataataataattttttttttctgtgacagagtctcgctctgtcacccaggctggagagcagtggtgcgatctcagctcactgcaagctccgcctcccgggttcacgccactctcccgcctcagcctcccgagtagctgggactacaggcgcccgccaccacgcccggctaattttttgtatttttagtagagacagggtttcactgtgttagccaggatggtctcgatctcctgacctcgtcatccacccgcctcggcctcccaaagtgctgggattacagacgtgagccaccgtgcccagccaactatagcttattattactgtctctggaaactagacgcctggtgagtgtcagagcaggggttagaatccaggtttccttactcctgttagcagatggtaacagaagcagctgtagagctggcagggcctgaagctaaagtaacctgaggcatttcctttaagaataccaacttttatcttttttgcataatctggttcaaattgtcaaccctatttttccaactcatagacatttttgcagtagatataatatgacttatcactcactggtaatatacctctaaaactgttctgtgctgcttacagagcattgtgtcaaccactatagttctggagtgcttaaagcttatgcaaatacagatgtgcacatgctgtgtgcttctgagggagatctgtatgggatcgtggcatcgctgagttctaactgatggatttctcttggtctgattaggtccataggtcagtttgtggtggatactcacaagcacgtagattatctattatatctgttcttactatcaagtggtgtcctttagttcctaccagctaatagatggtatgtgtggccatttatttgtattaggatttgactagtagaattactctcttttctttgatgaagttctgaaacaattgatagataaaggaatggtagctagagatgaaaatatcaacttcatcatttatagagctgatatcagagaatgtggcttagatacaggacaacaatgtgatttctactactgaatctcctgaatctcagaaatagacagatttatatacccagtcacaggctgtgaagaaccacagcctctcttcatatacttcatagcacaaggaatatttaatgttggtgcaaaagtaattgcggcttttgccacagtagaatggggaagagtgataaagagaagctaggccagcattgttttactaatagatgtccttctacttgagaagaaacatctgagatgagaagttagtgtctcaactaacaagtaaattactatcatgcattttaagaaattttaacaagctaaaagatatgaatctttacatcacatagtttactcctacactcttgtatagatgacacaggaaaatgttgacaaacaacaactaaaactaagctgggagaacactgattgtgtctagtgacgctgttgtacaggtgagggcttaggtaagcactcagtttgttttacggtggagctactttcagtagcaacatccgtatacatcctagatttcagatgattaaaataaggcaacgttaatttatatttatatcacaaatctatagtgcagaccaaattgattaatttgaagtgaacttttaagaccttttaaaaatttgcaccatatggtaatcttgctgtaaaagaccacacctaacatagtgcctacctagtacataatttgagctcattacatacttgttgagtgaataaatcttgacttaaaacagatgatgccccaggcaagcaaaccactcctgttagcaggctgctctcaaataaccatactcactcttttgagttgtatttttactaaggatcagttgtgattgttccaggacctttttatactagttatacttgttattgctgtaacatgatttaattaaatattgcttaagctgatgaaatatgagtacaaaagtaaaagagctgttgttcctctgaaaacaaaggtgaatgctttagaaagactttataaggagagccaccaaaagaaacactaagggacattgattcctgcttacagaaagtttacagtcttataaaggagctaagatatacatacaaataacttgaatgtaggatgaacaggagaatattacattaagattccagaagttcagaggcagaaatttacttttggcttgcagcatcattgatggatacatggagaagttgatatatgagctggtctctaaaataaataagagataaaatatacaaagatgattcattctaagtgaaaagaaagatatcagcaaaggcatgaagagtgaagcctatgtttggctggattatagagttaatgaatgggaagataaccaggtttcaaatagtagagggccctaacttccaggcttctaaagtacctgatcattgtgataacaggatccttattctttccatccacaatgatgttgaatggcctttagtatatctacaaaatgaacactttctattacggcataattatgctgtgtaacaatttattcattcatggtttcatgaaattttttcttaactccctaatggcataaaagttccttttaacctaagctattttttttttttttttttttttgagacggagtctcgctctgtcgcccaggctggagtgcagtggcgggatctcggctcactgcaagctccgcctcccgggttcacgccattctcctgcctcagcctcccaagtagctaggactacaggcacccgccactacgcccggctattttttgtagttttagtagagacggggtttcaccgttttagccgggatggtctcgatctcctgacctcgtgatccgcccgcctcggcctcccaaagtgctgggattacaggtgtgagccaccgcacccggccagctattttatattatagtttgctgaactgttattcagcaatgcatatttttttcagctaaacacattaatattaaattaattcttggtgaaatattaattgtagagttaatgattgcttttaagaattccattttttaaaagactcatataaaacactaacagtttgtattaaaagatcacaagctttcttggtgttttatggcttaaaatatatctttcaaagcttgtaatataagcaggatcataggtgactttcccattttaataacaattgatatttaatgcattctaaaagacttcatgagaaagatatccgacctattacattcttttgttttatatacttcccgttagtgcactgtgattgcttgagagaataaagcatcatgcaaatctaaggtatttttcataattatattcctataaagaactttaatgttactttaactgctgatcagaggaaggaactacaagttcctagaatacaaatcttgagctcagtagaaacaaagtataataatataatcatgctgcataatgacattttggttaatgacagactgcatatacaacagtggtcccataagattataatgccatattttacttagtttttctgtgtttagctgtacaaatactcaccattgcattacagctgcttacagtattcagtacagtaacatgctgtatagggttgtagcctaggagcaataggctataccatatagtctctctgtaatagactctaccatctaggtttgtgtaagtacactctatgatgttcacacaatgatgaaactgcctaatgatgcatttctcagaatgtatccctgttgttaagtgacacgtgttatacaaacttaaccttcagataaaaatagagaacccatttcacttcttcagaagtgtaggggtttttttaaggaaagaatgagagaatcaattcaaaacaaagatattgatgaagaaatgtgggaaactattattttggtagctcctctatgatggctacccatttccctctttaaaagttcaatttgtacatatatgttacctccctcatattttttcacttataaaatgagaaatattataaaaccacaaggctctttccactcatgattctaataacttaattttcaataagttactggtttctgagctaagatgaaataggtgtgcctaggaaggttgatcacagcctaaacaggaaacaggaatttttggcatggtcatcatattccagaacctgatccttcattttgaaatatcagatgttatattttttagcacatttaatgaaattcattttttgagagctggtttatactaatacaactcacaaaaaacacatttagaaaaatatgtccatttaacagttggagataagaagatcaccagcaaatgtattaaagctccattcataaattatctcatttccttcctaccgtgcaaagggacatgaacacacaatgaaaatataaattagagtttatcagggaaaattcagaaatggagaagtagtagatcacacacaatcctataagctctcatctcacaaagagtaatgcttgctcagggcatagctggactactatgggaagggaagggcttatgtagaagaatgatgcttatgtgatgcttaacttatttatagggatggcggatatggaaataaaagacaaaatggaactttgtcagagaactgaaagcaatgaaaagaatggaaattcgaaaactgaaaaatacaataataaaaaatgacacatttgattagtaaacagtttagacacagttgaatacagaattagtatgctggttgatgaattggaagaaacatccaaatgaagcacacacaggatacagtgaaatgtttcaatttgtgaaaaactgggatctcagatgacaagagaggcaatgaggcagaagcaatatttgaacagagtatggctgaggatttctcaaaaatgctgagggacattaatctacagattccagaaaccatgcaaactccaagcaggataagatgtctaagaatatgatagtaacttctgaaaactgaagacaaccaccaaatcacaaaaacagctgtagggaggtagtgggggaaaaaagtccaaatcatcttcaaaaaagtgacagttacactgacagccaacttatcaatacaaacaatggaagacagaagacaatggaatgatatttttcaagtgctaagataaaaataactgccaatctaatttttttttttttttttttttttttgagaaggagttttgctcttgttgcccaggctggagtgcagtggcacaatctcaactcactgcaacctccccctcccaggttcaggcaattctcctgcctcagcttcccaggtagctgggattacaggcatgcaccaccatgcccagctaattttgtatttttactagagacagggtttctccatgttggtaaggctggtcttgaactcctgacctcaagtgatctgctggcctcggcctcccaaagtgctgggattacaggcgtgagccaccatgcctggcccaatctagaattttatatcctgaaaaaatattcttcaagaatgaaaatgtaaaaagacttttaatgaaaaaagtaggaagagcttgtccccagaagattcacaccagaggaaatactaaagggaggaggaaaatggttccagatggaatcttagagatacaggaaggaatgaagcacaataaaaaggttctgtatctaagtaaatctaaataaatattgacaataaaaataattatatctcacgtggcttaacatttagattgaaaatacataaggacgtgtaagttgaagttaaaggattcatggtctttgtgttgtctgggaataggtaaaaatatcaatttatattagacattaatgagtcaaagatgtatgttgtaatttccagggtaatcactaaaataatagtcaagtagaatgtagctaacaagctaatagaaaaggaaatggaataataaaaaaattcaatccaaaataaggcaaggctgagtgtggtggctcactttgtgaagctaaggtgagagaattgcttgagtgtgagagtttgagaccagcctgggcaacatattgagacccccatgtctatttttaaaaaataaaaaaacaaaataaggcaagataggagagaaaaaggaatatagaataggtaggacaaatagaaaataaataataagatggcaaatttaactccaaacatattggcaattatattacatttaaatgaactaaatgctctatttaaaagttagagagctctatttaaatggtcagaatggattttttaaaaactatatgctgcttataagcaacatatctaaagtataaagatataggaaggttccaagtaaaaatgcaaaaagatatttcatgcaaatgatatatatggatggataatgcaaacattaaccaaaagatagctggcataatgctattaatatcaaagcaaagctttaatagtatcaaactagactctagaaaaaaatctttatttacagataaaagggacatttcactattattaaaagttaaaatttccagaaagatataactattctaaatctattacctattaacatagattcaaaatgtttaagtcaaatatttacagaaccataaggagagacaaatccacaattgtgttagaaaatgttaacacatttctcagtgttagaacaggcagacaaaaaaatattactaaggctaaaaaagatctgaataacacaataaataagcctgacttggttaacatatatagaacactgttgaaaaactgcagaacatatgttcttttcatgaacccataaacatttttcttaaaatggccatatagccatgaagtttcaacaaattttgaagtataacttcatacaaaataaattctctgatcacaatgcaattaaactagaaagtaaacaaaaagataactaggaaatcctcatgtattttgaaattgcaaaatacattttcaaataatctatgggccatatatgaaatcacaaaggaaattttaaaacattttgagattaataacttttaaaatgctatatatcaacctttaggttatacatctaaatttgtgcttaaagagaagcacatgtcttgacttcacatgttagaaaaagggacagtttgaaaattaatgacataagaatctatcttggctatgtgcagtggctcatgcatgtaatcccagcactttgggagactgagctgggcagatcacttggggtcaggagttcgagaccagcctggccaacatgatgaaacaccatgtctactaaaaatacaaaaaattggctggcatggcggcgcatgcctgtaatcccagctactttgggaggctgaggtgaaagaattgcttgacccaggaggcgaaggttgcagggagccaagattgtgcccctgcactccagcctgggtgacagagtgagactctgtctcaaaaaaaaaaaaaaaaaaaaaatctatctgaaaaagatagtataaatattaaataaaaaatcgagatgacacaaccagtatcaagaatgacaaaaaaatgagtaaaattttaggtcttgtgtacatttaaaagatcctaaatggatattatgaacaactttaattcaatgatttctaaacatttagatgaaatagataaattcttagaaaagtacaaaataaaaactaaaaacaaaaagaaattctgaagtcatataactattaaatattaaattgctaactaaaaaccttaccacgaaaaggactccaggtccagactgcttcactaagtctaccaaacacttaagggagaaataatgtaatattttacacactcttccagaggagaataaaggagggaacaattcccagtttgttctatgaggcatcataatcttgctacaaaaacctgacaaacacattatagaaaaggaaattacataggccgggtgcagtggctcacgcctgtaatcctagcactttgagaggccgaggtgggtgcatcatgaggtcaggagtttgagaccagcctggccaacatggtgaaacctcatctctactaaaaatacaaaaattagccgggagcagtggcaggcacctgtaatcccagctactcgggaggctgaggcaggagaatcgcttgaactctggaggcagagattgcagtgagccaagaaaacaccactgcacttcagcctgggtgacagagtgagactccatctcaaaggaaaaaaaaaaaaaaaagaaaagaaaaggagattacaggctggccatggtggctcacacctgtaatcctatcactttgggaggccaaggcaggaggatggcttaaggccaagagtttgagaacaacctggtgacatgtcaagactcctgtctctacaaaaaattaaaatattaaccaagtgtgatggggcacacctatacttgcaggtacgtgggatgctgaggagagaggattgcttgagtctaggagtttgaggtatcagtgagctatgatcgtgccactgcactccagcctgggtgacagagcgagtccctgtctcaaaaacaaaacaatgaaaaaaaaaaaagaaaagaaaaggagattacagggtaatatcactcattaacatgggagaaaaatttctaaacatagtattagcaaacaagaaaatcttgcattatataaaagtataatgtatcacagccatgttgagttcagttcaggagttcaagattggtttgttatttggatatcaatcactgtaatttatcacattaacaggatagaaaagaaaatatgatcatttccatagtttcataaaaaattttttaatcggccgggtgtggtaccccaggcctgtaatcccagcactttgggaggccgaggtgggtggaccacctgaggtcaggagtttgggaccagcctgaccaacatggtgataccccatctctgctaaaaaaaaaaaatacaaaattagccaggcgtggtggtgcccgcctgtaatcccatctacttgggaggctgaggcaggagaattgcttgaacccgggaggcggaggttgcagtgagccgagatcgcaccataaactccagcctgggcaagaagagcgaaactccatcccccacccaaaaaattgtttaataaaacttaacattcatcattttaaaaaactgccttagcaaataggaatagaaggaaacttccttcatcagatgagggttatcctccaaatgaaaggggagcctttgacatctctggtatcagtctgtttgcttgatctaactcagatcagctgaaccttcttgctcaacgctgaaagtgtggaggaagtgagcttcccaagacattatttgtctcactacactcctatagataaatctatgtgggatgttaactgataatcagaaggttgctttgtgagaatgcagtcagaggggaatggatgagatgattttcatagccaatatcttttaactatgaaaagctgatatttacatagatgggaacactgaatggtatggtgaccatttctcttctgttaatacattgtttctttagactgagtgtaatactgccatggctttacacatgctaatactgtataatcattctctagttcctgttggctctgtcattcaactttggatctctcagtgagccagactgtttattcatgctacattttttatatcctatgaccttttcttggaatgacctccccatccttacaccatctcctatcttcattcacttagcaaactcctatttcttcttctacaaaccaactcaagtattttccctctgaagttttcccttctgtatgttctaattgtatcttgcctatcttctgtaatagtacttatcacactgtattaaaatgttcttaacattcaactcagcaattccattgctgggtatagacccaaaggaaaataaatcattctaccaaaaaggcatgtacacttatgttcattgcagcacttcacaatagcaaagacatggaatcaacctaagtgcccatcaacggtggattggataaagaaaatatggtacatatacaccatggaatactatgcagccataaataagaattaaatcatgtcctttgcagcaatatgaatgcagctggaggccatcgtcctaagcaaatgaatgcagaaacagaaaactaaatatcacatgttctcacttataagtgggagctaaattttgggtacacatggacataaagatgggcacaatagacactggggactacaaaagtggggaggagggaggggtaagagctaaaaaacacactgggtactatgttcactatttgggtgatgggattaatagaagccccaaactcagcatcaaacagtatacccatgtaacaaatgtgcacatgttccccctggatctaaaataaaaatggaagcagagtgcggtggctcacgcctgtagtcccagcactttggaaggccgaggtgggcagatcacttgaggccagaagttcgaggccagcctcatcaacatggtgaaatctcgtctctactgaaaatacaaaaaattagccgggcgttatgacacgcacctgtaatcccagctacttccgaggctgaggcaggggaatcacttaaacccaggaggcagaggttgcagtgagccaagactgcaaccctgcactccagcctgggcaacagagcaagactctgtctcataaaataaaataataaattttaaaaactggaaattaaaaaagaatgtttggttgtctctccatattagattttgaatttcttagaagaaggttctaagtgctttatatttgtactcctagtatttgaactcaatgaaagtttattaagtttattaagtaaagaaatacatgaatgaatgaaaatgagtaagcaacgattgagtgagtgaatcagtagggctctcctgtcttgtgaccaccacgtgtgttctctcctcagcactcatgaactcattctagctggtaatgaaaacttctctggttgggcacatagaatttacaatcaatagttaactctaaattgaacttataattgaattttataatgcttctacattcatgggcattcaaaatgctgacttcccagatgcatgtcataaccttaatttttaatttcatcctatttctaagtgacatggaagagagaagatgtaggatgagttgaaagttttgtggaatagctttaattaggtatgtaaaagagcctgaaaaaacagtttaaaataagattctgttcaggaccaagatacagtattaattcctaattaagttcagcagtttaatacccaagcaaatgagtgagagcagagttgcggggaagtggagagactacttcttcccgacccttcactcatggcatgtatagaaaatgatataatttatagcacactagggtgaatggatctggctgcttgctattgcaggctagtggcccaaggggcctggctgccccaggctccccatggctgtgctgagaactaaggagaccaggatctcaggacagccataacccctttgcagtagactgctggggaaactctgaagcttaataagggaagttgagtgcacctgcaaggacttatggtcctggtccccacccaacctaacaaaccaggaagggtttgcagtgagaaagaaagatatgtgctatttaagtgtcagagctaggattgtttaggccagtgatttttttttttttttttttttttgagacggagtttcactgttgtcacccaggctggagtgcagtggcgtgatctcagctcactgcaacctccgcctcctgggttcaagagattctcctgcctcagcctcctgagtagctgggattacaggcacccaccaccacacccagctaatttttgtatttttcgtagagatggggttttacaatgttggccaggctggtctcaaactcctgacctcaggtgatccacccgcctcggcctcccaaagtgctgggattacaggcgtgagccactgtgcctggccaggccagtgattctgaatacatattgtagtcgcctggcagcttttaaaatctaaaaacatagcaatgtgaagaccagaccctcgtacaattaaatcagaatctctgtggagaagggtatggggcagtattagtatttttaaaaaagtttccacaggtggtttttataatgtctcagagttaaggacctctgatatatgcagagactgatgataaaaacagtttacgaagggacataaatctaactgtagattttttttcaattgtcttaatttaacacttatgtttcgtgtttttaacagaaggttttttgtttttattgttgtagacagatgtaagccagtcagtagctgggcttcatcttgcatattcctaggaggaaatatgtttatgaagtgatggcaaacgcggctgctgcattggtcaggaatgataaccgcagaggaatttaaacccagccttaaggagtaggtagaatttacagttgcagaagtggagtattgtcggggctctgcattctaaatggaggaacagcgtaagtacaagtgaggaagaggtagaagacaatttcagagaagagcgctacagagtctaagatgggggcccaatagcaaatgaaggagcggccaaagccagccatctcggaagggatgagagaccagtccacggacacagcctttccacacttctgtatcctgtagcagctgcaagtgatcatgcccaggcgcctttcatcatgtgtcatcaggaaggcctgactacagataacatttattgagtgagcactaactacatgccaggaatattccctaagcatttcgcatgagttaactaatttaatcttctcaacaagctcacgagataggttctattattatccctgttttatagatgaggaaagtgaagcacagtaggttgacattttttgtgacctctctctattcaatgacctgttttctctttatcatgactcagagttcccaagatctatttgccgaacagtgaattattgttaaaacaggaatttacctgtaggggtagggtgcaggtacacacttggaaagaatgtcagatagggattagagagctaaggattttgaacatcttttttttttttttcttctgtggatatgaagaatttgctgagattttaaagcagggggtggcatactgagctggttagtaaagccagtctgggaggatgcggcacagtgggttaagagtgggggaaaatgaggtacctgtgataccagctgaccagttaggaagttaatggcagtgactaggagggaagtggtgaaaagctgggtgaggtggcgatcgtggtaacagagagagcacagatacaagagttattatgaagatgctggtgactagagtgggcttgagtgactgctgagtcccgacaagatcaggaaggcaatcctgatgagagaaggtggtaaatttaactttagcttttttgagtttgtggaatagtgagtcattccagcctgggatgtgtcattgtattgggtatcctgactttggtttttaaactttatttgatatacatccctctttttgacatggaaggcaatattgatgtctgtattttaatttcacattaatcctttacctggtaaaaatgtatttacttattctattaattagtattattttattatgataatatataattaatattgttatttgctataggttatcagaccaggatgaagagggaaagatcaagcaggagtatatcatatctgacccctccttttccatggtgacagtccaaagggaagatagtgggataacctgggaaaccaattcaagtagatcttctactccttgggcttcagaagaaagtcagacttctggtgtgtgtagtcgggaagggtcaactgtgaattctcctcctggaaatgtttcctttattgtggatgaagtgaaaaaggttcggaaaaggactcataagtcaaagcatggttcaccatcattacgccggaaaggcaacagaaaaagaaattcttttgaatcccaagatgttccaacaaacaaaaaaggcagtcctttaacttcagcaagccaggtactaaccacggagaaagagaagtcatatactggcatttatgataaagcaagaaaaaagaagaccacttcaaatacacctccgattactggggcaatatacaaagaacacaagccattagtgttaagaccagtctacataggaacagtacaatataaaattaagatgtttaattcggttaaagaagaattaattcctctacaattttatggaacattgccaaagggttatgtaattaaagaaatacattataggaaagggaaagatgcatccattagtctagagccagatttggacaatagtggttctaatacagtgtccaaaacacgcaaattagtagcccaaagcatagaggataaagtaaaagaggtttttccaccctggagaggcgcactctccaaaggatcagagtccctaaccttaatgttcagtcatgaagatcaaaagaaaatttatgctgattctcccctaaatgccacatctgcattggagcacacagttccctcttattcaagtagtggcagagcagaacaaggaatacagctcaggcattcacagtcagtgccacaacagccagaagatgaagcaaaaccacatgaagtggaacctccatctgtgacacccgacacacctgcaactatgttcctgagaacaacaaaggaagaatgtgagcttgcttcaccaggaactgcagcttcagagaatgactcttcagtctcaccatcatttgctaatgaggtaaagaaggaagatgtgtattctgctcaccattccatttctctggaggcagcgtcaccaggtctggcagcatctacccaggatggtttggacccagaccaagaacagccggacctgacttcaatagaaagggcagaaccagtctccgcaaaactgacccctacccatcccagtgtcaaaggagagaaggaggaaaacatgcttgagccatccatttctctttctgaacctctaatgttagaagaaccagagaaagaagaaatagaaacttccctacccatagctattacccctgaacctgaagattctaatttagtagaagaagagatcgtagaacttgattacccagaaagcccattggtttccgagaagcccttcccaccacatatgtcccctgaagtggagcacaaagaagaagagcttattctaccattattggcagcatcatctcctgaacatgttgctttgtctgaggaagaaagagaggaaattgcatctgtttctactggttctgcttttgtatcagagtattcagtaccacaggatttgaaccatgaattacaggagcaagaaggtgagccagttcccccatccaatgtagaagctatagctgaacatgcagttttgtcagaagaagagaatgaggaatttgaggcttattccccagctgcagcccctacatctgagagctctctctcaccatccacaactgagaagacttcagagaaccagtctccactgttttcaacagttacaccagaatacatggtcctatcaggagacgaggcctcagaaagtgggtgttacacaccagactccacatctgcttctgaatattcagttccatcactggcaacaaaagagtcactgaagaaaacaattgaccgtaagtccccgttaatattgaaaggtgtttctgagtacatgattccatcagaagagaaggaagacactggatcgtttactccagctgtggcccctgcttctgagccctctctctcaccatccacaaccgaaaagacttctgaatgccagtcaccactgccttctactgccacatcagaacacgtggtcccatcagaaggagaggacctaggaagtgaacgtttcacaccggattcaaagttgatctccaaatatgcagccccactcaatgcaacacaggaatctcaaaagaaaataatcaatgaggcatcccaattcaaaccaaaaggtatttctgagcacacagttctgtcagtagacggcaaggaggtcattggaccatcttccccagatttggttgttgcatctgaacactctttcccaccacacacaaccgagatgacttctgaatgccaggccccaccactttcagccaccccatctgaatatgttgttctatcagacgaagaggcagtcgagttggaacgatacacaccctcttctacatctgcttctgaattttcagtaccaccatatgcaacaccggaggcacaggaggaagaaattgtccatagatctctaaatctaaaaggtgcatcctcacccatgaatttatcagaagaagatcaagaagacattggacctttttctccagattctgcatttgtgtcagaattctcatttccaccgtatgcaacccaggaagcagagaaaagagaatttgagtgcgattctccaatatgtttaacatcaccatctgagcacactattttgtcagatgaagacactgaagaagcggaactgttctctccagactcagcatcacaagtttcaatccctccctttagaatctcagaaacagagaaaaatgaacttgagcctgattcactattaactgcagtgtctgcttcaggttattcctgcttttcagaagcagatgaggaagacattggatccacagctgctacacctgtatctgagcagttcagttcatcacagaagcaaaaagctgaaactttccctttgatgtctccgcttgaagacttaagtctgccgccttcaacagataaatcagagaaagcagaaattaagccagagattccaacaacctcaacatctgtatctgaatatctcattttggcacagaagcagaaaactcaagcatatttagagcctgagtctgaagacttgattccttcacatttaaccagtgaagtggagaagggagaaagggaggcaagttcatcagtagctgcaatacctgctgctttacctgcacaatcatctatagtaaaggaagaaaccaaacctgcatctccacattcagttttacctgattcagtccctgcaatcaagaaagaacaggaacccacagcagcactcactctaaaagctgcagatgaacagatggctttgtcaaaagtcagaaaggaagaaattgtgcctgattctcaagaagctacagcacatgtatcacaggatcaaaaaatggagcctcagcctccaaatgttccagagtctgagatgaaatattcagttttgcctgacatggtagatgagccaaagaagggtgtcaagcccaaattagttctaaatgtgacttctgaactagaacagagaaagttgtccaagaatgagcctgaagtaataaaaccatattcacctctaaaggaaacatctttatctggacctgaggctttatcagcagtgaaaatggagatgaaacatgattccaaaataacaactacacctatagtgcttcattcagcttcctcaggagtggaaaagcaagttgaacatggtccacctgcactagcattttcagctttgtcagaagaaattaaaaaagaaattgaacccagttcctcaacaactacagcatctgtaactaagcttgattcaaacttaaccagagcagtaaaagaagaaatcccaacagattcatctcttatcactcctgtagatcgtccagtcttaacaaaagtaggaaagggtgaattaggaagtggtttgccaccactggtaacatctgcagatgaacattcagttcttgcagaagaagacaaggtggcaattaaaggtgcttctcccattgaaacttcatccaaacatttagcttggtcagaagcagagaaggaaattaaatttgattcacttccaagtgtctcctctatagcagagcattctgttttgtcagaagtagaagccaaagaagttaaagctgggttgccagtaatcaaaacatcatcttctcagcattcagataaatctgaggaagcaagggtagaagacaaacaagatcttttattttctacagtctgtgactctgaacgtttggtttcatcacagaagaagagcttgatgtctacctcagaggtgttagagcctgaacatgagcttccactcagcctatggggtgagataaagaagaaagaaactgaacttccttcatcacaaaatgtgtcacctgcatccaaacatataatcccaaaaggcaaagatgaggaaacagcaagttcatctcctgagttggaaaatttagcatcaggtttagccccaacattactgctcctcagtgatgataagaacaaaccggcagtggaggtatcttctacagctcagggagacttcccatcagaaaaacaagatgttgctttggcagagctgtctttggaacctgagaagaaagacaagccacaccaaccgttggaattaccaaatgctgggtcagaattttctagtgatttaggtagacaaagtggatccataggtacaaaacaagcaaagtctcccataactgaaacagaggattctgttttagaaaaaggcccagctgagcttaggagcagagaaggaaaagaagaaaatagagagctttgtgcatcttctacgatgcctgcaatttcagagctttcatcattgcttagggaggaatctcagaatgaagaaattaaacctttctctcccaagatcatcagcctagagtcgaaagaaccacctgcctctgtagctgaaggaggcaacccagaagaatttcagccatttactttttctttaaaaggattatcagaggaggttagccatccagccgactttaaaaagggaggaaatcaagaaataggcccattaccaccaactggaaatttgaaggcacaagtcatgggagatattttagataagctaagtgaagaaacaggccacccaaattcatcccaggtactccagagtataacagaaccatcaaagattgctccttctgacctccttgtagaacaaaaaaagacagaaaaagcacttcattcagatcaaactgttaaattacctgatgtaagcacctcttctgaagataaacaagatctgggtattaagcagttttcacttatgagagagaatttgcctttggaacaatcaaaatcatttatgacaaccaagcctgcggatgtcaaagaaacaaaaatggaagaattctttatttctccaaaggatgaaaactggatgttgggaaagccagaaaatgtggctagtcaacacgaacagagaatagcaggatctgtgcagctggattcctctagcagcaatgagctgaggccagggcagctcaaggctgctgtgtccagtaaggaccatacatgtgaagtgagaaagcaggtcctgccgcattctgctgaagaatctcatttgtcatcacaagaagcagtatctgctcttgatacttccagtggtaatacagagaccttatcaagtaaaagttactcttctgaagaagtaaagctggctgaagaaccaaagtctttagtcctagctggaaatgtagagagaaacatagcagaggggaaggagattcattctttgatggagagtgaaagtttgctattggagaaagcaaacacagagctttcctggccttccaaagaagatagccaggaaaaaattaaactacctcctgaaagattcttccagaaaccagtgtctggcctatcagtggaacaggtgaagtcagaaacaatctcctcttctgtcaaaacagcccatttcccggcagaaggtgtggaacctgcattgggcaatgaaaaagaagcacacaggagcacacctccttttcctgaagagaagccattggaagaatcaaaaatggttcagtcaaaggttattgatgatgctgatgagggaaagaaaccatcacctgaagtaaaaatacccacacaaagaaaacccatctcctcaatccatgcaagagagcctcaatccccagagtcacctgaggtgacacaaaatccacctacacaaccaaaggtggctaagccggaccttcctgaggaaaagggaaagaaaggaatttcatctttcaaatcgtggatgtccagcttgttttttggatcgagcactccagataacaaagttgctgaacaagaagacttagaaacacagccaagtccatccgtagaaaaagcagtgactgtgatagatcctgaaggtacaattcccaccaattttaatgtagctgagaaaccagctgatcattcattatcagaggtaaaacttaaaactgctgatgaacccagaggtactttagtaaaatctggtgacggtcaaaacgttaaagaaaaatccatgattttatcaaatgtagaagatttacaacagccaaaattcatttctgaggtgtctagggaagattatggaaaaaaagaaatctcaggcgattcagaggaaatgaacataaactcagtagttacttctgctgatggtgagaaccttgaaattcaatcttattcactaatcggtgagaaattggttatggaagaagccaaaactattgttcctcctcatgttactgatagtaaaagagtccagaagccagcaatcgctcctccatctaaatggaatatttctatttttaaggaagagccaagaagtgatcaaaaacaaaaatcactcctttcatttgatgtagtagataaggtgccacaacagccaaaatcagcttcctccaactttgcaagtaaaaatatcacaaaggaatcagagaaaccagagtcaattattttgccagtagaagaatcaaaaggcagtttaattgatttcagtgaagacagactcaagaaagaaatgcaaaatcctacttccttgaaaatttctgaagaggaaacaaaactcaggtctgttagtccaactgagaagaaagataatttggaaaacagatcatataccttggcagaaaagaaggtgctggcagaaaaacaaaactctgtggccccattagagcttagagatagtaatgaaatagggaagacacaaattacacttggatctagatctactgaactgaaagaatcaaaagccgatgctatgccacagcacttctatcaaaatgaagactacaatgaaagacccaaaatcattgttggttctgaaaaggagaaaggtgaagaaaaagaaaatcaggtatatgtgctttcagaaggaaagaagcagcaggaacatcagccttattctgtgaatgtagccgagtctatgagtagagaatcagatatctctttaggtcattctttgggtgaaactcaatcattttcattagttaaagctacatcagttactgaaaaatcagaagccatgctcgcagaggctcacccagaaatcagagaagcaaaggcagtaggaacccaaccacatcctttagaagaaagtaaagttttggtggagaaaaccaagactttcctgccggtggctctttcttgtcgtgatgaaatagagaaccactctttatctcaggaaggaaatctagtattagaaaagtcaagcagagatatgccagatcacagtgaagaaaaagaacagttcagagagtcagagctatcgaaaggcggttcagtagatatcacaaaagaaactgtgaaacaaggatttcaagaaaaggcagtaggaacccaaccacgtcctttagaagaaagtaaagttttggtggagaaaactaagactttcctgccagtggttctttcttgtcatgatgaaatagagaaccactctttgtctcaggaaggaaatctagtgttagaaaagtcaagcagagatatgccagatcacagtgaagaaaaagaacagttcaaagagtcagagctatggaaaggtggttcagtagatatcacaaaagaaagtatgaaagaaggatttccatctaaagaatccgaaaggactttagctcgtccttttgatgaaactaagagctcagaaacaccgccatatttgctgtcacctgtaaaaccacaaactcttgcttcaggagcttctccagaaattaacgcagtgaagaaaaaagaaatgccacgatcagaattgactccagaaaggcatacagttcatactattcagacatctaaagatgacacatccgatgtgcctaaacaatctgttcttgtttcaaagcaccacttggaggctgcggaagatacccgtgtaaaggaaccactgtcttcagcaaaaagcaactatgctcaatttatatctaatacatcagcaagcaatgctgataaaatggtttctaataaagaaatgcccaaggaacctgaagacacatatgcaaaaggtgaagactttacagtgactagtaagccagccggactttcagaagatcagaagactgcctttagtatcatttctgaaggctgtgagatattgaatattcatgctccggcctttatttcttcaatcgatcaggaagaaagtgaacaaatgcaagataaattagaatatttggaagagaaagcctcatttaaaaccataccactccctgatgatagtgaaacagttgcttgtcataaaacattaaagagcaggttagaagatgaaaaagttaccccattgaaagaaaataaacaaaaggaaactcataagacaaaagaagagatatccacagattcagaaactgatttatcatttattcagcccacaattcccagtgaagaggattattttgaaaaatatactttgattgattataacatctccccagacccagaaaaacagaaagctccacagaaattaaatgttgaagagaaactctcaaaggaagttacagaagaaactatctctttcccagtaagttcagtggaaagtgcactagaacatgaatatgacttggtgaaattagatgaaagtttttatggaccagaaaagggccacaacatattatctcatccagagacccaaagccaaaactcagctgacaggaatgtttcaaaggacacaaagagagatgtggactcaaagtcaccggggatgcctttatttgaagcagaggaaggagttctatcacgaacccagatatttcctaccactattaaagtcattgatccagaatttctggaggagccacctgcacttgcatttttatataaggatctgtatgaagaagcagttggagagaaaaagaaggaagaggagacagcttctgaaggtgacagtgtgaattctgaggcatcatttcccagcagaaattctgacactgatgatggaacaggaatatattttgagaagtacatactcaaagatgacattctccatgacacatctctaactcaaaaggaccagggccaaggtctggaagaaaaacgagttggtaaggatgattcataccaaccgatagctgcagaaggggaaatttggggaaagtttggaactatttgcagggagaagagtctggaagaacagaaaggtgtttatggggaaggagaatcagtagaccatgtggagaccgttggtaacgtagcgatgcagaagaaagctcccatcacagaggacgtcagagtggctacccagaaaataagttatgcggttccatttgaagacacccatcatgttctggagcgtgcagatgaagcaggcagtcacggtaatgaagtcggaaatgcaagtccagaggtcaatctgaatgtcccagtacaagtgtccttcccggaggaagaatttgcatctggtgcaactcatgttcaagaaacatcactagaagaacctaaaatcctggtcccacctgagccaagtgaagagaggctccgtaatagccctgttcaggatgagtatgaatttacagaatccctgcataatgaagtggttcctcaagacatattatcagaagaactgtcttcagaatccacacctgaagatgtcttatctcaaggaaaggaatcctttgagcacatcagtgaaaatgaatttgcgagtgaggcagaacaaagtacacctgctgaacaaaaagagttgggcagcgagaggaaagaagaagaccaattatcatctgaggtagtaactgaaaaggcacaaaaagagctgaaaaagtcccagattgacacatactgttacacctgcaaatgtccaatttctgccactgacaaggtgtttggcacccacaaagaccatgaagtttcaacgcttgacacagctataagtgctgtaaaggtaaatagatgttgaacacacataattaataatatatatatacacatttaatttgcttttacattttctcaattttaaagatgattaatatttgatcattgatctttaagcagaatggtctgaaagcaaactaagaatatttctccaagaatttagttaaggtaggcttgacagacattcattgagtacagcccaccctccttatccttgagttctgcatgcttagaatcaaccaaccgcagatcaaatatatccaggaaaaacacacacacacacacacacaaaacaataagagggggctgggtgtggtggctcacacctataatctcagcactttgagagaccgaggtgggaggattgcttgagcccagaagtttgagaccagcctgggcaacatggggagaccttgtctctactaaaaatacaaaaattagctgggcatggtggcgcacacctgtagtttaagttacttggggggctgaggtgggaggatcagttgagcccaggaggtcaaggctacagtttgctgagatcccgccactgcactccactctaggtgacagagtgagaccctgtctcaaaaataaaataaaataaaaaataaataaaaataacagcaataaaaataatacaaataaaaacaatatagtacaactatttacatagcatttatactgtatcaggcattataagtaatctagagattatttaaagtataggagaggatgtatgccggttatatgaaaatactatgccattttatatcagagacttgagcatcttcatattttggtatctgctgacatcctgaaaccagtcctctgcagatattgaagacaactgtacacactgtgtgccacacatttttctaggcctaggggctagcaagagagacaacacagggtcactgcccttgaggagcttggtattttatggcaatagtccttaacattaccaaaaatgccaaataatttgaaatttaaaaaattacctttgagcaaaaaactgcaaaaagcagtttccttcctatttatctacaatatcatcctttaaagagacacatttacaatacattgagacatttcattgcaagttatatgtaaataatacattaagacagtttaagattttactttctttgtatttccttttaatttataaaattcatgttagaagcagaaatttttttgcattctttctggctatgtctgtaggaccccagtgttccagataagttagtcccaacatgtatcctcctgtaagtaactataaatactccacttccctgagatactattggaatgtagtctttgagactctcctctacctttccatagccctcctactggtctcaccattctcacctctttaatccattctccatagggcagctggaattatcttaaaattactaaataacaataacgattgaggatttactctgtgccatgcactatttttttgtttttgtttctgttttttagagacagagtctccctgtgtcacccaggctggagtgcagtggtgtaatcacagctcactgcagccttgacctcccaggctcaagtgatccctctacctcagcctcccaagccccaagtagctgggaatatagtcatgcactgccacactgggttaattttataattttttttgtacagacagggtctccctgtgctgcccaggctgctctagaactcctgggctcaagccatcctccctctttggcctcccaaagtgctgggattacaggtgtgagtcacaatgcccagtcttaagttctttatatacaggatatcttttagtctttctaacagctctgtcactgtcattagtttgcagataataaaatcgtctcagagagtttaaatgatttgcccaaggtcatggaaggcgaaactggggctggtacccagatctttctgatgccagagctcatgttcttgactatatacgcatactgcttggctcagtaccttgataatggtagtgattttcaatatgatcattcaattaggtccttgttaaataattatcagactcattttgattcaacagataacatattagaatcttggcattttttaactcccaaattaatccttctcaacttgtctgatattggttctagttctccagggtatagttttgttgaaactttacttgttaaagtttggggttagggagtagggcaacttcttttgtgaaatctcagacgtcacatgcatgagctacagtggaagtgggccccattctgcggtgatactttgttttaactcacaactactgagcactgccagcagaaagaagactgaatttttttggtcttcttaatatgttttgtttatctctatgagttttagatattaaaaaataatcatctaagtattatcaatttaaaacaaattttataagtagagagatatgatgtctcctgccttaaaatcatttttaaagttttttttaattcttgatcttctctaaacagtatgagaaggagaaggtgggaacccagttgactaaagccaagcagctagcttcatttcattaagtcagccatgaagattagtaagagttgtttggttggcaattcctcctcctactgctcctttctcctccttcctcctcctcctccctctttctcctcttcttcttcttcttcttcttcttcttcttcttcttcttcttcttcttctttcttcttctcttcttcttcttcttcctcctcctccccttcttcctccccctcttcctttcccccctcctcctcctcttcttcttcttccttttttcttctttcttctttgacagggtctcactctgttgcccagggtagagtgcagcggcgtgatcatcatagctcgctgaagcctcctgggctcaagcaatcctctcgcctcagcctcctgactagctgggactagagacacatgccatcacacccagctactttttaaatttttagtggagacaagatgtcagtatgttgcccagtctggtctcgaagtcctggctaccagcgatcttcccacctaggcctcccaaagtgctgggattccaggcagtagccactgcagctggccagttggcaactttttaaaaataaaaatcaatttaaaaaattgtagcttgagaattttctagcatcttaagggcaggcatttgtgcctgttccaggagccaatggctgcagttacagatcacccaagtccttgtgtctcctccccagtccatccccatcatgtgcttatcttttgtctgttatttattttcttcatttactcactcccttcctgcattctcagtgtttatttatctcccattgtgtgtcaggaactgtgccaatcattgagagtgaaaaaaaaaaaaggaagatggacttgtagattcccaaaatcaatacaatgttgcgaaagcccaatgttctgagaaactaaccttttgggagtgaaacggtggggtaggaaggggaatgttagcaaaggtgtctctaaaaggtgatgcttgggtgagctttaaatgagatagagctcttctagcagtcaagggcagggacaacattctagagccaaggaataccatatgaaggcacacagatgagaaagagtgcaatgacgaagcctgtgtgattggagcctgggggctgtggagaagaggtaagggccatagagggaagtagagaccagatcctgaagaggcctccatcaatgttgtatctccatcagtctgtggtagtgaatcagacagctgaagctctgctattttttctgctttgttattttttaagtttagcaagattggctgttgctaggtttataattacggctaaagtgggtaccatgctcccctatcaccccatacgttttctagttggctattaccccttgagtattttaaccctttgagggtcattagaacttttaggtccctttagtaggcagtttctctcagttggtatgctaaatttcaggccttgtggcactctgatcaccttctcaggccattagtataaatgtgaagaaattactcaggtatattggaccagtttagcaaaaagactcctctctcagaacatataaaaaccaaggtcttactagagagaacgcattcaaatctatagttcattaaaacaggtatgttttgagctcatcagtttatcaagaaagtccattctttcacttacgaagatatactgtctttgtgtagttgttttgaggttttcactcaaaacctcctaattatcatacagaattatctatagtcagatgaggcagtaaagaaaatttaaggattgatttgttagtggatatagtatagtaagtctctacgaaacatactaaatttataaggaacttggagctcactggttgaagttctcttcctaaatgtcatatactaaggatatcttaattcttttcttcaggttcaattagcagaatttctagaaaatttacaagaaaagtccttgaggattgaagcctttgttagtgagatagaatccttttttaataccattgaggtaagttaacacacccattttaccttaacctggcttgttcacagtatcagaagtaaatgattctgaggtgaagggatctgacttggggattttatgcgcatgtgttgtttgccattgttggttcggttccattcaaagcgagaatgcttaaagtcttctctctgtgcataatgagtgagattcctttctgcctatggataaaagatttgccggtaacgacagacatgcatttattaacacttactataatagggcaaatgctttacatgctttacctgactgaatcctcacaattatatgagataggtgttattattgttccaattgtatagataagaaaccaagtcttagagtacattcctcattttcatgcctctcactgggttaactctgcagaaatgctctgagtcactgcccagtgtcccatgcccagggccagtgagtgcctctcatagcacgactatctctgatgagttcatactctcctagctgctggctcttatcccttctgcagggaagagagggactagcaatgctccatccttatacagagatggcccaggcaccctcaccagtcaatcaggactggcagagggcctgaggccactgcagaggctgctgcacagtttccctactactggggccgctccacatgctggtttgcttgtaagaggtctgcttaattcatgttgtggatcaactagtacatgctagttatttcgggtgtcaccttccccaggtgtcctttttagggagtaaattatgggatcatcttattactagccccactagtgaggatagccaggcatctggatgtgtctggacaggcaacgaagtttctcccactgtgggataacctgccatctcactggagaacatttggggaggtagcccccattccatatctgggctttctgccttgcactgtgattttagtggactgatgcatttccaccatctgaaggccagggatgctcactcaacgtgatgccattttcaagtttcatcatgtgtgagtgcaggtgggcaagacttccatatgaaaatatatatattttgtattatggtagctaaaactttcttgatgatactgttacagtaaattctattgctttattgcaaaactaactgtgggaaagggattggtaggttagaaatttgaactgtgcatgtgatgtctgattctctgatcaggatgccagaggtcaattctttaaaaggctggtgtttccaaaaaaaaaaaaaagcagcatttcttgtttcattcagaagtgggcttttttgcttgtttgttttcaggaaaactgtagtaaaaatgagaaaaggctagaagaacagaatgaggaaatgatgaagaaggttttagcacagtatgatgagaaagcccagagctttgaggaagtgaagaagaagaagatggagttcctgcatgagcagatggtccactttctgcagagcatggacactgccaaagacaccctggagaccatcgtgagagaagcagaggagcttgatgaggccgtcttcctgactgtaagtgccaagtaaaatgggctcaaacaccttgcgcccactctggcacatctacttttaaagcttcatttttcactattccttaagattatttatatctctgtgtgggatttatataattctggcatttaaacattatttgggcatgcctgatgcctatagaaaaggcccagcaaaccctgaaagcctcaatgcccagatccagctgaaagatacagctgaaagagacagcctgcagcatcatcatccattgcgtcccactggattcattggtcactgtctaagagggagggaaagaagccttgttcctgccatgctttccctctgagggccagctggcatcctcagcctggctcctggggccgtcctcttcactctctaagctgaagtgaccactcatatgggctgttccccctctgagcctggccaaggggctgagagtaacatttgggtgtgcaaaaggatgacataatggggtacccctctcaggtaataaatatgttggtgtttttacaaggggtttcttggggacaggattccttaattcaagcaggtaacttgtagacatggaaattcccttgggtgctcctcacattgcaccagcagagacacctctgtgctccctgcaattccctagaatattcagtgagatgctgggtctccatgaagccaggattaagcagaaatagtggagatgttttccctgaaggcagttccaagcctaattgtcacacagcaagaagcactgctcttaggatgactgggaacctccctttcaaagttccccatcctcctaccctttagaaaactttggagatacagcaaggcaaaacggaacaatgttagccttttgatttgcctctggggacagctcttgccagggcaaattttggtgaagtggacatggccattctcaaagagaactaaactcattacattgttttgtgtgtaattaaggcaaagcttcttattcataaattgggcactgtttgtgaagcataatgttaattaagtgctttttgttccctgagaaccttatctttgttctgtaagaataagaataatttacttctttctagaagagcaaactgtaaaaaaaaaaaaaaaaaaaaaaaggcatttctacttataaaagtaatattactcattttttaaaattggaaaatatagaaaagcacacaaaatatcactcagataaatactgattacagttttgatctctatccttcattgaaaacatttaagtcatttttcctgctttagagaattctattctggaagctaagccattggttgatgaatagagagaagcagagcataagcaactcattgccagtcccgctgatcacagagacagagccaactgcaaatgaaaccatcctccatccctgtcctgacactgcccatcccacccattccccctcccctgcaccccgccttgtgagcacttatgtccttgctgcccagactgagacaaaaacaacctcagggaagctgaggggttatgattttcaaacgtgggtaatcttaatgctcctggttgttttttctttctgttgttaattagcttctctctctctttctctctctctttttctctcttctcctcctccttcctctctctttctccctaagtcgtttgaggaaatcaatgaaaggtatataaaacatgatacaatgtagtggcaaacagcatgactggatgcttgctttttaatattttggtgctttatggaaaatgagctgccaattaaaaaatgcatttagtgggctacagtattttcacttttagacacagtgcttttaaaagctaaatgacagctttgaaagaaaactgcatgtgctttagttaaataacaattatcataatgtagatttttaactgcttcctcaagatgtattctgcattttcagcctaatctaggccatctttcctgtcactgcatatagaacattttgtagatgcttagatgcattggttaaacatgagtatttgaaagaatcattcatatctgccttgagtaattttatgatttatgtaattttaatgaactgttctatcattttctcttcaaaagatagtcatgcatttatcttctctttctgctcagctaacctaaatgaatctccctcctttgattttgttttgttttgttggtgtttttaacacttcatctaagagaattcttcattctttccaaaagcaaaacactcaacaagaaaacatgttgtctataaaaacatgtaacatcagatttatgtttatctttcagagcatttcatattataattatccaacagatctgacacgttcttccttttgccccatagcaagacctgaggtctttccttctggtttgagcctaatgttttctccttttagtgtaattttaaatgtaaatttctaaattgtaaataccatcttcagtttacttccatcccaattcaaattgtgatacagcatagagtaaaatcagaaatttgtatctataatgtattataatataaaaaaggatttagattagaaatatgatttttttaggtaattgaaatcacacagatgaatcctatttacctaaaacaaattctattcaacagaatattaccagttagtttttgaaaataatttgacttattgacattaatcaataagtgttttataacagtggctctgttatgaatagaattccccaaggagcttttaaaaatgctgatgcctgaatcttctgagattctgatttaattgctctggggtgtagatgagcatttttaaggcttcctagatgattctaatgcacagccagggttgaaagttctggtttatacaatctatccttcgtcccagtaattccccacactggctgtgcctaaatcacctgtgcaatttgtttaaccaaagatcctttggtcccaccccagatccactacatcaaaatttccagagtgagaccaggcatctgcttgttaccaattctcacagacgagtctaagacacaccaatcaggtctagaaactgatacccaggccttattccgagttccctatctatctatctatctatctacctatctatctatctatctatctatctatctatatttttttgagccagggtctcactctgtcacccaggctggagtgcagtggcacgatcttggctcactgcaacctccacctcccgggtttaagcaattctcctgcctcagcctccgaagtagctgggaccacaggtgcgctccaccgtgccctgctaattttttgtatttttagtacagatggagttttgtcatgttgcccaggctgatcttgaactcctcaggccaagtgatctgcccacctccagtttcctttattttaaacaaattattttttctaaatattattgacatttctttttatccaaaaagcacatggatttacagtgccattccatctatactggacagtgtagatgcatatttgcttacttatattttatccattcatggaagttactgctcagtaagaaaatttggtgagtgaaaagttgaaaaatgcaatagaatgtttttacctttctaaccatcagaatattgcaaatataaattgacatccacttaatactaaatactctttcttcggttttgtgcttaaatatgttcatctgtgtgtcattttaattaatttctatttcattgtccagttgacagtgaattaattttttgctaaagctgcctgtctcttaaaggagagtacacttgggctaaccattattttcctgtaaagaaaaaagacaacaaaattctgggatttggtgaagaaagatgaacaattaaagaaaccgctgtcaaacgttcatgtacacgtgcacacacttgatgaagctgggcgccatcactgaaaagctttccatgtcctcaagaaaacttctgtctcaaagtctcaatgttattgatgttcctttctataagaagtgctaattatctacagttggcccttgaacaacacgagtttggactgtgcaggtccactgatatgtggatctttttcaataaatatattggaaaatttttttgagatttgtgacagtttgaaaaaaactcaaagatgaactgcatagcccagaaatgttgaaaaattaagaaaatgttaggtatgtcacaagtacataaaatatatgtaaatattagtctattttatcatttactatcataaaatatacacaaatctattataaaaattaagaacatcaacatttatgcacacaaacaccaccgtccatagcaccatatgcagttgggagaaatgtaaacaaacataaagatacagtactaaatcataactgcataaaattaactgtagtaatactgtactactcaaataatttctacaactatactgctaccatactactttaataattttgtaaccacctcctgttgctgttgtgatgagctcaagtgttgtgaatctctgcttaaaaactgtgtcacgctaatcatctccctgtgagcagttagtctctccagtaaattgtatattgcagtaaaaagtgatctcctaaggtttttgcctattttttttttttttaccatattcggtgtgataccataaaccttgaataacgccatgatacccataggaagtggcactagtgatcctggatgtgctccccagaaacagagaaaagtcatgacattacaagaagaagttgaattgtttgatcttttcagtagattgaggtctgtagccaccgttgccttccatttcagcatttcaggtgattcatcttgtgaagagatgatgtaaacttaaggtattaataaatacagtacagtactgtaagtgtattttctcttccttatggttttctgaggaatttctcttttctttagcttatttgattttaagaatacagtatataatatgtatacaaaatatgtgttaatcaactcttgaggttattggtaaggcttccagtcaacagcagactattagtagctaagtttttggggagtcaaacagtacacatggattttcagttgtacagagagtcagtgccctaaaccccatcttgctcaagagtcagttgtggtttattttaccttgccactttttctccctcccttcatattacatctctaaaggcagtgcttgtatattaaatgctttttctcaacactaaaaatgcttaaattaaggaatgctgtcaagcatatttagactaaacatttacatatcttgaaaaacacatttgcttagaaaatgctgtttgttgaggggattcattttttttctccgttttgctcttttgtgttataataatgaaaggagttgcaaccattgtaagacctgcttctaaaaggatgtctgcctgccttttcatatgctgatgttaaactggaataggttcggtgcataagggaaaactctaacattttgcttgtggtacctaccatcagagcctttgtgctacaaaatgtcctacattaatacacatcagtgatgtgtatttttagagggcttagtgcatgtatggggcaccatttttgttcattctgagcctatcatttccgccctctccatccccacagtcttaatttaggctcgtgctgtcttccctcactagaccctatggggttctcccacctgacctcagacctccctcctctgcttaccctgatccttccttagacacttgccaagacagtcatctaaatttcccttttataacaattttgtggctctccctgccttaaaagacaaaattgaactctcagtgggtatgaaaggctctttatagtcaagccacaaacgacttttctatttcatccctgactgtctgtgtttcccaactcccacggtgccctctggccctcgaatgtgctgtacttggccgcatctccatgcctgggttcatacccttcttctatctgcaatgcccttacttgttctctcttctgcctaggaaactcccactcattaatacccagcccaaatgttacctcctctttgaagcccctctggaaccacctcccctaaatcaaatgatagtgaattttattgtttctgacagtagtaagtgtagaagtcactctttaaatattcagttttattttataatatttttccttcatactgaccataaatccaccatcactgagatcctgatatccacacccccacaaaactattggcctcttatttattcaaaatatgtttattaaatgcccaccatgtgccaagtaatgcattagaatacagtagtgaacaaaataaagtcctttcctgcatataaacggtattctggtgaagcagacggacaaaaaccgaagaggctgtgataagtctggggaaaacaaagcctagtgaagaatggagggggcaggcaaggctgtattagtagcgtactctctgaggagctgacatttgaacagagatctaaattaagtcaaggaaggagctgagcaagtgtctgggagaacaaagttccaacagcaagtgcagtgggtctgctgggaaaaccaagacatccatggaaatgaagcctttttgtcattgtttgtttaaatccacatttcatctggatacaaatacttagacttagcatcagttggcattccagctaatgagggtgttgagtccataaagctgttgatttagaaattgtggcttgtttagtcttttacgaatgataggctttatcctctcattgctctttccccagtacctagcacaatgcctgggacatagtaaataaacatgttttgaatgacaaaatgattagaagcttaatatcgaggtttgagaacaaggacatctgcagtgtgtaagtttctagatgtgctcttagcatttttatcctttgaagcctcagtgggtatgaaaggctttggatataaatcctttccctttaggaaataaagaaaataatccctaaaatgaagtaatttttaggaccaactttataggtaaaacacttaagactgtattgcttgatagaatctttctaactagaggatataggaatgaaatttccaatattaccagttgcctaagaatagattttagacatatatttcaagactttaaagctttaaatccttttttggatagagtgagaggccctgccttatgcaaaccaccactaccaacaccagcttcattttgaacaatttttttcactttcattctgtatgttaataattttttaacttatgtagagctctattccccgataggttgctttctgcaatggagagcactgcttctttagagaaaatgcctgctgcgttttcccttttcgaacattatgatgacagctcggcaagaagtgaccagatgttaaaacaagtggctggtaagcattttaatatattaattacctagatgaaatatggcagtttttgcttgtttgttttgtatgtaatgatatatacaaaagattttgagtgtaaagacatgtaactggaaaaagaaaagtattagttgtaaaatgttacagctagactctgaaattgagcatgggaggaacatcccatttctgtgcatttccatctgaagctttatgacttgcttggagattgaggaggtggaaggagccatggaaccaaagggtctcctctttttttttttctttaatttaaaaataggatttctctccctctcttctcatttgcctcataccagcagccaggtatagaagaaaaaagaagtcaaatgttttcctacgtgtcaaacagatttctctttatgagtggttttcccctcttcaattcagttcttttccccttttttcaaactaaacagatgagcttagagaactatcagctcagcaccatggtctgtagccaggagcctcccactcagctgtcagaagcatcctgccagctcttcacaatattttttaatgtgctattttaacaaacaggacaatgaaacttatttagatttttcaaagctgccatgtttcagtgaagttaccaagtttttcttactgtacaacatgctcaggtgtcctccttaaaagatgctgtagtcttccaaaatcacctcaaagattacagctattcaggaggctgaggcgggaggatcacttgagcctaagggttcgaatccagcctgggcaacatagtaagacccccatgtctaaaaacaacaacaacaacaacaaaaaaccccaaaaaacaaaaacaaaaaagatggctgttgtgtttaaattgatgattaacattcattcctgtacaaagagttttaatttagtaactactaaaaaggctactgtatgtctaaaaagacaaaaacaacacgacaccacacaacacacaaaaacccaaaaccccaccagccctttataaaattaaaaactcaatcattgatcttaatggattttctctagaaatgtctcaaagtgttttcttgtaatgtctttaagagggattagactaggacagtgattgcaaactaagaaagtttgattaacagagctggtcttttgcttttaagggattcattatatgccactgttcatttaggaggatatgcttttcaatacttaatgggcaatgagaggacgtttaatatattttagaggtcacagagttaaaatgtcacaaagtgttaacaattaactcagcaagtgcacatggcggtccctgtggctggaagccttttatggagagactgatctcagagccataaatgttactttgtgcgtctgtttcacaaaattggagcccagggtgttgacttgctgctaagtagtttttgtgcatttggtgacacctctcagaagtcctcacctgtgacctgaaaagttgatctgatgaccccctacctaaactaagcagatacaatgagaaaaggatgtgagttttccaatgagaagtagcagcccatacgatttattccatgcttatacgatggctggcattgtggaaaccgttaagcatatcaaatcatctaatctcaccataacccaaggaggtaggttttgttattcccatttgacaggtgaggaaaggtgaggaaagagaggaacagaaaaatgttctattttcaagaaaacacagccggttggggtgtgtttggcaggggagtttggcttcagagtctgccccacagcgaaaaggcagagtgctgctgagaaagatgagagaaacagatcatgataaacaaacatgaatctaggcttccttgatgctggcacctggggattttttttttaattgtggtaaaatacacataacaaaatttaccatcttgcccatttttaattgtacagtttagtggcattaaggacattcacattgtggtacaaccatcactgccatcctctccagaactcttcatcttgcaaaacagaagctctatatccattaaacactaactctccatattctccccttctcctggctgtggcagccaccattttactttctgtttctgtgaatttgattactctaagtacttcatctaagtggaatcatatggtatttctctttttgtgactggtttgtttaacttagagtaatatcctcaaagcttaccatgttgtaacgtgaaacttttcctcctcttatctattcatccattggtggatacttgggttgcttccactttttggctattgtgaataatgctgctcccctgaggacgttccaaaggccaggttgagtggaaatctgtatctggtcacagattccaaagtccagtttggttaatgcttaactcccccagtgtggtggctctttttgggcacatttcatcaggcagaggggtgattcttctacccaattccttagcctcttataatgaagccctaaactttcattttggtattttttggtatcatacctttttttttttccccacacagagtctcactctgtcgcccaggctgaagtgcagtggcaccatctcggctcactgcaacctccgcctcccgggttcaagccattcttatgcctcagcctccccagtagctgggattacaggcgtgcatcaccatgcccagctaattgttgtatttttagtagacatggggttttgctgtgttggccaggttggtctcctactcctgaactcaagtgatctgccctccttggcctcccaaagtgctgggattacaggcatgagccactgcgcccggccagcatcatacttattcaagtttattactgtaaaagtgtaaacagagttgctaaactccgggtctctgatgttgttctaccacataagaattgtaaatccagccattattattagattatatctatggaatattcttattcccttttcattttagaattctttgaaaagtaaaagtatttcctgtttctgaaaaaaggtgttttacctttaatgcttttgggggaaggagcacattaaaacaaaatttctaacctacatactttgcttcttccttgaaattaagtgattttcttggatcaattaatcagtttttaagtttgttaatttacccgagaaagagagagaaatgtgaaagatgttttcatttttaaaaagcagatacagctccatgtataattcataggataaaagggggagcattttcactgttcatgcctcaagtaattctcaaatactgcttcaaagatgatcgacaatccttgaaacattctgcttggtcctttcatagacctgggtaacatgaaaatttactgaactacatttttctggacagacttatttagaatgtgacatccatttcctgctgggaagacaagcaataaattccaagacagtatcagggtctctgacccgtgatcagttcctggggaggtgctctcaccagcggcctctgccttagcatgcagttcgctcctcaggtcttacctctgtggcctctgtggctttccagatgatgggtccctccttcagccctcatcttcaggagcttcctgccttgcccctctgtttcctgtgctcctgccaaggcccctttgctttctgaatgttagcactggttatctgtcagccactttgctaagcactcgatagatattatttgcttcctataatgacactgggaggtaatactattattattgttttctcattttaaagatggggaaactgaggctgagataacagaggggatggatctggtgtttaaccttgggccagccactctgcattgaagtccatgaacttgacccttctcctcttctgcttctcgtttttcacaactgtgtattttttcagctctttatcgctgttgcatcttctcagtttgtctctttttgctacattctttagacccatttgtgtttttctcatttgtaccttcttgctgaactgatctttatttttcttttcctttggtgtccacttttaataaagtaatctcataaaatttggcccatattattaatatttcagtaaacttatctctcaggaaattgttgactggaaaaaaaacccataaaaaataaatgtaaaaacatgctattgggtcaggtgcagtggctcatgcctgtaatcccagcactttgggaggccgaggcgagcggatcacctgaggtcaaggagtttgagaccagcctggccaacacggtgaaaccccatctctactaaaaatacaaaaaaatgagctgggcgtggtagtgggcgcctgtaatcccagctactagggaggctcaggcagcagaattgattgaacccaggaggtggaggttgcagtgagctgagattgcaccactgcactccagcctgggtgacagagcaagactccatctcaaaaaaaaaaaaaaaaagcatgctattttttcaactatgggaataaccttttcctctaatttgtaaaatatgttcaaagattttatgtcataagttttgggggagaattgcatagaagtttgatttatggcattgcatataccattaatgtttgtacgcataatcatgaactttacaagtttctaggaaaacatccaaggattttgttgtcattaaaattcagaacaacggagttatactaggtgtctaaaatgtatgctgaatcagtaggctactttttctgtagtttttatatattttgtttaatttttaaaaagttagtaattaaaaaaattgatagggctagccatgttggaaagaaaaaatgggatagtcgtttcagaaagtgtattttgatattttatttttgcaagtatttttctggcttgaagatacaccaactatatcttaaaagggtttcatttgcctctatcgtgaatatagaatctatattgatacagaatgatacaaccttggctatctagcaaagcatgtgttttgttttgaaggataagcaagtcagttgttgcctcctctaacctacatgagtttattgctccaactataggactgtagaagagtattctcaagtgatcccattttggaatacatttttgtttatttctgtgtgtattatatatgtgcacatgtacaaatgcatagaaaatattgtggagggatacacattcaacagtgattgcatctaaagaatacagctgggcgcggtggctcacgcctgtaatcccagcactttgggaggctgaggcgggtggaatccttgaggccaggagttcaagaacagcctgaccaatatggtgaacccccacctctactaaaaatacaaaaattagccaggtgtggtggtgcaggcctgtaatcccagctactcaggaggctgaggcaggagaattgcttgaacccgggaggcggaggttgcagtcagccaagattgcgccactgcactccagcctgggtgataaagcaagactccatctcaacagattaaaaaaaaaaattggccggtgtggtggctcatgcctgtgatcccaacactttgggaggccgaggtgggtggatcacctgaggtcagaagttcgagaccatcctggccaaggtgatgaaaccctatctctactaaaaatacaaaaattagccaggtgtggtggcaggcgcctataatcccagcaacttgggaggctgaggcagaagaatcgcttgaatctgggaggcaaaggttgcagtgagccgagatcgtgccactgcactccagcctgggtgacagagtgagactcagtctcaaaaataaataaataaaattaaattaaagttaaaattaaaataaaataaaaaataaaaaaatataattggggttgggggtttgggggaacaagagagcccttctacttttatactatgtatttctgtattctttgaatatttttcaacaagcataagtaacttgtgcccaaaaaattaataaaaacagcattagttacaataaaacttgtttatattccagttccacagcctcctagattagaacctcaggaaccaaattctgccaccagcacaacaattgcagtttactggagcatgaacaaggaagatgtcattgattcatttcaggtttactgcatggaggagccacaagatgatcaagaagtaaatggtaggattgctaacacaaatacaaatgcatatgcatattcatgcatcttcatgtgaagtatttaaatatacacctgtattatgactcttcccacaaagcatttatagccatttacaaaacaacaacaaaaccccaacaaccatataatgaaataataactacagaagcaaaatttgggaatcaagatcagggaaaacaaaatggcataaatattataatagtcaacacaaatattgtaattgagattcacatttggctttgagctctcagaataacaggagcaatgaagtggttctcatttagagaaaggaggtaacataccagagtttcaaggaaaataaagtttttaacagtacgaaagcctgaaagacaagtgtcacgtgttccacttttagggaagaagccatagagaggacagtgtgctccacaatgacctgaatgcaaatgaagcatgggatgtcatgggtggcagtttctcaggtctgtctttgctaaaagccaccaacaagccacaagattcattcagtgttcacagttcccagggcgtgggcctaggtatggtgtagtcttcctgtgtcccaaattaatgtgtggatagaaatgaaagtgcttagtagggtgaatggatggtatgtcttacagctgagcctctgtaagtatctctcagctcagaaggacttctaataagccctggaagccaggcagtttgaggttgtgcttcctgatgaatcagagctgggagtgctgccattctgtgttgcttgttgaagacagacccacatactatggaaaacagatgagcatgtggcaggcttggcgtcctaactcaggtgcccaatttgtaatcaggaatgaatggtaatatattatactattactaatatttaagtcttttgaaatgtcatgtgataattaatttagaaaaaagtttaaaaaagcaattataggcatggtgtaaagttggctaaatctgtctgtaatgtcatgactcctgttttattgacctatttccatatgcctgtcacagcacaaccaagtaagtgttactatccctatttgcaagtgagaaaactaatgtgaggttacatagtttgctcaaggccttgcaacttgtacatgaccgggggcaggagtcaaacacacatctttcaggctccaaagtttattcttttgtttgtttgtctctgtgtgtgttttgttacaccatacttcatctccatctatttctagctctatttcatggctctctgagacccttcttatcaaatagttgttgcttggcctgctttttttttttttttactgggtttcacccccaccccaaacacttccctatcctgtgtctcattgtttctgtgccctgaactgtgttaataacagttagctaatctgataatctagtctgtgataccatgtcatgtttagtagggtctctagtcacatatgttatgtacactgttaaagggagtgccagggtaataggatgtattagttcattctcacactgctataaagacatacctgagactgggtaatttatgaagaagaggtttaactggctcacagttccacaaggtgtacaggaagcatggcagaggaggccttaggagacagaatcatggcagaaggtgaaggggaagcaagcacatcttcccatggctggcagggaagagagagagagtaaagcaggaagtgctacacactttcaaacaaccagatctcttgagaactcatttatgagaacagcaagggagaagtccacccccatgattcaatcacctcccaccaggctcttcctccaacactgggaattacaattcaacatgagatctgggtggggacacagaaccaaaccatatcataggaccttgcctaaaagaatgattccagtgaaaattgcagacacagattctgggatatgggagaaatattcttcagtgtacaggtccttatgaggttctttaaactgaactttctgtccagaaagtacagctcattggaaaggagagaggcaattgagaagcctgctaagttgaagagctcccgattttcttttaaagaaacagtctgggttcttaagtggaaaagttttgaagatgtgacattcaagagtcataagggggggaaactgaaattaccataggcaaaatttacaaagaaaatcatatgttttaaaggagataaaatttcagtgagaataatcaaattggcccaaattggtaggtttgttcagaatggtattggataatgtttactattaaaatattcaaagtaagatattttttaaaatttttgaaggcaaatgtcttaattggacaaagttacttcttagagtagcttatgacctatcaaagttatttaagtatttctataaattgtggaaatccctagtggaaagaattctggaattcatgagaagaaaccaggatttgaaacctggaaggtcatactgaataccaaaatagtttactaatctgtaaagatgtttaaaaaccatgaagttgtcctttttttatgacatactcttctgaaatattggcactggttcttaagattttcttgagaatgtgttactgagatttaagctaacatatacattatgtaattttaatattcgctactgaaataagttactttaattgtggtatatgaagctcagaatcttactaatatgctattattttctgagaagtgttaacaagtattactatgtcatcctaagtatctcttttcagaatgctgttgctttcacatgtattctaaggagctggttttcacataatggtatctgtaaggttatcagtttgcattttccactgaaagaaaatcatagatgactttctccagtaactataacttttaattaactttggaagatgtcttcgattttaattgtgtcttatgctagagttggtagaagaatacagactgacagtgaaagaaagctactgcatttttgaagatctggaacctgaccgatgctatcaagtgtgggtgatggctgtgaacttcactggatgtagcctgcccagtgaaagggccatctttaggacaggtaaggagatggatgctaagggtgcattagaagacaacgctcagttcttcacagactcttgagatcagccagtaagtgtttattaagcacctattgtgtgttgagtgttgtgcaaagtgctggttatacaacgatgacttaagcctggggtcctgttctcaagaagctcatgctcaggtggggagatggaaaaacagaggatcatagaaaatgtgtggtaagggccatatccagatatacacaggttattatgagaacactccagaggggcacccaagttggcctggggcaggggcaggatcggaactgcttcctagaactgatgcctgcagaaaatgctttaaaggatcaataggaagtaatgcgttaaaggaggatattccacttgaaaaagacatgagcagaggcatcaaggcaagaaacagtatggagtgtgcaggacactgtaagaagtttggtattatttcttagacttaaacaaaggaaagacaagataagaaaggctaacatagagaggccgtgtttgcaaggtaagaagcttgggctgcgtgtgggtgctgggaacccccaaaaggttttaagcagtggtatttaactggaaatgcattctcacgatgaaatcttttcacagggtaagaagcctaaaccaaggctgcactgcctttaagataatggtaacctgcctcaggggaagaaatagtttactcctaccctttatcctttcctcttgccttttaaaacaagcctttattgagcacctactgaggacaagatcatggctaacttgtgtgtactgggacaggggaaagaatctttattttgatttgcttgtatatgtataaagaaagtctagtgggatttataggaagctactattaggggctgtttggggatgggtgagaactgggcaatgtggaaggcagagaagggagagagacatcaccatctatatttgatcccttttgggtttttaacacagaatacactttctgatgaaaaattgaaaacagaatcatgccgaagccgtggaagatcacgtgcttctcaggtcccaggaaagcaagctggcattgctccacgactgtcctgactctctttctgcagcaccctccacccctgtgatccgcgctgaggactgtactgtgtgttggaacacagccactatccgatggcggcccaccaccccagaggccacggagacctacactctggagtactgcagacagcactctcctgagggagagggcctcaggtgaggggccctctccatgggagagactgcccagagcccagtaaccaagctctgggtcctaaactaccctctaacttctgctcaccaagggagaaatgccgtctaaaatcctgctgagctaatgaagccgctgacttgatttgcagctctatcacagttcaccaatgaactccaagtttgtaataaaacacaggctacaatgcagaataactcccttgtaagaaaaatgtatgtgaattttaatgatagaacattctttgaggtatatttaacttcagtcattagacaggatttatgcatattttatgggttttttactagctatatcagaatccgtaccacctaactcaggaaactaatagtgagcttgtgtataatgtaaattggaatgtctccatgatagattggtaacattaaggagctaattacatgtatattatcatggagacatacctgcctctccaaaagcatgaaatatgtaaagagattcttctaggaaaaaagaaatgtgacgcactctcaccaagatgctgaagctgacattcatcaataagcagctgtgcatccactaggcatttggtaaatgttaacttatctaccgaggtggtgttttcttagcctcccacctccttgctgtggagcagcttcatgtaccatgatgcatattcagatcattcttaatactcatattttgatagagaggtttttaggttttcttttaaaccaagtttattgagataaactactttggtaggatatggaacttaggaataatggtatgaaactagacagcttttttttttttattacactttaagttctgggatatgtgttcagaacatgcaggtttgttacataggtatacacgtgccatggtggtttgctgcacccatcaacctgtcatctgtattcggtgtttctcctaattctatccctcccctacccccctgcccccaaaaaggccccagtgtgtgatggtcccctccctgtgtccatgtgttctcattgttcaactcccacttatgagtgagaacatgaggtgtttggttttttcttcctgtgttagtttgctgagaatgatggcttccagcttcatccatgtccctgcaaaggacatgaactcagtccttttttatggctgcatagtatttcgtggtatataagtgccacattttctttatccagtctatcatttgggttggttccaaatctttgctattgtgaatagtgccgcaataaacatacgtgtgcatgtgtctttatagtagaatgacttataatcctttgggtatataccccataataggattgctgggtcaaatggtatttctggttctagatccttgaggaatcgccacactgtcttccacaatggttgaactaatttacactcccaccaacagtgtaaaagcattcctatttctccacatcctctccagcatctgttgtttcctgactttttaatgactgccattctaactggtgtgagatggtatctcattgtggttttgatttgcatttctctaatgaccagtgatgatgagctttttttcatatgtttgttggcagcataaatgtcttcttttgagaagtatctgttcatatcctttgcccactttttgatggggtttttttttcttgtaaatttgtttaagttccttgtagattctggatataagccctttgtcagatggatagattgcaaaaattttctcccattctgtaggttgcctgttcactctgatgatagtttcttttgctgtgcagatgctctttagtttaattagatcccactggtggattttggcttttgttgccattgcttttggtgttttagtcatgaagtatttgcccatgcctatgtcctgaatggtattgcctaggttttcttctagcgtttttatggttttaggtcttacgtttaagtctttaatccatcttgagttaatttttgtataaggtataaggaaggggtccagtttcaattgtctgcttatggctagccagtttttccaacaccatttattcaatagggaatcctttccccgttgcttgttcttgtcaggtttgtcaaagttcagctgattgtagatgtgtggcattatttctgaggcctctgttctgttttattggtctatatatctgttttggtaccagtaccatgctgttttggttactgtagccttgtagtatagtttgaagtcaggtagcatgatgcctccagctttgttctttttgcttaggattgtcttggctatgcaggctcttttttggttccatatgaaatttgaagtagttttttccaattctgtgaagaaagtcagtggtagcttggtggggatagcattgaatctgtaaattcctttgggctgtatggccattttcacaatattggttctttctatccatgagcatggaatgtttttccatttgtttgtgttctttcttatttctttgagcagtggtttgtagttctccttgaagaggtccttcatatcccttgtaagttgtattcctaggtatttaattctctttgtagcaattgggaatgggcattcactcatgatttggctctgtgtttgtctattatggttgtacaggaatgcttgtgatttttgcacattgattttgtatcctgagaatttgctgaagttgcttatcagcttaaggagattttaggctgagatgatggggttttctaaatatacaatcatgtcatctgcaaacacagccaatttaacttcctctcttcctatttgaatacctttttttctttctcttgcctgattgccctggccagaatttccaatactatgttgaataggagtggtgagagagggcctccttgtcttgtgcaggttttgaaagggaatgtttccagtttgttttatttatttatttatttttgagacggggtgtccctctgtcaaccaagctggagtgcagtggtgtgatctcggctctctgcaacctctgcctcccaggttcaaatgattctcctgcctcagcctcccgagtagctgggattacaggcgcatgccaccaagccccgctaatttttttgggtatttttagtagagacggggtttcaccatgttagccaggatggtctcaatttcctgaccttgtgctccgacctccttggtctcccaaatgctgggattacaagggtgagtcaccgcgcctggcgcttccagcttttgctcattcagtgcgatattggctgtgggtttgtcataaatagctcttattattttgagatacattcaatgaataccaagtttattgagagtttttagcatgaaggggtgttgaattttattgaaggccttttctgcatctattgagataatcatgtggttattgtcattggttctgtttatgtgatggattatgtttattgatttgcatatgttgaaccagccttgcatcccagggatcaagctgatttgattgtggtggataagctttttgatgtgctgctggatttggtttaccagtattttattgaggattttcacatcgatgttcatcaaggatattggcctgaaattttctttttttgttgtgtctttgccaagttttggtatcaggatgatgctagcctcataaaatgagttagggaggagtccttctttttctgttgtttggaatagtttcagaaggaatggtaccagctcctctttgtacctctggtagaattcggctgcaaatctttctggtcctgggctttttttggttggtaggatattaattactgtctcaatttcagaacttgttattggtctattcagggattcgacttcttcctggtttagtcttgggagggtgtatgtgtccaggaatttatccatttcttctacattttcaagtttatttgcatagagatgtttatagtattctctgatggtagtttgtatttctgtgggatcagtggtgatatcccctttatcattttttattgcatctatttgattcttgtctctattcttctttattagtctggctagtggtctattttgttaatcttttcaaaaaaccagttcctggattcactgattttttgaagggttttttcatgtctctatctccttcagttctgctctgatcttagttatttcttgtcttctactatcttttgaatttgtttgctcttgcttctcttgttcttttgattgtgatgttagggtgtcaattttagatctttcccactttctcttgtgggcatttagtgctgtaaatttccctctaaacactgctttagctgtgtcccagagattctgctatgttgtgtctttgttctcattggtttcaaagaagttatttatttctgacttaatttcattatttacccagtagtcattcaggagcaggttgttcagtttccatgtagttgtgtggttttgagtgaatttcttaatcctgagttctaatttgaatgcactgtggtctgagagactgtttgttatgatttccattcttttatatttgctgaggagtgttttacttccaattatgtggtcaattttagaataagtgcaatgtggtgctgagaagaatgtatattctgttgatttggggtggagagttctgtagatgtctattaggtctgcttggtccagagctgagttcaagtcctgaatatgttaattttctgtctcattgatctgtttaatactgacagtggggtattaaagtctcccactattattgtgtgtgagtctaagtctctttgtaggtctctaagaacttgctttatgaatctggatgctcctgtattgggtgcatatatatttaggatagttagctcttcttgttatgttgatccctttgccattatgtaacggccttctttgtcttttttgatctttgttggtttaaagtctgttttatcagagactaggattgcaacccctgcttttttttttctttccatttgcttggtaagtattcctccatccctttattttgagcctatatgtgtctttgcacatgagatggtctcctgaatacagcacaccagtgggtcttgactctttatccaatgtgccagtctgtgtcttttaattggggcatttagcctgtttacatttaaggttaatattgttttatgtgaatttgattctgtcattatgatgctagctggttcttttgcctgttagttgatgtagtttcttcacagtgtcgacggtctttacaatttggtatgtttttgctgtgggtggtattggtttttcctttccatatttagtgcttccttcaggagctcttgtaaggtaggcctggtggtgacaaacagcatttgcttctctggaaaagattttatttctcctttgcttatgaagcttagtttggccggatattaagttctgggctgaaaattcttttctttaagaatgttgaatattggcccccactctctcctggcttgtacggtttctgcaaagagatccgttgttagtctgatgggcttccctttgtgggcaacccgagctttctctctggctgtccttaacattgtttccttcatttcaaccttggtgaatcagatgattatgtgtcttggggttgcttttctcaaggagtatctttgtggtggtctctgtgtttcctgaatttgagtgttggcctgtcttgctaggttggggaagttctcctggataatatactgaagagtgttttctaacttggctccattctccctgtcactttcagctacaccaatcagacgtagatttggccttttcacatagtcccatatttcttggaggctttgtttgttccttttcatttttttccctctaatcttgtcctcatgctttatttgattaagttgatcttcagtctctgataacctttcttccgcttgattaatttggctattgatacttgtgtaggcgtcaagaagttctcgtgctgtgtttttcaggtccattaggtcatttatgttcttctctaaactggttattctagttagaaattcctctaaccttttttcaaggttcttagcttccttgcattgggttaaaacatgctgttttagcttggaggagtttgttataacccaccttctgaagccgacttctgtcagttagtcaaactcattttctgtctagttttgttcccttgctggtgaggacttatgatcctttaaaggagaagaggtgttctggtttttggaattttcagcctttttgcactggtttttccctcatattcgtggatttatctacctttcgtctttgatgttggtgaccttcagatggggtttctgtgtggacgtcctttttgttgatgttgatgctatacttttctatttgttagttttccttctaacagtcaggcctctctgatgcaggtctactgcagtttgctggaggtccactccagaccctgtttgcctgggtatcacaagcagaggctgcagaacagcaaagattgctgcctgttccttcctccggaagcttcatcccatagaggcacccgccagatgccagctggagttctctcgtatgaggtgtctgtagacccctgctgggaagtgtctcccaagtcaggaggcatgggggtcagggacccacttgagaaggcagtctgtcccttagcagagcttgagtgctgtgctgggagatctgctgctctcttcagagctggcaggctggaacgtttaagtctgctgaagctgtgtccacaactgccccttcccccaagtgctctgttccaggtagatgggagttttatctataagcccctgactggggctgctacctttctttcagagatgccctgctaagagaggaggaatctagagaggcagtcgggctagagtggctttgctgagctgcggtgggttccacccagtttgaacttcctggaggctttgttgacaccgtgaggggaaaactgcctactcaagcctcagtaatggcggacgcccctccccccaccaagctcgagcattccagattgacttcagactgctgtgctgccagcgagaatttcaagccagtggatcttagcttgctgggctccttgggggtgggatccactgagctagaccacttggctccctggcttcagccccctttccaggggagtgaatggttctgtcttgctggtgttccaggagccactgggttatgaaaaaaaaactccagcagctggctcagtgcctgcccaaatggctgcccggttttgtgcttgaaacccagggcctggtggtgtaggcacccgagagaatctcctggtctacaggttgtgaagaccatgggaaaagcgtagtatccgggctggaatgcactgttcttcatggcttcccttggctaaggcagggagttcctcgaccccttgtgcttcccgggtgaggtgatgccccaccctgcttctgctcaccctccatgggctgcatccactgagatgagctgggtacctcagttggaaatgcagaaatcacccaccttctacattgatctcgctgggagctggagaccagagctgttcctattcggccatcttgccagccacctctagacagctttaaataaagtgtgttatttaagctcttgtttatcttcatgatcaacaactatttatttagttatgatgtgaaattttatatgactgaacaatgatgatagtttctttcaagttgaagacaggcttcacaaaataatgatcaaaggatgaattaatatcgggtgggggacgttttggtgggatgtaggcatttaagcagaagcgtaaacataataagtgttcaagaaacaacatctcttttaatgtgccagctgctggaaggcaggcttcagtattagcaaatagcttagaggtgaactctggccaaaacagagggagagaggaaaaaaaaaaaaaaaaaaccagacttttattgagcatttactatgtgccaatcactagcccaagtactttaggtatgttgcctcatttaatccccacaaaaactcttaagataaaacagacactttgagaggctactcagctcgtattagcagtcaggatttaaacctcattttgtgagatttcaaagtctaagttgttaacccttgctttacgtcacttaggggagtcctggaccttaactgtgaaaactcattgatgctatatgagaagaaccctgtatcagaagtgccagagtcccagagtaatctctcccaccattttctaccatctgtaaggaaaacccagctctttcagaggcaagatcagcctgctaatgaagtctctgaaatgactcattcccttaatggcatccgtccccagttggcatttgcataaatcacatcagcacagttggatacttaaatcagcagaaatctggaaaccctgagacctagtagccatctcactagggaacagtgatgtcatctcataaatatggctacaaggagaagggatggggggatggcgttccattgagggccttcagctggccaggaacttgcctactctgagtgaaccttctcagcaatcctatgaggcagttagtgatctccactaaatcagactcagagaggttaaataatctggccaaagtatgaaatgatggagtgagggtatggagtcaggattcaaacccaggcctgtcttcttctttcaactagttttaagactgcagccctgaatagactgaggcatccctcaataacctgatgactgggtggtaccatgcatccttagttttctctgtcccatgagaaacatagatatgaagagagaatgcactaccattcaaatcccctctcgttaatatttttcccttccctgattatcctggggactttgcaactaaaaaaaaggaaaaagaaaagaaaagactctttctgataacaacaatgcattccagaaaatcctttgcgaaagccagagaaaccaatgacagttccatttgtaggaaaaaaaaaagaccatccaccaatttcattaagaccaacatcgagcttattaaaacataaggcttgtcattagcttattctatttgagatcttgccaatcaattcatttttatttttcttgttgcaggcaagcatattaggggccggctaagcaaaaatttataatagaacaatacaaggggttctttgctattgagtggttatagtccagcaaatttagaaataaagggaagttgcacatgcgaagccctgttgatagtttaatgctgggttagatctggagttgctttccatttaggtactaagaggcccctcagtgccaggaggtgcaacgatatgttcagtccatagcccaggtttgactctccaacctctggatccctgctgagtctgacaatagataattttttgaggcaggaaaaaatttattggccacaaattactatcctgttcatttgctaagtctactgctgacacactgcatcagagccatcccccatcaatacaggcctcaatatcttattccctaggttggcatcaacagactgaaataattcatctttaatcgcagagtcccaggactgcaaaactcatttttatctctttggttctttaatgtaagagttcaagacggaaggaaaattctgctctttgggagtggccatgtgttatggttcttttgaccatctggttttcacaaccaactttaaaacattctttacacggtccgatgcttcaaaattctgtaaaacattaactatttaactacgatctgtgtagttcaatctctaagatgtcagttgtggagaacaagtcttacagtagaattgatgtataaagaagctcaaaacttgatcatctctagtcaataaatacaaacaattcctcctttttgtccattatattagaaccccattcttcactttgattctttgcacagcaatggataaagttacttggtctctgagaaagaacagcaagccaagatttgtttgatctcactcctttgttggttccatgaagggatcattgtgtgaagttgtcatctcagtgcctatgacagtgcctggcatattgtaactactcaataaatatgtgttactggaatgagtaaatatcaattagcatcaaacacataacactgactagtaagaaaagttagtctagctttgaggataatctcttatttaaaatgaggaaaaaaataaattgtgccagcaaagtaaagaagaatggatgaattaattgtagtgcttggatatttaaccaggagataggactagtctaatctgtggactggaaaccttcccatgggtaactcatagggaaggactttacaagcttatttatccattggttatataacccttacataggttctggatttcatgcaaaaactctatagtactaaactagctccaaaaattgatccagaggtccctgagggaaattagggggatcaaagattacttccatttgttgtggtttagtttaactgagcctggaccataaatggggtatgaacggggaacttatctgtgtagatactcaataaatgtctgtttcacgaatgagtgaatgaatgaatgaatgaatgaatgaaggggattaaccaatctctttttgtccttgcccacttcaagccatctaactggctggatctccagcaaacaagatagggagcaagagctaaatgagttcacatttcttttccacccccaatccccgataaaacaagcaggcttcaaagctctggtatggtgtaggaagacaagttgaaaggaaatgaaaaacaaaaaggcaaaaaaagatgagtaatattaaatcacacgcacacatggagagagggcattggttgtcctctagattggagaatctaattttgcttgccagaatagaaacacatccatcttcagacctgcagtccttccccaggtataatggcctctggcgattccaatttaagaccaaaggtgctagttgaacttttatggtgggcgtttgaatggaatgagcctactgtgcccccaagttacatgacgcagtgtctgaaatagctgagcaactgcctccattccataatcctcacagaaaacatttgcatatttttgcgtgtgggcaccgaggaggctcggtcccagcagtcggcccctgttgggtttggggtaggcgggagtgacaatccccggcttgtgcgcgggggctgagggagctcctactcaccttcttcctgtttttctttgaatgctctcctcaggttgggtgggctcaaaacactttcaaaaattttccaccgttctgctgtttcctcagctgttctgtctctcctgtgtggagagaagtcagaagaagtgtgggtggaggagggaaaactgagagaaatatagtacagggattagctgtgtgggctgcagcgagagaagccgtgtattgaatgacaaatctgtgagagtcaatacgccagaaagtagctgggagtgagtctcctgctccctggctctggctgaggctatgggctggggagacactcccggggccatcctccagggcaagcatttccagggagttgggctcagggtgctgggcctgtgagctcatattcctccttcttccagcttttggggccccacctggtggagcaggaacagaattgcctgtcataggtgggtgttttcagctggggacacccactgctctgtctgtagaataaggacaaataagggtaagtttcctaatgaacttagtgcagagtgaggaatcccagcatttttcttttctttaaatctttcttcctcagccttcagatggataggtgatgactgaccagtggtcaacagcaagagattggagcttccttgcaccctgtggctaaaggaggcagtcattcctgctccttgcttcttcacagggtgacaggagggtcactgacacgattgggccaaagttcttattgagtaattaaaagctagtcaccaatctgtatgtgaaattgttttcctgatccagttgtcatatccctctgtagggagcctttgggagagggagttatgagaagatgattccccatcgcatcccccagtgtcttcgcgtttggctattcctaaatgaaatctttcttcccaaatgaccttatttgactttgatcacgtacaacacctcctagttgtacagtaaaacctcagtcaatggaaacccaatcagttccttcacttctaacttaggcctgtcaatttccaaaagtattcaggttgtccacaatgaaagacccagacatagtagaaccagtaaaacaatcctgtgagaacaagagccaaataatgcaggactgaagagactgaaaatgaagaactgaacctcaatggaacacaaaatttaaatctgaacttactggcagctaaagagaaaacaggagagagggggagacagcaagaggaaaaaaagagattacataactcatctctttttttaaaaggaagcacatttcactaagagagacaattatatttcttgacattcagctctaagatgaatttttcatgtagatctttatataagggctattgaacaagataatagtgattgcctttaagagcagttttacaaaagctgcaaaaacgttctctgtataaccattattttaaacaggatctgaaagcataatgtgaagccaccattctgggcaggcagttttatgaggatctcaaggaattgtttgcctgtgtgactgtggaggggtaaaggagggcctagagaatccagaggaatgaatgttactaagctcctgggattctctgcctggaatataaatgataccattcagcctttggagggtaactatagagaaaacaaaaatctagaatctttctgctgggacctttggcttatgctgattttgcaagaatgtttaattataggaaagcctaagccccatggttgtcaggattcagcccccatgttacttttctacagtgttgtgaactaagagtgatgttagttcacacctgtaatctcagcacttggggagtctgaggtgggagaatcacttgaggccaaggagttcaagaccagcctggccattcagcccccatgttattttccacactattatgaactaagagtgagacgcttaccatcgagtctcataatatcatcatttatcaaaagaaaaatagttctgttcaaaaatttttatttaccaactttttaagaaggaaaatcttctcaatcctgatttaaccaagtgtttcaccttaaacaaaaagttccatattgacagttagttaagattttataagtagcttcacacagccatggctattcagttggttttttatatttaatgttgctcatgttctcaagtagtttttttttccttcccaccccttcttaccccgcattatcttatgattatttttcccaacctaaatgatcataaaaatcaaccgggatgcttactaaacacctagattcaaaggcccctcttaagattccgattcagaagatctaatatgcccaggcaggcttggggaacactgccttaccagctggtccttcagggcccagccatgtactctgttcacagttcacactatgtggtgtcgactgactgcctgaatgttggtgctgtcaatgtgaatgtcagtaaaagccaactgtgttttttaaaaaacaatacctatttagccatctgtggtacactgcagtgacgacactaactgtaggctgctcctaggaatcacggcactggattcctccatattgtttgtacacaggccgccccgctcccctggggagaaagcatacttagatccaggggttggacatggtggtacagagaacaaccacaccctgtaattgccaacccctcaagttaccttaagcacatacatactcctttcctttttttccatcccatacaaattgctgaattatcaaattcctggagaagctactttacagggttcaaattaatgtcccctttgagattgtgcaaacacattcaaccaactcctgaacttctgagctggtaatatagctcttaaaagtaaaatatttaattaaatttggatagagaatatgtatttatggtacaaattaaaaagatacaaaagagaatacagtggaaattaagtctcctttctacctatcctttacctacccaattctcctccccagaagcaattactgttacctgattcatattgatccttccagatagtctgtgcacatacaaacatctacagttttttaacaaatggtagcatactatatatgtttcaccactttgctttccttgcttaaaaatattccttggtgagcatcccatatcaatacatatgaaactacttcaattaaaaaaaaaattttaggccaggtgtgatggctcatgtctgtaaccccagcactttgggaggccgaggtgagtggattgcctgagatcaggagtttgagaccagcctggccaacgtggtgaaacctcatctctacttaaaaaaatacaaaaattagctgggcgtggtggcaggcagctgtaatcccagctacttgggaggctgaggcaggagaattgtttgaactcaggaggcggaggtttcagtgagccaaggttgtgccattgcaccccagcccgggagacaagagtgacactgcatcttaaaaaaaataataaaaataaatttttttttaagttttattttattgttttaagaatataatttaggccgggcacagtggctcacgcctgtaattccagcactttgggaggccgaggcaggtggatcacgaggtcaggagttcaagaccagcatggccaagatggtgaaaccccatctctactaaaaatacaaaaattagacaggtgcagtggcagttacctgtaatcccagctactcaggaggctgaggcaggagaatcgcttgaacccgggtggggcagaggttgcaatgagctgaggtcatgccactggactccagcctgggtgacagagtaagactccatctaaaaagaaaaaaaaaagaatataatttaacttatttaccaattgagaggcattgaagttgtttctattctcttgccatcacaaacaatgctgcagtaataaaccttgtgcatatatcatttcacacatgtgcaaatatatttgtaaattaaattattagaagtggaataactggttaaaaagtgtgtacattgtgaattttgatagatattactgaactgtctctatagaggttgtagttgtttatttgactctgactagtagtgtataagagtgcttagttctttatacccttgcctaaacattggatgataaaacttttgatcttttgacaatttgtagaaaatgaaatcttattttagtttaactgtgcatttcttttattaggttgaacatcttttcatatggttcagagccactacagtacttctttttctataaactgatcatttcctagcaattttttttctcttggattgtggtattttttctttttgatttgtagaagctctgtttttttaaggaagttagctttcctattaagagataagtttcaaatctttaaaaattttttaccgtgcatattttttataataattgagttggatttatcaatctcttttgaaaatagcttttaacttgggtagcatattttaaaatgcccccatgccgcctgcccccctctctctttctgtgtgtgtgtgtgtgtgtgtgtgtatgtttattcactcatgtttttttgtagtagccaatacagtaatttcatttttatttatttttatttttttttttaattttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctcaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttgcagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtccaggaatgtatccatttcttctagattttctagtttatttgcgtagaggtgtttgtaggattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtattcttgttgactttctgtctcgttgatctgtctaatgttgacagtggggtgttaaagtcttccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatggatcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtgatgacaaaatctctcagcatttgcttgtctataaagtattttatttctccttcacttatgaagcttagtttggctggatatgaaattctgggttgaaaattcttttctttaagaatgttgaatattggcccccactctctcctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcattttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggagcccctcccccagcctcgctgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgctcacggtgcgcgcacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcccagtaatttcatttttaaaaactaggtattttatcatctggaatttatctcagtagattgtgtgaagtaggaaatcctactttttttttttttttagtatggctatctagctgtcccatcaggaaaacccatcattttcccttctgatctgaaatacttccattattatacactcaagagactatatgtttgggtctattcctgacctttataatctgtctattgatccatctatttatgccccaggaccatactggttttattattgtagctttataatttagaattcctggtagattaggttgccgcttcctgactttttttttctatttgctagtttgtatttgatatgatctttagaatcaggatgcgtagcctcctccatcagcctgctcctgactatttgttatttttagagatcatgttaaatttatagattaacttagggagaattgaaatttttatgatgttgcattttcctatccaagaactgatgtgcctttcccttcactcaagtctttttttgtttccctcagtagcatcttaaaaaatgttctttatatagatcttatatctttatatatttttatgtctgtcactattctaaataagatttttcattttatctcctatctagttgttatttgtatataaaggcttttgatttcttgtatcagttttatatctagccatcttactgaattctcttattatgtaagagtttttcaactgattttcttgggttctctagataaatggtcccatcatctgcaaatggtagtaattttacctcctccctcccagtgtttttaacctcatgtttctctctgacttaatgggaatgcttttaatatcccccttaaccattatgaccccaattattttttacttcgtaaaaatccttttcaattcctaccaaaaatgattctgaccccattgtgcaccttagtcatggcaaactttccagttgctccttgccaaaactcaagaataaaagggcccaagctagagaggctgtcctcacaagcatcagctgctgggggcttccactcattttcctctgaaacaacagagaaagagaccatctctcattcgcagagcagcccaaggccttctgaggagacagtgagtctcctctaagtcatttctctctgctttgtagcagtggagctaccaagggtgagatgagcaggttgagaggcctctgaagcctgctgggcacaatgctctgtgataagtttcagctccactggagcttatcatccaccagcaatcgacttcatggctgctgctcagaggctctaggtgctgcgctgctcactgccctcacgtctctgggacttccacacataaagccatctctttccattgcactatggcacttgtagggaggatcccacacttagggcccaaaatgagaccatttgagtcaaatttctaattgtctttcaaattttattattggctgtagacttccaatcatagtcacatcagtcgtgttatttactggtataaaatccctaagcaccaactaagtaccaacaatcgtggcctcatttgctgtctgatcactcaccttagtttgggtattctgtgaacttgaattctactgcaaactatgcaatgcttgttataagtcatatggacttagttacaattaggacaaatttttgtttctaaaattaaaaaaatcataatctctggaagagtgctactctttagatctcaaattccagaatttttgaagtttttgttaggctaaaaagcagggacagctgacatgaagactttggtgacatctgagtggagtcagaataagtagacaaggaaacgaaccatttgttctaaccttttttgctttgttcttggtgcttgagcataaggtggcaacttgtatacaataaaacaccaccacatttcgtattacttttgtttgcgtgcctgctgcttttatttcacagattcaatgaggacattgtgcacatttgtcaaatctgcctgacctgtttcatgcactgaaagcaggacggatcccatattttgacttcagtaccatgtaaacctttattctttaaatgagcaatgagacagagcatgcagttgactatatatgtggaattttctccttgacagacttcatcatcttaagggcaaacacttacctacaaaacagtatccttgctgtttaacaactgtgttgttataaaatgaagccagtgtgttgtctttgtctctaaagctaaaatttccccaccaatccttgtcacttttccccttcccacccccgcctcctcaacaagccctcagaataacaggcagagacagggcctgggcacatgataagtgatcaatacatatttatttagggagcaaatgaagtctgaaattcagttcaggctgactatgcttagtgagacaataattttgttactaattataattaatgttcatttaaaacatttcttcagtcatcaattccaataagataagcaatacatctaccccagaataatattctagatattagtcagaaattacattctcaatcataggacatggtttttcattaattaactgaagcctaattagttgtcagtggacgtgggactcagtgtcattgatccagtctgagtgtatctaaggacagtcctctcctgagggcctggtcaggtgatcagttctaaaataacaaccaatatgattcaaggagtttgcactgaccttttccagacattggcactaaacagcagttacacaagcaggtccagggtgtccccttacccctgccttctgaggagcacaacatgagttttgtccttttagacatggggtcagggtggggtggttattctgtacaaatgttttgcttttaagaagtttgaaatttgtttgttttctgggccaagaacattttttcgtttttctggttctccatgttattctctaagacaggtattaggaagtgaaataagtcagcaaaagtagaaataacctggaaaaaaattcatctgtggatgaacagtgaccactcttggattctgatgcttttgtggtatattcatcaataacaaaaaaaaacaaagacaaacaaaaaaccctacccttctgagaatgaacatgaaggctattgtactattgtattcattgacaattatatctccttgcaggactctggctctccagcacccaggttaggaactttcattagcaaggaatctaacttgtaactctaaggactctccaaatggaggtttaaagaaagagccctgcttgctttttttttttttttcttaattcatgctctaggctatgatatcaaacagattaaagagaataggaaagaagcacaaaactattctagcttgttggcagattcagagagctccgtcttcaaatccagcaagtccatttgtattaagtggtggggctgttaacagtgtacttgccaagcccactgccaattagacaccactatcagcatttttcttttaatttaaataggcaatttaggaacagcaactttgagaattttttttttttttttttgcaattagaattctcttttcttgccaagatcgagtttgctttaaaagatttcatcttctttaaagatctttggtttctattaactttggtggctttagcatgatgatcatgtacaaaatcatcgtagattggtttaatatcatcttaatccaaaagtgccctctggccagaaattgataaagaaaatgatatattcttggagattcactaaccacaagagtagtctgttttctgaatttttttaagtgtctggttctgttgcaaagagcattctggaaggcacataatagaaattatttgataaagtaatcttagtggacaatggccattttgtaggacctggcttgctaatccagtggtcataaaaggggaagaaaataagttatttgttgctaataaaagatgttcattcactaccaaattgaaataggaatcatttagcatgtggcattatgtttaaaattattattttcctcttgtatttagatctttctctggaatcaaaggactccagctgaaagttaacctccaacccaatgataactactttttctatgtgagggccatcaatgcatttgggacaagtgaacagagtgaagctgctctcatctccaccagaggtactttctcctttgcacacagtgagctatttccaagctatttcttcccttccacccctcagagaagatgtcctagagggcaactttataaactcccaacctactgtcagtggtaggtttttgtcatgaggacccaaggttggtcaaaggtcaagatatttcttttgtttttctgctttacaggttctcagccttggctacctgttagcaatcagccagggtgcttaaaaaatactgtttccctgcctccactcctgaagatcctgatttaattgatctggagatgggctcaaacatttatgtttttagaaatctctctagatgatttttttttttttgagacagagtctcactctgtcgcctaggctagagtgaagtggcatgatcttggctcactgcaccctctgcctcctaggttcaagtgattctcatgcctcagcctctcaagtagctggaattacaggcacgtccaccatgcctggctaatttttggattgttttagtagagatggtttttgccatgttggccaggctggtctcaaagtcctgacctcaggtgatctgcccgcctcagcctcccaaagttctgggattacaggtgtgagccaccatgcctggcctctccagatgatttttatcagactcacaatgtgttataatttgtggatatggtgtgtgtatgtgtggtaggttggggatattctttgaactctgtgaacaagttaccagccttgttctgtttattcttgatgcctggcacataatttgtgatagttaatgtttgttgaatgaatgaccaaaagagtaattcaaggaagtgataaaactattcaatgacatttttgggaaaatacctagatgatgccaacaaaaaatgtttgtctctgcaatttttgtgaaaggaagtgaggaatggaaagaggaccattttattatcttatcctagacacagagctggcacaaggttgagtgggcgcaacaagcgatcggcttacccagaaacatcttgtgcttttgcctcgtttgtaagatagtcagggccagcctgatgtttatgaagagaagatgcgagggctgtcttcccagcagtgttctccccacagtcccaatatggtgcctgtccttccattgttagagtctctcctttaggttatatcggtgcatcccccatttttttttttctcgaatggagtcttgctctgttgcccaggctggagtgcaatggcacgatctcggctcactgcaatctctgcctcttgggttcaagctactctcctgtctcagcctcctgagtagctgggattacaggtgcgcaccaccatgcctggctaattttttgtatttttggtagagacggggtttcaccatgttggccaggctggtctcgagctcctgaccttgtgatctgcccaccttggcctcccaaagtgctgggattacaggcgtgagccacctcacccggcctgtatcccccaattttaatatgcacacagatttcctgaggatcttgttaaaatacagatttgaagtcaggagggctgcggtggggtccgagagtctgaatttgtaactagtttccaggtgatgtagatgctgctggtgcaaggagcacactgcacagcagatgagcactaatagagggtacaccgtgaggacgtgcctatggcaccacgtagaggtaaccagccaccggcatccacgaaggccttatcatgagtgaagttttcagctgtggatctgaagacacttcgtgggggattttgacgtcaggggaaagagtctagggtctgaaatgtggggcttagcctagggacagcactggtccttgtggcaatgttttaatactattttctcacctgcaataggaaccagatttctcttgttgagagaaacagctcatcctgctctacacatttcctcaagtgggacagtgatcagctttggtgagaggagacggctgacggagtaagtagaagaagaaagcacaagtgggctgatggcccagcagtagggtcttagggtgtgtcgcctcagggtggcctccgctgagcatattcatggtgcagtgaacatgtcgggatgtggtctcaaatatcaatgtgtgcacatccacactgttcggctgtggttccctaccgagcgatagttcatcacttggagcaagtgtcaatatttttattggaaatataagcacagatggtttggttaaaacattggctattttaaggtatgatctctggttcagtgggggaaaaaaagggtccagtaattcttttattatttttctatagcaaaccagatattttatcaaccctcttgaaaaggcatagaagaggctgggcacagtggctcactcctgtaatcccagcactttgggaggccaaggcaggcagatcatttgagttcaggagtttgagaccagcctggccaacatggtgagactccatctctactaaaaatacaaaaattagccaggtgtggtggtgcacgcctgtaatctcagctactcggaggctgaggcaggagaatcacttgaacctcggaggtggaggttgcagtgagctgagattgtgccattgcactccagcctgggagtgagactctgtctcaaaaaaaaaaaaaaaaaaaaggcatagaagagaaggacagtttattgagttcctagtttctggccacagaatcttgcttccgtagtagctcccgcaaaaggaagcatcaaagaaaagaagaggcaaaggcggaggatagggtggaggaaactgccctgcaatttgcctgcaagctctgggggttattttgcagaacaaaatggcaaaatgggagaaggtatgtgaaactcttgaaaactgtaacacacgggaaacacaggctgctgatggtgctgctgtgccctggtgtcggtggctggcaggtgctcccaagaaggcactgagccagccagcagtgactttcactatttccctgtcacattgctacttgcctgtctgtggccaagctcaggtgttacctgctcctagttctggccaaggcttctctggaccctggcaccctttgatcttacctgtgtaaaagaacagataacttgtggggtcatttgtcagccacttactcatcatcatcttcaagcagcagccctgtcttgtgtatctttgaatccctcaaatctagcatggggcctggaacattgcaggggctaaaaaatatacaaatgagtgaattcagggaaaaaatagattgaagaaatagattgagcttttctgtcttttggattcctcaaaacatcaaaaagaaaataaatagactggaggagggtaagagttcacagataataactgatgataactgtaatgtgttttatagaattttatttattattaacctgaaaatcaggtcataaatatcagacagctgggccttgctccagagtgagggcttgtcagtagccacctctctgaaatgaggttgagtaaagacatgaaaagtggaatacattcccttgcattaatcattttctcatctgttaaaggggagagggagagagtgctgactgaatattaacactgcttaaattaaaaatgcttccttgctgtctcagccatttccaagcaaaattgagcaattcttgcaaacaaggtcacccatcagcagttgaaagtgcttttggttcatttcactaaggtgcttataaaaatagctaaggtgagacaaaaagaaaccttcaaccaacctcttaagggcacctactacagttcaaagaggccagaatcttgcagactgttgaccgctaattatactcagttaattccacacttggcactggccagcactagctaccttgtcatttaagagctgcacctcatttggtggctgtgtccagtaaggtcaggaggcatagaactcatggttaaagttttggagatttctttttttgcaagttttggaagaaaactatgcaaattatgtttcctacctgcttcccttgtatttatgaagagaagtcaccttaaaggcagagactgcagcatttctttttgtcctaccattattctagttatttcctgattcccagctcttttaagagttgcagtgtacaacatgcatgttgtatgtatgtgactggcaatatgtcaaatgcctgttgagagtttggagagttctgtggtgatctggttaaggttagggatacaatgaacagagtatctttagttaaattccagcagtttccaagggcagaatcctgcctaaactgtgtgagtttgtgaatgtttatgcttatgagatacaggccggcgattcctgcactgagcatactctgattgacttcacccacagaatcccgtcagtgctgggtgaggagctgccttcctgtggccagcattactgggaaaccacagtcacagactgcccagcatatcgactcggcatctgctccagctcggctgtgcaggcaggtgccctaggacaaggggagacctcatggtacatgcactgctctgagccacagaggtaagcgagcccttcccctcccctcttcatcaaaatattatgcttgggtgtccaggcagggctctctgagggacctgataaatagcacccacttccatgctcaacttctgagccaactaagaaagaaaacaagagtcaagtatatggagatgaaactctgactctgattactgaggaagctgattttagagtgtgtgaatcatacctgaagagggtttcttatattaaaccctattatgaggcagacttacccaaccagagcctgggccaggtcagcttccttgctctgcagggcagagttggtgcctggagaagcagagaaggatgtatgtctccctggtagctagtgggtaagagatagggaagagggaggggcagctgggttttgcatcacagtttttccttctgaactcaccacagggtggagagagaccacaagggtaatgctaaaaggagtccctccacagagaaggaatcaacaggagtgaggaagaagtggatctccaacacctccctccacattggtccatatcgggggttggcaaactatagcccataggccacatagaacccgctgcctgtctgtgtaaataaaattgcagaaacacagtcatgctcttttgtttatgtattgtattacactacagtggcagaggtgacagatgtctgtcaaatcctaggatatttacatctgtccctttacagaaaaagtttgccaatctctgttctatattacctgtattgtttggttggttgatgtgaaaaagccgttagcctgtgttagtctcagagcgatcaggcaggtatattatgatctgaatatgctcacagtatggtttaatagaaagaacactggactaggagccaggaatccagtttgaggtctggctccatcctcaattagcctcctgttggctgtttgccataagtgggttaaccctttgagcataccttaaatcatctagctcagcaggggacagtaatgcctggcttgctaccttgtggggctgtgaggatcacatgaaatcaggtacagggaagagcttaggaacggtaaagtatcatacaaatgtgaggcattattcaaatgtaatcctttaaaaagaagccttcaatgcttgcaagttcccagaaaaggcccacagattgggattttgcatatctctggctgcacatttctccctgcatcctacttgacagtttgattctctgagatggttcataaggacaccatctccaagcactacttaaagtcacgtttcgtcaagtcagagcaattatgattaattgatattcagtgctgtgcaatgcataaggacccagcccctacccagagtttgaaatcactcaaactcagtttacagttagtagattcagagctgaaactacatattaatttcatgaaaatgtctgtacaccctcaaatctttaaaaagcccacaccaagggctaacctccaataacaaattcctaggctctagaagacaaaattatgtattttgttgaccagttcaacctacagctttggcctttggctctttcaggcttggagtgggtgccatagattctgggagaaagagtgtgtccctttgtgtggtctcagcactgacaggtagggtctcagggccctcatgtcatccttcgagggcttcacatggggcaccctggcctctgggactctgagaacgctcctgtggcagcccctcctgtcttctactttttctggtttaatgattttaaatcaacctacatcactcttgattctactcacagaatctaggttttcagatgtcacaattgggaaggaggcgtgaagatcatctcaggagagtctgctggtttccttcctgtccattcctaaacttgccatgctagctcaaggcttccgcacctcctctgcagtttcagcagcagccacccagcctgcaccctcacttctagtctctacccactcgcaactgggaaatatttctaaaacatcattttcatcatgtccctgccttttctgctcaaaaatctacaaacatctacagtggtgtcagaacttgggtgggaccacctgcaggacacagtgaagaggggcagccaggaagaatgtggccagtctggggcaaggagtcctgaggggagttaccaccagagtccaaaggggtctgggctgagtgtgggccagaggtgggactcaagggagtaagggtcctcagtccaccaggaggaggggaggcagttccaagatcgtgcaagtgtttagagccaggcttctggatgattattttttgaagagaccagccaggtctctgttcaaagccagccaggcagagagtcaggccccacgcaggcaggcttggcttcaggccagagttgaggttagtggaatgtgtgctcggccagaaatggagacagaagcagggctggtcaggttctgtgtcctgcagaactggtggagacaaggattcagggaatacctttccctacttggcctcccaggtagggattggctcaaggaatgaccaacgctgggcctgtagggaccggggaccttccaaacaggggaggagaaatgacacatttaggcattcagaaccctccagaccagcgttatgcaataggaccttctgcaataatagaaaaatggtgccacacgtggctattaaacactagaaatgtggctggtaggactgaaaaactgaattttaaattttgtttaactttaatttttttttttcattcgacaaatgtttattgagtacctgtcctgtgccaggttatcttttaggcactagagatacaccagagtaccaaacagatcaagagtttctgttctgtgtgtgtgacagtatatacagtggtgcaaacatggctccatgcatccttgatctcctgggctcaagcaatcctcccacatcaacccctctaagtagctaaggctataggcacgtggcaccacccccagctaacttttgtatttttagtagaaacagattttcaccatgttacccagtctgtctctaactcctgacctcaaggtatctgcctgccttggcctcccaaagtgctgggattacaggcctgagccaccacactcagcccagaccaagagttttaccttcatgaagctaatagtctactgacaaagataagaagagcatgttttaatatataataaatgatgtcattattttatatcatttattcaacaattagtattatgcattcattcttacatttaaataaacatgtcaacgttacggatcaataaaatttaaaaactaggatattttattttaatttaatatgtagccattttctcagctatgcaatgttgataaaatatatatgaaaagtgtgatatgtctcatgtttattcaaatgtaagaatacatagattcatataagctgcacaaaacataaaaaatgcaggtattttccaatctagaaatggttaatttgctaacaacctgtacatactaatgatcactacagctcccattttctccaaccttaatgcctccttattcccaactctttggtttgcacttgccctttggttcttctctgctgtcggactgttcaccaaccatccatttattcattgcacaaatatgtactaggaaccactggagtgagaccctctagaactccttcacccttgtctctcaggactagggcctcttggaagttgaaagagacccaagactcttctactaattgggaactctcaaaatactattataaaaaataaagaaatgccagttaacagggttattaaaatttactctaaggacttacatttcacatagtaattcttttaacagacacaattgcagtgacaaaggcaatgactttatatatgcccatatctgaaagaaatgtcaaaaattcaaatttataaagccctctgtgaaatatgaggccctattcaaatggccctcctggtcttgtctgtcaccttttccttcttggctgctggcaccttcctatctcattgtcaaggagaagccaccacactatctccacatctgagtatctctatcccattctccaccattaactttaattttaatggaagtggccacacatgtctagtggctactatattagacagggcaagtctagagcctggcccctgacttacttatccacgtaacatcctaaaagtcacccccatgtcctgtccaaacccaagaggccaatggtgatgttctctgccacatacggacttcttcagccaccttaccatcactgctgctgcccttactgtgtggatttttctccttctttttcacctattcaagtcctgcctgtcctttctggctgagtgtgagccctgtgctcccaaagccttctgtaagagcccagctcacactgccagtccccatcattgctacctgaaacgtttagtctgtcttgcaggttccagaacatcatagtattctggcatctctctcattagcaaggcattgaaaaggtcctttatcaactcaaaagtctcacttatctccccaccaccgtgaacctctgcccttccacgtgagcttctttctgcaatgaagttgccaacttgccatcccctaaatacttgcacttgagcttctgagccttaagacagttgttgcaagtcttgaagatcctcagccctccctgccagacccgtcgcttacccagattcttaggtccaaactgccctggtgttgctgtgctcccacccctccagcctacacatccgtcgacctttccctcatctctcttcttccatctctcattccactccttccgctactttcagggccccattctcagtttctaagactactgggagaaaaccccaaacttgtgttacttttttacatagagcaatttagcttttctggtcagcagtttctcctttccagcctggccttgaacctttcccttcacaaccaaaacagcttcattaaatgtgtctagtaaacacttgaagatctacaccctgagaggcattcccagccgtggtccgagtttcaaatgtgggcagtttttccttcctgctccatacagtatgggatcccagagggcaaggacagcacttcatgtccttcacatgccccagagtgcctagtaaagtgctggatacatggatatgcacaaggaatagttgttgagttgaatttgtctgaattaaagagaggaatcaaaggcaaccccgctggtggcaaggctgcagaaaaccttgagaaaatgaaaaggagagttggtttggggaagggggagcagaaacaaaggatgaagttggcaaaataatgaaatattccttaaacttcataaaggcctttatgtaagttacctataaaattttaaaactgtaaaattaatacattgtatggaaggcaagcttacggtacttttaaaaatacatggcagcctcaaaggagttttattcaaaagaatgacacgccatgaatgcggtagttaaaacatgtgggcagctgggagagaattagaatgtggagataaatcacaagggaggcatatgttggctattctgggactgcctcctaatgtaggaggagcaaaattattaaacatgctcatctgttgggataagctctgcattttagcatctagaagaaatctagtgaagtatttgggacagcattattgcaactccttattgtgaagtggagttaataactgaagaattggttattcccaagtgactttccttttcaaattccttgagatttccagagttttatgtttcccattcgctttcatttcagatacacatttttctacagtggtattgtgagtgatgttcatgtgactgagcgtccagccagagtgggcatcctgctggactacaacaaccagagacttatcttcatcaacgcagagagcgagcagttgctcttcatcatcaggcacaggtttaatgagggtgtccaccctgcctttgccctggagaaacctggaaaatgtactttgcacctggggatagagcccccggattctgtaaggcacaagtgatccttggctttcagaatttgcaagaacagcgatttgaattttgggggggtctgctgttcattcctttaggtgctatacattattcaaaaagtctcccgcgcatttgcactaatgatggctgcatgcatagcaatcagcatgtgagcaaaatcgacaagaaaaccttgactttacagagcagtgtgtgagtaaacagaatgaaaacaacaacctccactctttagtttatataagtttgagttctttcctaaattaaaagatctacacttgagttgggaaccgaaagagaaaaatggacttccatctgttttactggtaaaggaaatcctctgatggacaggtcagagtgaaggaaggttgtgctggtaagacatctctgacgaagagccatggatgctttccacaaaatgtcacctcgctgcactaaaggatgatgaatcctaatcattaaaggaattgtttcagctgatttaaatttataatgaactcttttgtaataatgtatactgtagaacatgagtctctcctccctaaaattttaaatgtagaaatgtgctatatattagaaatttccattttgttaaataaatggttagagtctataaagccagtcgtgttatgtgaacttactccatgtaacttactggcctggcatctctggagcaggacaaactgcagagtaaaactcattacacttcagtgcagtgcactactattgattttcctgtgagaattttacacacacacacacacactttaaaatctaatcactctcagaccatagttatagtcaattaacagaagctgggaatctatttttactaaaattaagtggtcattttaagatattatgttgaatccctcaaaatctttctaaaatatgtgtgcaaagtggataaatctagaatgtatgtcaagatgattgtgcttgtcttctataatgtaaatgtgttgatcatacttgtagtttttaaaaaatacttcaaaacttgaattcagatgttttcttttttttttttgaggtggagcctcacgctgtcacccaggctggagtacagtggcatgatttcgcctcactgcaacctccgcctcccaggttcaagcgattctcgtgcctcagcctcctgagtagctgggactacaggcatgcgccactacaactggctaatttttatattttctttttcagacggggttttgccatgttggccaggatggtcttgaactcctaacctcagttgatctgcccgtctcggcctcccaaagtgctgggattacaggcgtgagccactgtgtcccgcccagatattttcttgaattgagaaataatatccttctttctgaatatattctaaaatctcttgtttaatagctagaaaatctgaactggatctgtaactgccttactagagcccttggaggccattaccaccctgattgcagttccagcagttgctggcaagatggagtcttggtgaaactggagaagtaacttgctgctttgtggagaatgttagtttcactttctcaatccttgaaaatgttatcctcaggttctgactgctcagccagccgtgctcattattactggttgttgttgttgttgttgttgttttggtgtgaatgtgtaaccaagtgaattttagaatttatctcagtttggctttctccaaaagtagaccaactgcaaggctcagtgcctgttgtttacctaggaggtgattccaggaagaacatttgaggaagtgggtaaagtcattaaaggacatgtgttatgagtgggttattaccactgtgggcagctgggctctcctgtgccagaggaccctctggaaaccacacagaacataccagaagctgacactcaactcctgtccaacccctattgttgaaggtggcctggagtcattcccatcccccaactttccaagctgcatttcctggtcctgagaaagccctcatcaagagtaaatgagaaacacagacacctgagaaggtatgtcgaaaactgtctaatgcaactgcgcatgcaccctcgctagccgcgggtgaaggggaccaagtgccagcagcatctgccgtcaggttggaagcagctctggaataaaggagaaaaccaccataatggaaagaaccaggtttgaatcttgattgatcccctaatagataatcgctttgggcaattcagatcctatagttatgtcttttctcaggataattataaacaccaggttaaatgagcatgtggaatggcacagcattttgtagtttatatgatatgacaaaggactccagaaatcctctaagtccagccctccactccccagtgagtgaccctcctgtctctgactctgtggcaaggggacggtggaaggtagggctctggggtcaggagatccatgtgtcaacagcctctgtctgccgagtgataggagatttcttggttggtccctgggcattattctagtacagacaagtagaactaaattaatacaatttccacattctattagagaattgtcaagcaatgtttttcttccttggcccttctctgattttcatttcccttccttctttccttcctcttcatataacacagagcctcagagggagggaaggaagtcagcaaattttggtcaaaattgctcccctggaaatctgtcaatgatgtttattaatttaataacaggtacagcacatgaattctttcttttagtcctcatcaaaaccttgcagaataaaaattgttgccattttatagctgaggaaactagtctcagagtagttaagtaatttaccttgttcacagtcacagctggcaggtggcagagtgcagatttagatacagctcaaattctgacctaagattagaatgattatattttgcttcattccttacatagatcatttccccacatatatgtggtgtgtgagaattatgtgtgtgcacacacttgcatgcatatatacactttcccttccccccccggaactgacttccttcctaagcttctgttttgttgttggtgctgtcataactcttggaagacatggggttactttgatttttatttcaatagcaatgtgaccttaattcatgtatgcccagcactattttcacatggttgtttgagagttcaaaagagtctataacattgtttgtggagaaaatactttatcatacatgaaacacaattctgcttctagaagatatggggtcaaaataaaggagtttgttgggggggaggaaatgaggattaacactggggtcatttctctttgcaaacacacctggcaacattagatggacatattctttgttaaagtcggaaatatttttctactggagcaaaccagaacatgttcctgttgtttttctggaggtacttcctcaaagtccaacagaattaaagtattgtacttcatcacacacacttactaagatgtgtgcttaaagtccaaacacaacactctcccatcagaagcatccttaaggcctctgagggctgtatctgaagtcccttctcatcctcactgtgctcattgcccattaatcatcgcaagtgttgagttgctgaaagaacccacacagtttacataggactcaaaacagtttacattggtggaacagctttattacaggcagaggaaacagtacagccacacagaagaaggataggcatggaaaggggtcctgagatctcaggcgcaggcctctttggcctcccactactgggctgcacagtgtgcacattgtctccaggcctctaactaccagcagtgtatgtgtgttgcagcttgatgccaggaagctcaacttttgtctgtggtggtgatggtctctcatagaaggtgagctggtcacagacactttctagctatgtgataggcgtaacctttgaaaatcaccttcctcactcctgcaggctctaccaaaaccaggtgcaacatcaatccaatgatttttactaaacagtgctaacaggcagatatatcctgctctgaaacaactgatggatccataatatagaatgtcacttattgccaattaatagattccatgggctgggcacagtggctcacacctataatccttgcactttgggaggctgaggcaggctgattgcttgagcccaggagtttgagaccagcctgggcaatggggtgaaccctgtctctactaaaaatacaaaaaaattagccaggtgtagtagcactcacctgtagtcccatgttcgtgccactggaatccagcctgggtatcagaatgagaccctgtttcaaaaaaaaaaaaaaaggattctgtgtcattgtccaagcctcagtggctctctaggcatgcaaattgccagttaacatcaggtgaaattaactcacgctaagtacttcttggcttgaattcctgagcccagctgctaaggggtggttcaagaatactactaggaagagctgaatgcctctgctgccaatagccatcctctttaggtccctgatttggtgacttctagggctagggtgtgagtccaggcacatccctgaactgagtgaagttggagttgatttccacccgtcacagtgctcgtgagggaacatatatcctgggctgtttttagagcaggagataatgcatctcattttcctttactacccttgaagtgtgcctctctttcatgtgcccctgtttttgtcctaagtgaactgtctttctatgctgaacttgtttttactattaatatcagtaatttcagatccccaagtaacatatgagctttataatagtttgagaatagttaagagaatgaggactatttggcttggaacaaaaacaccttagggaaggatataagaggtcttcaaagatttgaagagccgttacatggaaggaattaagcttagtttgatttttctactaagagcagtgggtagacgtcccaccaatgggtagaagttgaggaattcagttgaagagaaggaagaacacccatcagtgacagctggctaaggggcatgttgcttagtgggttatgagcactcaggcagaacgatcaactgtctggaatatcaaagagtggattcctgctttaggttctagatagatggtgtttaaactgtgtttctgagtactggaattccatggaggtgcctgaaggtcaatgtgggatccaacaggaaggccaagtgggcatacattcaaacccctatctcatttcatcacactagctcaatttttatctatattacacattggattccatattataatttatttgataaaacaccttctatggtcaaataatgtttgaaaactagaaaacctctaagattcaagtctgaatatgtgacccagggtgatcccaaagcctacaagtcctccattctttcagggtcccctttcttttactatttaaatactgatgtgatgttgactgcaagacattctgtttcctatcccaaatttccaagaattcctgtaggcaattacattttcctggttaacacctctgacctcctgcttccaaatgctcctcctcacccctagccatctcatcattacttcttaatgttcccctaggcccatttggtctgcatcatcccaaaacatggacatggtgctcctttgattccttaaggcagtgctaacacaaggctgccatcgttagtggttaacatggcttttctttaagacttggggtgactgagggcaagttttcatacataaaacttcatacataaacatgaagctcgatggaaaacatccagcattgtaaggagccccttctgaacttttcttcaccccattttcctgcatattgaacagactactccattttatattattctgtaagttttagcctctgctcaagctttggtttttcagagcaggcaatgaaatgagaaaacaccaaacattaaaaacacctctcttaccagtatagacatctttcataattttatgacagcaaaattttgcaccccttatctgtgtctctgctatccttcccaagtgttaggcttctctctgcagaactaaaaggcccattaaagcaattctcccaaccaaagcacattcctcttcccaagatgaatttggtcattacctccgaggatggttttagaatccccttagcatctccccttttgtggttttctgtagaagtagccaatgatgagaaattctttttcaacctaactggacttcattttgggttgccccaataccatgaagaactttattctttgaaggatttcaaggagaaatgataccggtctagagtcaacatgctactttaagattttataacttagggggaaggggttaaaataattaagaaaaagaaaaagtggtgaaggagaagcaccaatcattcagcacatctgtagttgtgttcaccatgggttgggcaccatttaggccttaaggaaatggcagtcattaaatcaaacaaaatccctgctctcaaggagcctgcattctagtggaggaagacagacaataaatacaggtattgtatgtcagtggggaataagaactaggaagaaaaatacatcagagaagagaataaagaataataagaagtaccagctgggcacagtggctgacacctgtaattccagcactttgggaggctgaggtgggagggtcacttgaggccaggagtttgagaactgtgtgggcaacatagtgagaccctgtctttataataaaataaagtaaaataaaaaatttttaaaaagtaatagcaggtagggggtgctgtatattttaagtatggtaggaaagtatctctgataagatgatatttggctaaagagctaaatgaagtgagggagcaagccctgtggatgtgtgtgagggaggagcatcccatgcaggaggaatagaaaggaaggaggtcttgaggaagcaggatgcgggtgcattagaggaagagtgaggatcccagtggggctgcagtggaacacgggggagagaatggtagtggatacagtccgagagtagctggggactggttcacaatggccttgaaggccaagtaaaatctttctgttatattctgagtgagttggaaagaagttatagtcatgaggagcagaggcaatggcagtcaaagaatttgcttttccagtgtttgggtatcatgtttttcaatatcaaatggggggttttataaaggcctcctggcctggccttttgccattttcagcttctgcagaaaagtgctgaaagggctgtatgggtgggagagaagaacaggcattctttgtctcattctcagctctgtccaggatccctgtggccctgctcacttcctgctttcaagaggagcagctgctgctgattggttgctattaggaccagcctagagccaaactagggggaaaaaaaaccctgctattttacccgggctgactttgggctgaattgagtctgtttgtccactatgaaacgttggcaaccaccaagagtggagaaaaatacaagcacatttgaatgtttcgtatctttttaactgtgtgattttacagttacagagaagatgagataatgacataatctagggagactatctggccaaacaggcctcatatgtgtgtatctatgtgtgcatgtgagtgtgtgtatatatttcatatgtgtgaacatgtttgtgtgtatctatatgtatacgtgtgtgcattcatgtggggaggtagagggatgggaagaggtaaattatcatgacaattcagggatggttttcccactgaagagtccaaaactggacttgggagagcgtttaaaggttgtcagatccatggtactcagtcacattaatcaagctcacaaaagactaattaataattcagaatgccatttgcttaatttatagtgagagatcaaattgccaagggggctggggaatgcatatctgctagtcaggggattctttcgctaggaccctgagctccaggccctgcaggcacccacatttggggctgggctgcacagactgcttgaggctgcctacctgtcaaactccacattctcaagagaacagatgtatcttcacgagggaagcctgtgatagtcaaaaagattgtttggtgatcaaggcaaggcacgtggatggtgtgaatggccaacattattgaactgcacggccagccgtgtggcccagatagttggttttgctggtcggagtactttcttcctgcatcagcactgggcttccctgagaaatcctgatactttgccgcggtctgtctattcagtctgacttcttacattcacaattccctaaaaaaagatgtctgaggactatttcccagactatagttttcttttttatttagtgaatacttgattagatttctgggccctccccctcctgcttttgatctgaaaactattgtgcctgttatggtaacctttgtggatgatagaacttcatttattatgtgaagatcgtgctaacttaatactcaaaagaaaaccattcttgcaaatgcacatgtcacatttcaccatctcccatgggttgactacaggtgggaggaggaggagattttcattcaaggatttggtgtaattaatgagagagagcagttcagaaccagaaccacttgaagatctgggctgagacacggctctgctcgttcatatctatgcgtctttagacaaactgtttagcgtctcttagggtcatcattgtaaaataggaataatacttgctatggtttgaatgtgttctctaaaggttgtattaaaaacttaatccccagtacaacagtgttgaaaggtaagacctttaagaagtgattacttcatgagggctctggcctcatgaatggagtaatgtcattatcttgggagtgagtttgtcattgtgagaacaagtttagtatgaaagtgagtttggcccccttttgctgtctcttgtgaactctttggcctttctgccttctgacatgggatgatgcagcaagaaagccctccccagatgtgagccctcaattttgggcttcccagcctccagaaccaagagctgaatgccaataattttaattaataattaataataaatttattttaattataaagaattatataactgtaattctttataattatataattatataaatatataatttttatatataaaaattatataatttctttattataattcaattataaattacccagtttcagatattctgttatatagcagcacaaaatggactaagataggtggttcattcagacaacaaatattaatcaattactaagatgccaggcactgcagtaggtactaggcatacagcagtgaccaaatttaaccaacattcatgccctcaggtagcttatgttctagtgagaggagcatacaaagaaggagataaatacataaagtgtttaatatcagaaagtgacatatgctgtaaagaaaaataaagcagaaaagggctgttatgacaagtaaatgaaaaaattaatgtatgtaaattcttggcagagtgcctggcataaaacgacagcaaacattttagctgttcttactaattcaactacaattatagagcttggtgtacccctcagaatagcacaatgtcctctcacacacctcagcatgtagttaggctacccatgaccactgtatttccaatgaaagttgaatatttttctatttttgcttagggcaaaaattcaggaaaagtatttagaacaacgcataaattatccttaatttcaccactcagagataactggtattaacatttgatgtatattttccctggctcttcttttttctttagacacacatcacatgtttttaaaaatgcaaataaactccctgctatctaatctgctttgatcacttaacgctgttatgaatatctcatgtcaacaagcacagattcacatcattattctcatgcccaggtatagtccactgaaaaggtcaaccttaaaccttccaactgctccctcactgattaatacatgtccaactgacatcccaagttttcatttctatgaaaatgctttggttttaaaggcaccaacttcactatttggccccgagtttatcttgatttttatcatgggaaagtgtatgttgtttccatatttactatgaactttaatcagtttttataaagccagcagggaagattgagtagaactctttcatagggcaagcttggtgcccactttcatttatagtcaattcaatgtcatcatattcaactgaaatatatttttaacattcaccgtgttaggacaccaccctggctcctgctggaagccaagatgagtaagacataattcttgtctccaaggaggccgtgacagatacacagacatctgtgatacggtatataggtcagaagaatcatgacatttcaaagtagagagagaacatattggtttggtgttctcatgaaaggttgtgcagagttcagggcatttgggacatgcttttattgtagtaggtggtggtgaggattagggaagtctggacagaggcaagagtatgagacaaatgggaaacaggaggggaaccatccaatcggacacaggaaacaagtaaggaagcagtgagcagcaaacctggaaggtacct

SEQ ID NO: 502 - DNA, 53725 bp, Homo sapiens
aaataacaaagatcagagcaaaactgaaggagatagaaacacaaaaaaactcttcaaaaaaatcaatgaatccaggagctggttttttgaaaagatcaataaagttgatagaccgttagcaagactaataaagaagaaaagagagaagaagcacatagatgcaataaaaaatgctaaagggaatatcaccagtgatcccacagaaatacaaactaccatcagagaatactataaacacctctatgcaaataaactagaaaatctagaagaaatggataaattcctggacacatacaccctcccaagactaaaccaggaagaagtcgaatcactgaatagaacaataacaggctctgaaactgaggcaataattaatagcctaccaaccaaaaaaaggctacgaccagatggattcacagccaaattctaccagatgtacaaagaggagctggtaccattccttctgaaactattccaatcaacagaaaaagagagaatcctccctaactcattttatgaggccagcatcatcctgatgccaaagcctggcagagacacaacaaaaaaagagaattttggaccaatatccctgatgaacatggatgcaaaaatcctcaataaaatactggcaaactgaatccagcagcacatcaaaaagcttatccaccatgaccaagtcagcttcgttcctaggatgcgaggctggttcaacatacgcaaatcaataaatgtaattcatcacataaacagaaacaacaacaaaaaccacatgattatctcaatagatgcagaaaaggccttcaacaaaattcaataggccttcatgctaaaaactctccataaactagatattgatggaacatatctcaaaataataaaagctatttatgacaaacccaccgccaatatcatactgaatgggcaaaaactggaagcattccctttgaaaactggcacaagacagggatgccctctctcaccactcctattcaatatactgttggaagttctggccagggcaatcaggcaagagaaagaaataaagggtattcaattaggaaaagaggaagtcaaattgtccctgtttgcagatgacatgactgtatatttagaaaaccccattgtctcagcccaaaatctccttaagctgttaagcaacttcagcaaagtctcaggatacaaaatcaatgtgcaaaaatcacaagcattcctatacaccaataacagacagagagcaaaatcatgagtgaactcccactcacaattgctacaaagagaataaaatacctagcaatccaacttacaagggatgtgaaggatctcttcaaggagaactacaaaccactgctcaacaaaataaaagaggacacaaacaaatggaagaacattccatgctcatggataggaagaatcaatatcgtgaaaatggccatactgcccaaggtaatttatagattcagtgccatccccatcaagctaccaatgactttcttcacagaattggaaaaaactactttaaagttcatacggaaacaaaaaagagcccacattgccaagacaatcctaagcaaaaagaacaaagctggaggcatcatgccacctcgctttaaactatactacaaggccacagtaaccaaaacagcatggtactggtaccaaaacagagatatagaccaatggaacagaacagaggcctcagaaataacaccacacatctacaaccatctgatctttgacaaacctgacaaaaacaagaaacgggacaaagattccctatttaataaatggtgctgggaaaactggctagccttatgtagaaagctgaaactggatcccttccttacaccttatacaaaaattaattcaagatggattaaagatgtaaatgttagacctaaaaccataaaaaccctagaagaaaaccgaggcactatcaatcaggacacaggcatgggcaaggacttcatgactaaaacaccaaaagcaatggcaacaaaagccaaaatagacaaatgggatctaattaaactgaagaccaggccgggcgcagtggctcacgcctgtaatctcagcactttgggatgctgaggcgggtggatcacaaggtcaggagttcgagcccagcctggccaatatggtgaaacaccatttctactaaaaatacaaaaattagccaggcatggtgatgtgcgcctatactctcagccacttgggaggctgaggcaggagaatcgctgaacccaaggaggcagaggttgcagtgagccaaaatcgtgcccctgcactctagcctgggtgacagagcgagactccgtctcagaaaaaaaagaaagcaaaaaaataaataaataaatactgtctgcacagcaaaagaaactaccatcagagtgaacaggcaatctacagaatgggagaaaatttttgcaatctacccatcagacaaagggataatatccagaatctaaaaaggacttaaacaaatttacaagaaaaaaacaaacaaccccatcaaaaagtgggcaaaggatatgaacagacacttttcaaaagaagacatttatgaagccaacaaacacatgaaaaaatgctcttcatcactggtcatcagagaaatgcaaatcaaaaccacaatgagataccatctcacaccagttagaatggcgatcattaaaaagtcaggaaacaacagatgctggagaggatgtggagaaataggaatgcttttacactgttggtgggagtgtaaactagttcaaccattgtggaagacagtgtggcaattcctcaaggatctagaactagaaataccatttgacccagcgatcccgttactgggtatatacccaaaggattataaatcatgctattataaagacacatgcacacatatgtttattgcggcactattcacaatagcaaagacttggaaccaacccaaatgtccacaatgatagactggattaagaaaatgtggcacatatataccatggaatgccatgcagccataaaaaagaataagttcatatcctttgcagggacatggatgaagctggaaaccatcattctcagcaaactatcacaaggacagaacaccaaacgccgcatgttctcactcataggtgggaattgatcaatgagaacaattggacacagggcggggaatatcacataccggggcctgtcgaggggtcagtggctgggggagggatagcattaggagaaatacctaatgtaaatgatgagttgatggctgcagcaaaccaacatggcacatgtatacctatgtaacaaacctgcacattttgcacatgtaccctagaacttaaagtataatttaaaaaataaaataaattttttaaaaatgttaaaaaaaaaatctgtcatcccttcacaaagctaattccttagccacaactaagagttctccgtatccagagtaatccattcttccaaaaatagcactttattttatctatgcaaaaacctttacagtaacaagacaaatcctaaactcttctgctgggtttaaggtctttctaattcagcttctctttattttcctaattctcctctccaacctgggacataaacatattcttatcttcatgtgtttgcttctcaactgcatttcctatcttaagcgtccttttcccatctcacctcctttaagaccatgctagaaatttgatctcctttcaaactagggtgtttttaaccttttggtcctgaaatacctatggcatacatttttatctgttatctgttatcagtggctcattcctggaagcagagtatgcatgtgtgtgtgtgtgctgaatgagctctcatctctaaataagtctgaaaaaatccctcaagaatgttctacaaaatccttggagatataccagcacacatagctttcctcaatcacccagtctgtaccactcattttagcccctgttcatatacttccttgtaccatttttcagtgtgtatttcttgtaccctcagtaaaactaagctactgtcactgaaaccatgctttatatttctcttgtataattacccaaatacaaggctgagtgtcctttaattgttaaacaagtattggttcaattaaacggaagtatttcatagaacttccaaattagggccgggcatggtagctcatgactgtaatcccaacactttgggaggctgaagcaggtggatcacttgagctcagatgtctgagaccagcctgggcaacgctgtgagactccatctctacaaaaaataaaaaataactagccaggtgtggtagtgcacacctgtggtcccagctactcaggaggctgaagtaggactgcatgagcccaggaggtcaaggctgcagtgagatgtgatcatgccaccgaattccagcctgggtgacacagcaagaccctctcaagaaaaaaagaaacacaaaattaaaatacaattttcattaaaaggaattatcatttcaaagttatgattagtctcagctgggcgtagtggctcacgcctgtaatcccagcactttgggaggccgaggaaaagtggatcacctgcagtcagaagtttgagaccagcctgaccaacatggtgaaactccgtctctactagaaaaacaaaaattagctgggtatggtggcacacacctgtagtcccagctactcaggaggctgagaggagaatcgcttgaacccgggaggtggaggcttcagtgagccaagagcacaccactgcactccagcctgggtgagacagagcaagactccatctcaacaacaacaacaaaagttattagtctcaactactacacaattacccttttgaaaagttttttacgaataaaaagttatattactatatttacttattttattttattttattttttgagatggagtctcactgttgttggcctgggctggagtgcaatggcgcgatctcggctcactgcaacctctgcctcctgggctccagcaattctcttgactcagtctcctgagtagctgagattacagctgcccgctaccatgcctggctaattttttgtttgtttttttttttgtatttttagtagagacagtgtttcaccatgttggccaggctggtcttgaactcctgacctcaggtgatccaccagcctcccaaagtgttgggattacaggtgtgagccaccgcactcggcccatatttaaatagtattatatttaaaatagcacaggttgagcatcccttacccaaaatgcttgggatcaaaagtgtttttgaatttcagattttctcaaatttgggaatatttgtatcacactggtcaagcatccttaatccaaaaatctgaaatccaaaatgctccagtgaacatttccttccagcatcatgtcagtgctcaaaaagattcacgttatggggcatttcagacttcagatttaacctgtaacttctatttcaatatgttagactaggacaccatttatatcttgcacaaaactccacaaattaaacatgtagtcctagcatggacaacacagcaagaccccatctttcaaaaaaaaaaaaggaattagcctggcatgatggtagtcgtagccactccagaggctgaggcaggaggagtgcttgagcccaggagtttgaggctgcagtgagctatgatcacaccactgcactttagtctgagcaagagtgagaccctctctaattaataaataaataaatacataaactaaacatgtagcattatttgtccttaaagctcaaataatgtccagagcaagttcatataccacacaatttatttatttatttttagaaatgttcatagtagctttattcataatagccaaaaattgaaaacaactcagtgggtgaatgataaataaactgtggtacatccacaccatgtaatagtactcagcaatgaaaagaaacaaattattgatacatgcaacaacttggatgttaaagccaatccaaaaaggtcacatataaaatttcatacatttaacatttttaaaatgacaaagttaaaggaatgaaaacagatgagtggctgacagagatcagggaaagggaagagggtgggagggacataaatgtgactataaaaaggcaacacaagaattccttgtggtgatggaactgtatcttgactgtagtgaatacatgactctacaccagacaccacacaatttaaatagcagctattctaaagcatcctagctttaaatgcatattgaattacctatttcaaagggaattttaatcaatcctacttagacagaatgtttccttcaaatttgttacttggtacaataattgctaacacttattgagcattcatcatgtttcaggtactcttctaagccctttataaatattttctcatttaatcttcaaacaaccccatgaagtagatcatgctcccagctaacaaataggaaatcagacaagttaagtaacttgccaaagtcaacaagttagagtggaagagtcaggatttgaatccagacagtctaactctgcaatgagtgcacttagctacttctttcacgttgccttttaaacagggatcaattatgaggcaacataagccctgctgaatttgactccttaaaagagaaatgctatgaatcccaaaaagattttaaagtctaggtgactttaaaaagtctagcaataaatgtaggtgagaaaaagactatcagcactaagagggatggttttgaaaaaacatgtcaattgtgtatttaatgttaacgtaaaatagcccaatccacgaattaaagattagcaaatgatttatacttattttaccttctcatctcacactcaagaatgtgtaatttttgcccagcacaataatccagaggttattaatataccttggctcaatatattactgtcccaatactcttccttccaatcggaagcaaagaggtcctcttacttgtatctcccctggacaccatctcctttgtgtacttcagccttttttttttttttttttttttttgagacagggtctcactctgttgtccaggctggagtgcagtggcctgatatcactgcagcctccacctgctgggctcaggcgatcctcccacctcagcctctcgagtagctaggactacaagcgtgcaccaccacaaccaggctgtacttcacatctctatcatctttaatcactcctatacaggatccttttctttcactgccaagcatattctagtatttctaacattaaaaatttgtgtttaaatccaattcgtctcattccttctgagaccaatctcctggaaacgtcgtctacacctattgcctccagttactaataaatattttactagaaatcttcagcaatctctttcttccatctatcactacaaagaaactgtactttcgaagatcattgtttttgccaaaaccatggccaaatactttgttcatcaagtttgttcatccttactcctctaaactttctgggaccttgtttcctctgacattccattttttaggggcttttctcctccttactttttatagttccaatttatttactgattctttttttttcctcatgttccaatagtaggtggccccagattctgaaaatcattcattctacataggaaaataatcattctatatgactcctaaatctctgtcttcagaccattacagctgcaacccagtcctgcatttccaacctccgtcaaactcattaagttcaaaactaatcatcgcttcacatcttattcaatctttctttgccaactactgtactctgttttgctcagtaataattccattcttccttttcattttctttccccactaaaaaaactttcatcatcttttactcttccttcaacatcacctttacatctaaaaagttaactttgttaactttatcatcaaattctcacatatttcttttttgaagacagagtctcactctgtctcccaggctggagtgcagtggtgcaatcttggctcactgcaacctccacctcccaggttcaagtgattctcctgcctcagcctccccagtagctgggactacaggtatgcaccaacacgcctggctaatttttgtattttttggtagagatggggtttctccatgttggccaggctggtcttgaactcctgacctcaggtgatccgcctgccttggcctcccaaagtgctggattacaggcataagccaccacacctggcctctgacatatttcttaaaaagatatacacttgtcctcttagatgtgggcttcactttcattctcaattatagctacttatcttgttcccaatcttagcccctttccctaatccatcatcagtctttcattgtcaccacttttatcattaccttgcttgagatcccataacagttcccacacatctatatgaagtcaaatcagaattcctgtctggctttcaaggcactactgtatttgatcttattatctgatcctatccaggttcattttctactacttcagttcttccccaagatccatcgacattagcctttccaaaatccaacattctgcatacacttcctctaaggttttgtatacaacattggggggtggggggatgggagtgaagaaagttccagtagacaattctttaagaggttaaatgacagccctatacccaaacatgcaccccctactctagacagatgatcactctactgttctccctgcctttttattcaccttatcgccaattaaaaacacttctctactcccgtttgtctcagtaaatcttatccattttccatgtgccatctcctcagaagttttcctgagcttggcagggctagttctcttgacaattccacttgcagttgtggttcacagcacacaagtaaagctttgttgtttctcttgtgattagtccgtgaaggggctctgacttgatcacttttctacattgccaccaatacctaaatccaaccgccccaatgccaatacttagccagtgttaagcacgtagtgtttaaacacacctcaacacgcaagtattgtaagataatgaccacacaacagggcaaatacaaagttaaagcaggtccgggaccaatacaaagcatctttaccaataaaatgccgtgatgacgctgtcacccattccggattcacgaatcattcttcaaaagtccggctccaaaactatgtggagactgaaatcccctgaagaaaaaaaaaaaaaaccgccaaaatgacagctaagacagaggccagactaacccctggccctcccaaattccctctcgctccacaagtgggttcacaagagacacaaacgcacccaggaagacctccgctccctcagacgcggggcgggccctgcgacttcactctgggagggacatttccgctcacccagctctgcgaccctcgctcctgcggagtcagcttctgctcgcggagggggaagggcaaaaggacagtgcgtcccaacccgtccctctccagctgagcctgtcagagaccagcccagctctgaaatcaagccgttgagaaaagggaattcggccctccgccgcctcttcagtttaaaatcgtttcccgactcgctctgcggccccacgcaggaagcctccttggcgcctcgccgattccgtatcagtgaagcaactaaaattgccattttaactgagggcaaggccgagccacttaaccactatcgtcaacctttccaatcgtgctcggttgctcctcagttttcctaccggtgcgaagctttctctcaaatttccgcccgtagtaggcatggcggcggcacctcaccactgattcgttgaattccttcccggtaatcttgggcactagcgggcggagttgaagggcgcttggaccccagcggcgatctgtgtttgggttcgcgctctgggagaattttggctttgctcgccttcctctttcagaagactcgaaatcggccagcaggtctgcgagatttgaaacgcgactgttactccttgttttccggttctggccgcgggagcctctcgagaagcgtggaaagaggagaagggcgtataccttgtgaccgcctctggttgtcttgggctcgcgcctggcgccgctacgtggagtcgctctctcgtcgtcacttttggctgccgacttgttgagtagaagtgcagactgatgctttaagactcagggagaggtctttcccttatctccaccccagcaagcaccccagagaccttggagatttgtcttgtttctagacacgtgtactccaatgttgtgcggaggaggccttaaatattcgagaagagagtgggaactcctggaattttaagggatttctgtgtatttccaaaactgacttttaactaccggcagcgtgggatttcgtgattgtttttcgccatcgtgtggctccaacatgtacttcccttcttggttaagtcagctgtacaggggtttatccagacccatcagaaggaccacccaaccgatctggggttctctctacagaagtctgttgcagagttcacagaggagaattccaggtgaaaatagcgaagagatctatcctatgaacagtacttcagcctgttatctacggccggagagcttttattccatttttcattttttcccccattattattattattattattattattattattatttgagacggagtctcgctctgctgcccaggctagagtgaagtggcgcgatctccgctcactgcaagctccgcctcccgggttcacgccattctcctgcctcagcctcccgagtagctgggactacaggcgcccgcgaccacgcccggctaatttttctgtatttttggtagagccggggtttcactgtgttagccaggatggtctcgatctcctgacctcgtgatccacccgcctccgcctcccatagtgctgggattacaggcgtgagccaccgcgcccggcttttcccctgttcttaactggatagccttatgtgtagaagcgaaattcactctcattatattcattatacggcagttttttttccctgagtttttagaaagaccacaaaaaggtaaccacgtaatatatagaatactctgcttttggttgatgccttaaaaaaatccttcttcggccgggcgcggtggctcacgtcgttaatcccagcactttgggaggtcgaggagggcggatcacgaggtcaggagatcgagaccatcctggctaacacggtgaaaccccgtctctactaaaaataaaaaaaaaattagccgggcgtggtggcgggcgcctgtagtccccgctgctggggaggccgaggcaggagaatggcgtgaacctcggaggcggagcttgcagtgagccgagatcgcgccactgcactccagcctgggcgacagagcgagactccatctcaaaaaaaaaaaaaaatcatttttcacagaattataatagtgttttctagtgtacaagtggctgttaaacactagattcatactaaagctaaatagttcctacaccgtccatttctgcagtttctaaaatcctatttcatttgaggaagaaatgtgcaatattaagaattgggtaattaggattttaggtcaatgcaaatgctagaagatcaaaaaaattttgatttcctaacacaagacagaaatttacattcagttattcacttggcttttgacacatttgcaggtaaatttaatagtgaatgaattaaattacatactctgacttattttattttataaatttcccctgtagccctgacatacctaagatatattttgagaattttcatttttaagcaacctgcaagtgatgtatttttaatcttgccttttaaagtttctttttttttttttttttaaagaattcagtagctttgttgtccggaccaacacatgtggagagttgcgttcgtctcacttaggccaagaagtcaccttgtgtggatggattcagtaccgaaggtaaattgagaaagacagtctaagaatgcatggtggtggttttcccagggcaattccaaacctttactaatttacaaccagtccgaagaataaaacgttttgcaactcctgcaggattaagaacttactgaattttcaactttgttttagttttgaaagacccaagtgtcattctcagtagacattttgaaagacccaaatgtcattctcagtaggtacatctcagtaacatctgttgaagggtataacaacgaagcttgatccaccagtggactgaaatgatactgggcttactaagactgaagagttcctataaccagtaattaaaaatgggccagcctcctataaaccagctgttaaactccaatagcatgggggaaaagctcatcttattccatgtaggtagagaagaagcctagaaacataaacagtgattccttaagatcagagcccattttttgttgttgttcatctctctattccagaacatgcctgaatagaacattaattcacatggaagagattcaaaatacataggttatatgaccttcttaaagaatatgtcccagcctggcgtgtaagcctgtaatcccagcactttgggaggccgaggcgggcggatcacgaggttaggagttcgagaccagcccagccaatatgatgaaaccccgtctctactaaaaatacaaaaaaagttcgccaggcggggtgatgctcgtctgtaattctagctactcaggaggctgaggaaggagaattgcttgaacccagaaggcagaggttgcagtgagctgagattgcgccactgcactccactctgggcaacagaacgagactccgtctcaggaaaaaaaaaaaagtttgtcccaagtaggtggatatttttcccataagtttagtgactgtttcctgaacccaaatctgaagagggtttctgtacctgttcctgatgctgaggatagtatgagaaatagaggttggatgttaaaatgttggcatttctgggaccttttgatgattcatagaggtattaaattagtagttggaactcttccagaaaatgttagattgtatctttttttagaaaaagactatattgctatatttcaaaaatgatccatcagatgtttctattatgctaaaatactatctttggattttactatatgcaaagtttccaaatttaataaaattttcttaaaaggacttaagccaatgaaatttcttttaattgttcatctataataatttttcattaataagccatctgtataagattaatataccaggtaagtagacaataaaaattgaaactgaaataaaaaacaatcttttttttggcaatgagctacatagataacaattgcatgaatgtaactaatgaaggtacataattatcataaaaaacatgaaaaattataattatcataaaaaagaaacatgaaaaattgcatggatttttgtttgctttttattttgtatgcttcaactttggacttagagattttatcttaaaatgtttcttttccccccccccattaatcaggcaaaacacattcttggtcctaagagatttcgatgggcttgttcaagttatcattccccaggatgaggtaatagaaaatttcctgttattatctaaaagcttctttgatgctattgctggggtaagctaagtagttagatgaatatgttagaggttttaaattcagaagtttattgttaatgaaaactgaaaaatataagcaatgttaagacatagcaaaaagaccagtgacccagtagaattaggaacccaggatacgaacaaaaaatttagaggaaaaaaatatataaatggcttgtagacataatgaaagtatgcccagcctcactcataggtagagaaatgtgaattgaaactgcatgtaattgtcatttttaacacattagattgacaacacactgtgtttgggaaagcaggtgctcaatacctggagggagtacaaattggcactagctgaagggagagcaatttggcaatatcaaaactataaatgcatatatcctttgagccattaatttcacttctggtaaattatcttatatctagacttatacagatataaaatgacatatgtacaaggatattcatttcaggattctttttaacggaaaaaaattgggaaccacccagatgtcctccaataagagactggcttaaaaaataatgtatattcttacaatacaatactctactcagccgtacaaaaaagaatgaagaagttctattctaatagggaaaaaaaaatccaaggaatactgttaagtgaagaaccctgtattcttgagtatacaaaagagcagctgttaaactccagcactctaagtgctgtcatctgtataaaaactgggggaaggatgcagaatatacattcagtgtgtgtgtgtgtgtgtgtgtgtgtatttgcttgtatatatgttaggaaatgtctctggaaggatacctaagtatctggtaacattaggtgctgctgggggaaggaactgagggcgttgaaaacaaggataggagggaagctttttactatatctttttgtaccccttgaatttgaagccatgtgacggtattactgctcaaaaaagtatttaatttaattaccattgaaattagataaaatatgacagagtgatattctgaaaaaaaaatttttttaattaaaaaattcaaggccaggcatggtggctcacacctgtaatcccagcactctgggaggccgaggccagcagattgagtacaggagtttgagaccagcctgggcaacagtgaaacctcgtctctactaaaatacaaaaaattggccaggtgcggtggctcactcctgtaatcccagcacttttgggaggctgaggcaggtggatctcgaggtcaggagtttaagaccagcctgaccaacatggtgaaaccccgtctctactaaaaatacaaaaatttagccgggtgtggtggcgggctcctgtaaccccaactactcaggaggctgaggcaaaagaatcacttgaacccagaggcagaggttgcagtgggccgagatcacgccactgtactccagcctaggcaacagagcaagactctatctcaaaaaaataataataatacaaaaaattagctgggtgtggtggcatgtgcctgtagtcccagctacttgggaggctgagttgggagaatcacctgagcccaggaggttcaggctgaagtgagccaaaattgcaccactgcactccagagtgcacaccagagtgataccctgtgtcaaaaaaaaaaattaaaattaaagaattagataaaataaagaacttccatcatacttactgggcaaagttggtttctattgcaatttttactaacgcttgtatgcctaagaaaaatattatttattcagctcttaagttttgaaataaataaagagcaatgaattatcttttagggatcaacatccagagatgagtatagctaaccctggagaactcctttgactctgacccattattgctatgggatttaactgcccctaagactaaccctggagacaattgcttttcaagtatgtgggacttgtttgcactaataatagtcattcttacccttattttcctttaaggaaagtttttttaaagctcttaactaatagttttacttgctgtattatatagagtcaaaatggggatgcagtttttactaaatttggtaataaagtcattaaggagcagccccagcctttatggtaattaagctgtgactattaacgttttttaaaccatctacttataattactgaagattcctgtaagttcatttgtttctcagaactcttttcccccttgttctgtagtcggcagcctctgtgaagaagattttatgtgaagcccctgtggaatctgtggtgcaagtgtctggtacagtcatttcccgtcctgcaggacaagagaatccagtaggtagtttcgaagatatctgtgtaatttttgcttgtatgcatttgcaccatctgtgtacacattctggcaacacatgactggacattaggcactaaagttgaataaattctacaaatgaactgacagatttcaaaatcttgactataaacaaacacatctatgtaaatatgcatgctaagtctcactctgtcaccaggctggagtacggtggcgtgatcttggctcactgcaacctctgcctcctgggttcaagtgattctcctgcctcagcctcccgagtagctgggactacaggtgcatgccaccacgcccagctaatttttatatttttagcagagagagggtttcaccatgttggccaggatggtcaccatctcttgacctcatgatctgcccatctcagcctcccaaagtgccaggattacaggcgtgagccaccgtgcctggccctttttttttttttttcaggacgggtcttgcagtattacccaggctggtcttgaactcctgggcttaagtgatcctcctgtctcagcctcccaagtatcagactgcaaggatatgccatgacatttgttgatatctgaacacatcagccacatatgcataagaatgtcaaaatcatgcacagacatgtatgttttatactatacactataaggactttgcacattttacatatgtaaataaatgcatagattctacaaatgtgtattttgtgtatatcctgatgagtaatttttaaaacccttccttctcactctccaagaaaatgccaacaggtgagattgaaatcaaagttaaaacagctgagcttctgaatgcctgcaagaagctgccctttgaaattaagaacttcgtgaaggtaccaacctctgttattaataaaatagagtatctagaaaatgttgatgactagtcaagtattttcagagttttttaaagaaaagtttaacttctacaaaattaagcattttattgtagacacatcatgaagtgttctcttagttctacaacttcttggcacactgtcctgaaataatgacagttcagtaaactgttgcagtccctaaatacctagactgttttttcagacagattaaaatgtgattctctctttaaaacttgaggtgttatattattcaagtttttcgttgctattgtttaacatttgaaaggaaatttatgtctagcttagaaatggccagatgggacaggggatcctgtatctattaagtgataaaatgtgtgcttagagcaacgcttgacctcccaagcatataaatataaataggattaccataatttagaatgttctttgccaaagtttaagggcttgatggagctgtacactcatatgattttcagctttgtcacagtttatagacttatatattcctaatttttaaactgatctattaacagatttttaattagtcttaattaattagtcttacatttaagttcatggccaattagtcttacatttaagttctcaatacttacgtttaagttcatggccaattggtcttacatttaagttctcaatacttaattatctaattagaaagagcaatgtaattatagagttgaccttattttgaaaaagaaaatatatagttttccccagatgagcattcaaaaagagaagttatagacatttcctaagttttcagcacaaagagggatgcagagatttgtagccttgaaaataagcaaactaggctgggcatggtggctcacacctgtaatcccagcactttgggaggccaaggcagacagatcacaaggtcaggagttcgagaccagcctggccaatgtggtgaaaccccgtctctactaaaaatacaaaaattagccaggcgtggtggcaggcacttgtagtcccagccgctcgggaggctgaggcaggagaatcgcttgaacccgggaggcagaggttgcagtgagccgagatcatgccactgcactccagcctgggtgacacagcaagactccatctcaaaaaaaaaaaaaaaaaagagagagaaaataagcaaactatttctactagtacagccatggagattccatccactgtccctttgcattctttacacttgtagtcagcgtcccattcaggtgaatcttctactctgatgtatctttttttaggagatggggtcttgctatattgcccaggctggcctcaaactcctgtgctcaagtgatcctcccacctcagcatcccaagtagctgggattataggcacatgccaccatgcccagatacagcataatggtgctgtgtatttttctaagagacctttgaaatctttaaatttttttcaagattcaactatgggcttaaattaatggataaatgtttagtaaagtaggcaaatttcagtcagtgaagagtgatattattaataatgaatagtaaaaaaatgtaaaatctgcactgatgacaaacttagaagttgtaggaattaacagcatacagtgggctacttaatgatagaaactaaagacagagctaaaatttttgaaaattcaaactctttctaaagataatacctttctaatattgaaaaatatttaaatataaaaatctttcaatttctttagaaaacagaggctcttcggttgcagtatcgctacttagacttgcgtagtttccaaatgcagtataacctgcgactgaggtcccagatggtcatgaaaatgcgggaatatctctgtaatctgcatggtaagagaaatgcctggatgctctttggagctttgtagcatctcttctattttattcagcagttttattgtatcctttccttagcatgaggtcaagatgttgccagaagtctggaattcactcaatgtgtaatgtagtttttgaagaaaagttaacattattttaaagatgataaagatgatagtcgctattacattgattaatgtattatagtatttcccatcatcatcaaaggcaggacagccctttggctttttctataagatttcttttcttttttttttttgagacggagttttgctctggctagaatgcagtggcattaccacaactcactgcagcctcaaccttttaggcttaaccgatcctcccaccacaccttcccaagtagctaggaccacagacatgcaccaccacacccagccaatttttaaaaattttttgtagagacagggtctcattatgttgcccaggctggtctcaaacttctgggtttaagcaatcctcccacctaaccatcccaaagtgctgggattacaggcatgaaccacgatacccagccagttttcttaattctttatcatgtgcatacatcacttattgggagctcaaaaatgtcatgtgaattaaactagacatctcattcagtcctggactttttctgctatatttgtgttatttctacactaacagaacatttaaaaaatcagaatagttcagtagacaagaatccattaaatatttagaattattttatgtgaacagtatgctttatgaacagaatagtatttatgaaaatcttcagcttccttcttagatttgtagaaaccagcaccagtaggcttggtagcttatttcagctaaaattcttaattaaagggaagcctcagatttgttgtactatattgtggacatcatatatgacaaatttcacattcctatctactaagtgataatgtttctctctttttagggtttgtggatatagaaacccccacattgtttaagaggaccccaggggtatgtatattccttcaatcagtctattaataatgtcctattagttataaagctagactactttgcttttatattcacttggtccacttttatttactgcctcaggatggtcatattaactaggtttttctgaagaattgagaaaattatttgggtattttgagtcagaatcattttattccacataaattttctttcctttgagtttttttgtttttttttttttttttttttttttggtttgttttgggtttttttttttgttttttttttttttttgagacagtctcactccatcacccaggctggagtgcagtggcatgatctcagctaattgcaacctctgcctactggatccaagcgattctcatggctcagcctcctgagtagctgggattacaggcatgcaccaccatgcccggctaacttttgtatttactttagtagagacggagtttcaccgttttggccaggctggtctcgaacacctgacctgaaatgatccgcacaccttggcctcccaaagtgctgggattacaggtgtgagccaccttactcagtctcatttgagttttatagatgtaatcattaataaattggtattttttgtttttgtttttgtttttttagacagtctcgttctgtcacctgaatccgcctactggattcaagtgattcttctgcctcagcctcccaagtagctgggactacaggtgcgcaccaccacacctggctaatttttgtatttttttagtagagacggggtttcgcatgttggcccagctggtctcgaaatcctgacctcaggtgatccacccgcctcagcctcccaaagtgctgggattacaggcgtgagccaccgcgcccagccaatgaattggttctttaagaacaaatctattggccgggcgcggtggctcacacatgtagtcttagtactttgggaggctgaagcaaggaggatgacttgatcccaggagttcaagaccagcttgggcaacaagaccgtatctcttgtcttaaagaccctaaagaaaaaaaaatggaaaagaaaaaaaattattttaaagaacaaatctcttatatattaaaaattgacatttttcggccaggcacagtggctcacacctgtaatctcagcactctgggaggccaaggtgggcagatcacctgaggtcaggagttagagaccagcctgaccaaccatggccaacatggtgaaaccttgtctctactaaaagtacaaaaattaggccaggcacggtggttcacgcctgtaatcccagtactttgggaggccgaagcagatggatcacctgaggtcaggagtttaagacccgcctgaccaatatggtgaaaccccgtctctactaaaaatacaaaaaaaattagctgggcatggtggcaggcacctgtagtcccagctactcaggaggctgagacaggagaattgcttgaacccaggaggcagaggttgtaatgagccaagatcacgccattgcactccagcctgggcaacagagcaagactccgtctcaaaaaaaaaaaatattagccaggtgcagtggcgggaacccataatcccagctacttgagaggctgaggcaggagaaccgcttgaatccagaaggcagagtttgcagtgagtccagattgtaccattgcactccaacctgggtgacagaccaagactctgtctcaaaaagaaattttttttaataaataaaaatggacatttctggccgggcgcagtggctcacacctgtaatcccagcactttgggaggccaaggcgggcagatcacgaggtcaggagttcaagaccagcctggccaacatggcgaaaccccgtctctactaaaaatacaaaaattagcggggcatggtggtggcaggcacctgtaatcccagctactcgggaggctgaggcaggagaatcacttcaacctgggaggaggaggttgcagtgagccgagattgtgccatcgcactccagcctgggtgacaagagcaagattctgtctcaaaaaaaaaaaaaagacatttctaaacattaatagttactcgatttatacagtctatgaaattataaaactacagtttaatttggaaatgcaattaagaattacttggataggaaatgatacacaaaattcattcatctagtaacaaaattggaaattcaattccgcaagcataaacttaacacctaccgtatacaatggtgtttaaagtctactatgtccaagtctttttagggactcaaagataagcaggaaattgtctctgtcattgtaggaactttgttctttagtcattcattgataaactgaagtaacaacttctactagttagttatactttgggtttgtttttgttttttaataatctgtcttctctctctttctctctctttgaaagggtgccaaagagtttttagtaccatccagggaacctggaaagttttattctctccctcagagtcctcaacagtttaagcaacttctgatggttggcggtttagacaggtgagctttttttatgctagcagttgtcagaaaaggaaaagagaaaaacaaagggaaaaaaggaaacacaaaatcctctctgttctcaagagaaggatagaaaatttatgagagtttggagaatacttataaaatgccctcataatttatagtcatcctttattaaaggtttattgggtggccactatgtacaaagctctatggtagtagatgtgagaggggatttaaaaaaaaaaaaaaaagaataggttctactctcaaggtgttaaggctagtaagccagaataggataatgaataaaaccaactgtgatataaaccaaatgtaaatgtattgagatttgcaagttaggtgttaagagctttaaaattatactttttgaggaaatatagaaaactttgtgagctagatcgttgaggacagagctacatttcagcaggtgaagatgagagttggaatggcatagcacagaaagtctcaagtgtatccatggcacagtaaagatttcactttggccaaagcaaaagagtatatatgaagaagcatgggctaaaaaaaatgttttaataaaaagagctggcatggactgatttgcatgctagtctaaatacatgaatatccagaggtgccagtgtttattttgaaaacaatatatagaatagttaacttctcataggtcagctgtatgtctaattcgattaaagcatcataaaaaataaaagtatttcttacttttttttttttgagacagagtctttgctctgtcacccaagctggagtgcaatggcgcaatctcggctcactgcaacctccgcctccctggttgaagtgattctcctgcccttgcctcccgagtagctgggattacaggcgcacgccacccacgcccagctaattttcgtatttttagtagagacagggtttcaccatgttggccaggctggtcttgaacgcctgacctcatgatctgcccgccttggcctcccaaagtgctgggattataggtatgagccgccatgcccggcccttcttacgttttttaagtatcattgttttatagcttgcattgctttaaacttttggggaaaagtgtgtatgtcttcctagaatcataactcaattaatgctatttctcaattgtagatattttcaggttgcccgatgttatcgagatgaaggttcaagaccagacagacagcctgagtttactcaggtacaaagttatattcacttgtttcttaaaattcaggcttactattttgaaatagtattttcaagaccagtgcagtattaatactttacttctcattacattttatccatcagatatttaattaaactcacctgcagttgagaaactaattattcttttttttttattcatttcatgtgtccttttttaaatttttttctttccttggatagcacaggggccacactgtcattcaaattttagtatgtgtgctgccaaaacgagcatgtgtccttttcataaagaatgtggtcagcaactaaggaatgccagaagttcctaaagtgttctaatgttcatgataaagtccttaaaacaaatctcttatatattatgaataattttatatattgatattttaatctaatatgtggacttaccaaagctgttacgatttgctttctgtatgatagcattttattttactttatattattttatttattttattttttgagacagagtctcgctctgtctcccaggctggagtgcagtggcgcggtctcagctcattgctgcctctgcctctcaggttcaagcaattcagctgcctcagcctccgaagtagttgggactacagatgcgtgccaccatgcccagctgattttttgtgtttttattagagatggggtttgaccatgttggccaggatggtctggatctcctgacctcgtgatccacccgcctcggcctcccaaagtgctaggtttacaggcgtgagccaccacgcctggccaatagcattttaatcatgtgttgaagtgaaaaaattatgagctttggagttggacagacctgggatcagatgtagcttcgctgcttactaattgcacatacgcaaataagtaacttagttctctgagccttcatgaaatggttgtgggaactaagcaagttaatgtatgtaaggccattagcacagtgtctgacataaaagagatgtacaataatatttataccctctgcatgtattatgtgcaaaattctatagtaacttgaaagcagaaaaatatataaatgtgtatatattgtggctaaattagtttccatatggtactttggtttcagattgacatagagatgtcatttgtagaccagactgggatccagagtttaattgagggtttgctccagtattcctggcccaatgacaaagatcctgtggttgttccttttcctactatgacttttgctgaggtgctggccacctatggaactgataaacctgacactcgctttggaatgaaggtacttatcttcacttttctaggactctgtccccaaataatcctgcagtctttttaaaccactttgaaattgacaagtgttacacactgttagatgatatttttgttgttaccttgttaccttcgttgttacagagctagagcaagagagaataatagcatgttagcaatacagtgctttctatctttcatgttccaagatccatttccaagagcgagattcttgctataaagtttttattacttgcaagttattgattatatggatatgaatggtaacttgaaagaaaaaataactattctttccttttcagttttttttttaatccaaggagttactaagtttccttggtccataaaaagctcaaacatatgacaatgtttattcaaattattactatctgtaagtatttaaagcaggggtagaatttatatagaacagtttcattaccaggcctctacttgtttgctcttaaagagcaatatcccttgatccctgtaatgctagtgacatttctatatctcagttctcagtgcacattctttagaaattggtcctgcctggtctgtgaatagtcagtggtcaattcttagaatgaaaaaaatacaatacacaaaaagtcataactaccaacttacagctgccaactcaactacttcttgtttcttcgtttgtaatatggaatagtggttctttttttgtatttttttgagacgtagtctcgccctgttgcccaggctggagtgcagtggtaagatcttggctcactgcaacttcggcctcctgggttcaagcgattctcctgcctcagcctcccgagtagctgggattacaggcgcataccaccacaccggctaatttttgtatttttagtagagatggaattttgccatgttggccaggctgacctcctgacctcaggtgatctgcccacctcagcctcccaaagttctgagataataggcatgagcctctgcgccgagcctggaatcttaatctggttcttaagtcagactgcttgtgttaaattctggctctgccacttactagctatgccatcttgggcaagttccttatttctgtgtcttggtttcatctatgaaatagggataataaagagtgctaacctcatatgaaatgaatgagtatatgtaaaacactggtcatattgcttaacccatggtaaacactctttgaatgtattctataaatgttaaattatcaagatctattctcttctttaaaatcttgtttgtaaaatgttttcagataaaaattacttcatatttagttatctctttttgttacccattttccagattatagatatcagtgatgtgtttagaaacacagagattggatttcttcaagatgcacttagtaagccccatggaactgtgaaagccatatgtatccctgaaggagcagtaagtgaagtacagttctatgtttctctagaatgtatgctttggaagtaactttgtccaatactgtcatatttaaacttcagaaagaacaattctttttaaataaaaatagggatttttgctgggcatggtggctcacacctgtaatcctagcactttgggaggccgaggcgtgtggatcacttgaggtcaggagttcaagaccagcctggctaacatggtgaaaccccatctctactaaaaaatacaaaaaattagtcaggcgtggtggcatgtgcctgtaatcccaactacttgggaggctggggcaggagaatcgcttgaacctgggaggcagaggttgcagtgagctgagatcataccattgcactccagcctgggcaataagagcaaaactgtgtttgaaaaaaaaaaaagtaggtatttttatacagaatctaaagtatttctaaaaccataagtagagaacaataaaattttatgaatgtgagtttacattccagatccggggtgtttttcttttttcttttttttccccccttttaaacaatgctatcagccaggcatagtagctcatacctataatgccaacactgtgggaggtcaaggcaggagaattgcttaagctcaggagttcgagaccagcctggggaacatagacctcatctctacaaaaattacctggcgtggtggctcacacctgtagtcccagctattctggaggttgaggtccaaggatcacttgaggcaaagtgttcaaggctgcagtaagccatgattgtgccacggcattctaacctggataacatagcaagaccgtgtctcaaaaataaatacataaataaatgatgctatgaagtactcctgtacttcattgtggataatatgtgagcataaaataatacgtagtattctgtctgcagcctcagttgtctgtctatctcttagccctgtatcagcaccagcatggccattgcatgttgattctttatcttctgagagttctcatctcagttgcactaataacagggaaataaaaggagatggagctaaaaaagcaaaaaggaaggggaagaagtgggagtagaagagagagagagaatggttgggctgagcaagtgctgactctaaagcaacggtacacgtctcttttctgtaggtagtacatctgctttaaaaaataatttcataagaagtattccagttatattttaaataagattatgattttgaaagtctatactcatttggatacataagcattatattcagaatggagtaagaactcaggaactcagtctcattactttctttttttttttttttttttttttttttttttttagagtgagtcttgctctgtcgcccaggctggagtgcagtggcgcgatcttggcttactgcaacctccgcctcccaggttcgagcgattttcctgccttagcctcctgagtagctgggactacaggcgtatgccaccatgcccagctaagttttttttgtatttttagtagagatggagtttcaccatgttagccaggatggtctcaaactcctgacctcaggtgatccacccgcctcggcctcccaaagtgctgggattacaggcgtaagccaccatgcctggcccctcattactttttatttacttcatatattcagtaaaaagtaatttattgtcatgcggggcacggtagcccacgcctgtaatcccagcactttgggaggccaaggcgggtggattacttgcggtcaggagtttgagaccagcctggccaacatggcgaaaccctgtctctactaaaaatttaaaaattagctgggcattgtggtgggtgcctgtaatctcagctacctgggagactgaggcaggagaatcacttgagcccagtaggcagaggttgcagtgagcatgagatcataccactgcactccagcctgagcaacagagcaacactccatcttaaaaaaaaaaaaaaaaaaagtaatttattgtccatactctagtccagacataagaaatatgttcaggtaagctcagtatgatattttgcctatcattatttacaccatttcaagtttgttctttctcaagtagatataagaactgcaggagtgtggatcatgttttcatctttttataccttccgtacctagttaaatgccacattaatatagttaatgatatgtggcatatgggagaaataagatggttaaagtatgatttcacaaatcacatggtttattgccatacaaagaaaattttttcttaggttcacaatgcttaaaagagagagagaataagggccaagcgtggtggctcatgcctgtaatcctagcactttgggaggctgaggcgggcggatcacgaggtcaggagttcaagaccagcctggccaatatggtgaaaccacgtctgtactaaaaatgtaaaaaattagccaggtgtggttgtgcgcacctgtagtcccagctactcgggaggctgaggcagaagaatcgcttgaaccccggaggcggaggttgccgtgatctgagattgcctcactgcactccagcctgggcaacagagtgagactccctctcaaaaaaaaagaaagaataacatgaacaatcctcacagggaaaacactcagtagctgaggtgcattaatcacatagcgagtgagttccaaaattattaaagtccacttgctctattaggatggaagtagtcctctggggaaggtaaagtctaattaaagtttgaggtgtactcttatatgagctgttcttgggagaagctggtttgaccaccacagtacacactgtatctaaggtccctcgatgctagagggcagtgccagtgtgggtgggtgaggcttcagagattagctccaagactaacagggtatcacccatctcttggctgtaggagaagcagttgacagagtatagccagtcacagcatgtgctatcaaagtgtctgtcgaactcttaagtttatatgtatttttgaagtccagtagttgaggtcagtaattcacacatgggagttatgataaggtttgaggtaacattcctggggggaagagggagttcactcgaagttctcacataggggatctgataaaacatcatgctctcgaaaggagggggaatacaccccaaaacatcaaaccatgttaagtgtttggatcatttcaaagttatgtaacatgataaccataatgtctcacttgaaagacactgagataatttcaaaagaaagattttaagaaacctcaaataatcaaattctgaatccttttattgatctgaaagttttctttcacaattcagttgtagacattcatgttgaacatttatcctgcatattagatatagagggtctcctgtggaatacattcacagctatttccaataagagctgcatgcccagcgtggtggctcacacctgtaatcccagcactttgggaggccgaggctggccaatcacatgaggtcaggagttcaagaccagcctggccaatatggtgaaaccccatccctactaaaaatacaaaaattagccaggtgtggtggtgggcacctgtaatcccagctacttgggaggctgaagcaggagaatcacttgaacctgggaggtggaggttttagtgagctgagatcacgccactgtactccagcctgggtgacagagctagactccatcgcaaaaaaaaaaaaaaaaaaaaaaaaaaaaaaaaaaaaaaatctgcataactggaaaaaataagcactgtaacaagctttaaaaatgtgtcatttggtagcagaaattggatttttttttttttttttttttttttttttttttgagacagaatctcactttgttacccaggctggagtacagtggcacaatctcggctcactgtagcctctgcctcctggtttcatgtgattctcctgcctcaacctcccgagtagctgggatttcaggcacctgccaccataccagactaatttttgtatttttagtagagacggggtttcaccatgttggtcgggctggttttgaactcccaactttcaagcagtccacccgcctcagcctcccaaagtgctgggattacaggcatgagccaccgcgcccagcccagacattgaatttttattaaatcttactattgtaatagaaagacacaaaatatatttgtcatttgatcgcataaccatgtttatgaagctaagtgtcatactgacaagtttactttgatttttctttcatcagaaatacttaaaaaggaaagacattgaatccattagaaactttgcagctgaccattttaatcaggtaaggagttaattagagcagtttttttccttatacagattcaatatttttaactattattaactaaactatcattatcattagttttgagcatcttgttatttcagatcattcttctgcttttatttactttttattttatttatatatttattttgaagatgtagtcttattctgtcgcccaggctagagtgcagtgttgccataacagctcactgctgccttgatttcttaggctcaagcaatgctcctgcctctttctctcaagtagctaggactacaggctcaggccaccatgctgcccagttgcacccctagtcccagctacttaggaggctgaggtgggagaatcacctgagcctgggggtcgaggctacagtgagctgagatcgcaccaccgcactccagcctaggcatcagagcaagattccatctcgaaaaaaaattgggctgggcacggtggctcacacctgtaatcccagcactttaggaggccaaggcaggcggatcacttgaggtcaggagtttgagaccaatctggccaatatggcgaaaccccatctctactaaaaataaaaaaaattggccgggcgcgttggctcacgcctgtaatcccagcactttgggagggcaagacaggcggatcacgaagtcaggagattgagaccatcctggctaacatggtgaaaccccgtctctactaaaaatacaaaaaaattagctgggcgtggtggcgcgggcctgtagtcccagctactctggaggctgaggcaggagaatggcgtgaacgcaggaggcggagcttgcagtgagccgagattgtgccactgcactccagcctggacgacagagcaagactctgtctcaaaaaaaaaaaaaaatgcaaaaatgtgccgggtgtgttggtgctcacttgtaatcccagctactttgagaggctgatgcaggagaatcgcttgaacacaggaggtggaggttgcagtgagctgagatcacgccactgcactactgcctgggccacagagcaagactcagtctctaaataaataaatattagctgggcatagtggcacatgtctgtagtcccagctgcttgggagactgaggcaggagaatcacaagcccaggagttcaaggctgcagtgagctatgattatgccactgcattcttgcctgggtgacagagtgagaccctgtctctaaaaaaaataaaggatccagccaggcacggaagcgcatacctgtaatcccagcactttgggagcccaaggtgggagtatcactggagcccagaagtttgagaccagcctgggcaacatagtgagacctcgtctctacaaaaaacagaaaaaaaattagctgggcatggtggcacacacctgtcatcccaactacttgagaggctgaggtgggaggatcacttgagcccaggagatcgaggctgcagtgagctgtgttcaccccaccgcactccagcctgggtgacacagtgagaccctgtctcaaaaaaaaaggaaagaatcttaggtatgataacaggaataaaatgaaaccatataggagtaattaaattatgctataatcaaaggaattaatattaaagttcctatttaaaatcttgttttctaagacttaatagaggaaaaatgctcttataatgatatgtaagaaaaggaggctataggactatatttatactgattataaccatgtaaaaacactatatttgtatattgaaaatggactacctacctctactaccactatttcccaagcctcatacctcaagcacaacgaacaataagtagatttttatataagaaaaaaagatcaggttagtggttcccaaaatgggttgagacaaaatcagaaaagtcagggcaatataacaagcttttcataaagttaaacaaatttaaagaactatcctttttttctctgtcggcggtggggatggcggggggatgaaatatgtcttttctttataaaattaaaaattggcaaccctttatcttccaattttgtttatttttattttattagtatataaaatctgcatctaagaaccataggaccaggaaataagcctgaaggttaactttggcagctttcagttgatgggactattattacattttcttctttcattcttctctctcttctcctgttttctttttctttcctaatttcctgaacttttatataagaaatgggtattactactactattttttatgagtgttttaacttgatttggcttctaattgctttcagaagatcttatgtgtttttagcaacatatggcatacacatggttcaaaaaataaagaaccattaatgatgaaatgcaataatcatttgctctagcctgccccatccatcctagtattctgccagagtatctctgtttttggaaatatctctacatactttttttttctttttacttaattcatttaaaccttgttaacttcctgtcatgagagatgaggctcacatatacagacctcacctagttactctgtaccttctgcacagctgtctttctgaacctttttttttttttttttttttttttgagacgggagtctcactctgtcgcccaggctggagtgcagtggtgccatctcggctcactgcaagctccgcctcccaggttcacgccgttcttctgcctcagcctcctgactagctgggactacaggcgcccgcgaccacgcccggctaatttttttgtatttttactagagatggggtttcgctgtgttagccaggatggtctccatctcctgacctcgtgatccgcccacctcggcctcccaaagtggtgggattacaggcgtgagccaccgtgcccggcccttttcttcattcttttctgagttgaagccacccatcctggatcccaggttttcctctttcttttttgtgttggagtatgtaatcaagtaacttcctaagaaagcatgtgagagatcaacttactgagttcttacaaaatgtctttatgtttaaaacctcacacttgatcaataataatttggcttagtacaaaattttgaattgacagccatatcatcttagaagagtgctgtccaataaaactttctgtaatgatggaaacgttttatgtctgcattgttcggtgtagttgttgctagccaatgtcgctagtgaacacttgaaataggatagtacaactaaagggctgaactttttactttatttcattttaattaatttaaatgtaaatagcaacagtgcattgctagacagcacagctttagaacatttaaggcattgctttactttcttctcccatctgttgttactgatgagaagtctgatgctttgatgcttgtgtgaatttattccattatagcagagctggttttttctcattggaagctttttgccttctgattctttatgttctgaaatttcagagtttgtttgccttttgatcatttttcatttaatgtgttacacacttgaagagccctttcaatacgaaggtttatgtctttttatgtgtagaaaattattttattatctaatgattttgacctcatcattttttctagtctctctttggaatttctactagttgtatgtcaaaccaatttaacctcttttcttttgcatgtcatttttcaccattttctttgtcttgttctattttcctggggatttcttcaactcttctgttgaatttttttttatttcccagtagcttttttcactgcatcttattctggttttattcataaaatatatttttgagtacctttgaggattcaagttctcttttggtccataacttatgttttctctggggctaattttttgggtttatcttggtcttttttttttttttaatgctgcagagtttcttcaatgtacagtgattgttggttatctgtacatattcaagaaaggggcattttaaaagctggttggggccgggtgcagtgactcacgcctgtaatcccagcactttgggaggccaaggcgggcagatcgcttgaagtcaggagtttgagaccagcctggccaacatagtgaaaccccgtctctactaaaaatacaaaaattagccaggcatgttgacacacatctgtaatcccagcgactagggaggctgaggcaggagaattgcttgaacccgagaggcagactgcagtgagccaagatcaggccactgcactccagcatgggtgacagagcgagactccatctcaaaaaaaaaaaaaaaaagctggttggaagctcaagagagaggctttgtaaatggttaggtttagtttagcatgagcagcaaggctgctctaggcactcaaggcttaagagtcctgagcctctccagaattctgcagggtaaaatcagttccttcttgtgctgaggctgcctccattgttctttatgccagaccttcctgcaccttgcttctttaatcattcctactcagttcacttgcagtctgccaaaaattcgcagaaatctctcatctgctgatattattctccattcttcatcccctccccctttttttcattatgttgaaatgacttttttttttttttttttttgagtctcactctgtcacccaggctggagtgcaatggcccagtctcagctcactgcatcctctaccttccaggctcaaatgattctcatgcctcagcctcctgagtagctaggattacaggtgcacagaactggcacagctactttttgtatttttagtagagatggggtttcaccatgttggccaagctggtgttgaactcctgaggtgatccacccacctcagcctcccaaagtgctgggattacaggtataagccaccgtgccaagcctactttataaaattcccttagtatcattttgaatgggttcatggagataatagagacaatctcttttaaattctcttctattgggaaccggaaatctttgtattataagaagataaattaatcccactgttcaaaaaaaaaaaaaaacgtgaataagtctttttcttttacacaggaaatcttacctgtattccttaacgccaatagaaactggaattctccagttgctaatttcataatggagtcacaaagactggaattaatcagactaatggagacccaagaggaagatgtggtcctactaactgctggagagcacaataaagcagtaagaaaaattacttccaagcatcagtgctgttgatgctgaacaatgccttactctcctatgtatatagtatacgtttgaactgtagactgttaattcataaaatggagctgctctgcataaatcttttttttttttttttaagagacggagttttgctctgttgcccaggttggagtgcagtggtgcaatcttggctcactgcaacctccgcctcccgggttctagagattctcctgcctcagcctcctgagtagctgggattacaggcgcacgctgccatacccgactaatttttgtattttagtagagacagggtttcaccatgttgcccagactggtctcaaactcctcagcttaggcagtccacccgccgcagcctcctgaagtgctaggattacaggcgtgagccaccgtgcccagcctgcataaatcttatagtgctttataatgcactgtataaaaacttaagggttggccgggcatggtggctaacgcctgtaatcccagcactttgggaggccgaggtgggtggatcgcctgaggtcaggagtttgagaccagcctgttcaacgtggtgaaacatcatctctactaaaaatacaaaaattagctgggtgtggtggcgggctaatttttgtattttgtagtcccagttcctcgggaggctgaggcaggagaatcacttcaacctgggagggggaggttgcagtgagccgagattgtgccactgcactccagcctggctgacagagccagactccgtctcaaaaaaaaaaaaaaaagggttttttttcatagctaccagcctccattggcattacttaaatagattagacctgaccctaattagaaaagccacttagattaaggggtagtgaaattagtcatataaccatgaaaaaatattttcagtgtcaagatttcacaaatgaagaaaattaggagtctcaaatttttatacatcatgcattcgtaaattgtggagggacggatcagaccactggcgagctggagggctggcagacacccctggaccaacttggtcaaagtgggaccctttttcctcaagaacagcagctgtaggtgatgagtgccatcatgcactggctgagtcatgattcttcaggggatatggaagactgaattagctttagggatctttgtaaaatatagaaaagtatagtacaaagtcaaatatgaatattaaaaatgtactgtaaagatcaagcatgatataaatttattttttcactttagtatatagttttttcaaaatgatagtgtgtctaactagtacttcatcaagttctttcttctaatctatattttcatttgtcattgtttcttccacagaaaaagtttcagagttcagcttcaaagctaaatgtaatcccccgtctccccttcccctacaatagtaaaatgaagaaagctatttatttccaaattttattatgaatgcatttcttaaaaaagaacatgggattttgttcctaactaatttggctattaaaccttctcttggtatgaactaaacatgctggtgtttcattctcaggaagttataggtctgattcctacaaggccttccttgaaagagagctagaaaccagactttcgaggaataacattaacattctgaaaatgtcacaatgaaggtccgttatgtagacgtaaatgtaagatagaatgggctgcaaaataataccctatcatgtctctaggcatatgtcactgttctaaccagctgtcctttctcagggaagtcctgcataccataggtagcacttattaagcacttagtatttgccaagcccgttctaagcactttgtatacattaactcatttaatcctcatgccaaccctatgaaagaagttctgatactgttgctattttaaaaataagaaaagtgagtcacagagcttaaaattttgctcacagtcacacagctaggaagtggaggagccggatttctaacccatgaagttgggttccaaaattcacactcttatttttttttattttttatttttttttgagatggtctcactctgttgcccaggctggagtacagtggtgtgatctcagctcactgcaacctctgcctcctcccgggttcaagcgattttcctgcctcagcctcccgagtagctaggattacaagtgcatgccaccacgcccggctaatttttgtatttttagtagtgacggggtttcaccatgttggtcaggctgatctagaacccctgaccttgtgatccgcccgcctcggcctcccaaagtgctgggattacaggtgtgagccactgcacccctccgcactcttaaatggacctctaatctgcattacctatagtgatagccagccttcactgaacattaacagtgtgccaggcacttaccaaatcctcaccacaacccttcaagagaagtgaggaaataatcagaacgactaccactcacatactttgtcaggtcctgcaccttatgtatattatcttaagcttcacagcagtcttttggagttgatatttttatcccaattttacaatgaaaaagggtacagagaagttcgtaattagccacactgagattcagacccaggtctatgaagtgctgatccctgtgttcttaatcaccgagttatcagtactcacccagttggttgagtgtgatgattgttctcaaccttgttgcaattagacttatcctcagatctttgtgtcctgagaagcaaagggcatcctatctgttaattggctaatcctttcctagagaatggcctggcttcggaatccaggctgtgtcatttcctgcctgctctgtcaagaagttaactcaatgtttacgtcttctgtttgcagtgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctccccaccccagtgacatacatctcctgtacactgagcccaaaaaggtaccgtatctatacttccaaatcaaaaggaaatgtgtatataaaggcaaagaacttcagacttcaaggtctgatgaaagataggacccagttctggaagccccagaagaaattgtggagtttgagttagtagtaatacattgtctttaaaaatctacagggtcttcaacccgtagaacagaaaaccagacattttctctaacataaagtatctgtgaatcttctaggcccgtagccaacactatgacttggttttaaatggcaatgaaataggaggtggttcaattcgaattcacaatgcagagctgcagcgttatatcctggcaaccttactaaaggtaacaaacatcatctgctatcctgggcttatttttttaccagaatatttttcagttttgtgttgttgttgttgtttgcttgtttgttttgtttttgagacattctgtcacccaggcaggtgtctactggtgcattcatagctcactgcaatctcagtctcctgtgcttaagccatcctcccacctcagcctcccaagtagctgtgactacaggcacatgccaccatgcccggcaaatttttttatttttttgaagagataagatttccctatgttgctcacactgctctcaaactcctgccctcaagcactcctcctgcctcggcctcccaaagtgctgggattataggcatgaaccactgcatctgacttaaatcagcctattttattaaacatttgttatgattggaggattcacaagatacaaaatagcatcagctatctctctacctttaatgtaggacttggaaaagtaaataataatattaaaagtaaataataatattaaatgcttaaatagtatctggcacatagcactattaaacagtactatttaaatactaattaatagtgcatattaaatacccttattataatagtgcagataaatatccttattctgcccactctaaagatgagatttactgaggcaacttacttaacttgccaaagtgacagtacaaaagtaagcagagtcaggatttgaatccaggtgaggtggctcttaagcccatgctcctaaccactaccctgcttaaaaaaaccatgcagcttgaaaaaataaaaatcaaatcaaatgaaaaccatgcagtctgaagtgactaaaaatgttgataatgttagagaaagagagagaagtttgaaaagattttatatcacttattagatactactttagctatatttaaggcagggatatattttagtgatagtggagtaatcaggattttttaaaagtaaaagaagagtctgtacaggtgcagacctaagaatttgaagtttgttggtgatgctgtagaaggcttgggtaggtttcagaaaggaaaaggtctgagagagtctggtcctaaaagatcgttttgtgggattaactgacaagtgtgaggtaggatggaaggagaactcagaccatgagatgactcctttagctttaagccttcagagtccttaaagtttaagggcattgtgaaatctgttaacttttttttttttttttgagacagagtcttgctctgtcgcccaggctggagtgcagtggctcaatcttggctcactgcaacctccgccgcctgggttcaagcaattcttctgcctcagcctcctgagtagctgggattacacgtgcgcactaacacacccggctattttgtatttttagtagagacagagtttcaccatgttggccgggctggtctcgaactcctgacctcaagagatccacccgccttggcctcccaaagtcctgggattacaggcgtgagccaccgcacccagccgaaatctgttaacttttctcctgccaattcaaagcctccaatcacccattgggttttgtgtgtttgtttgtttgtttgattttaaaaagatggagtctcactctgtcacccaggctagagtgcaatggcatgatcataacttagggcagcctcaaactcctgggatcaagcgatcctcctgcccagcccagcttccagtcagcagttttcagcctttttcattcctctcattgtcaaacttttcaagagtcactaagaatacattacttttttctttttctcgctttgtcacccagactggagtgcagtggcgtgatcttggttcactgcaacctccgcctcccaggttgaagtgattctcctgccttagcctcccgagtggctgggaccacaggcacacaccatcacgcccagcatttttttttttttttgtatttttagtagatacagcattttgccatgttggccaggctagtcttgaacccccaatctcaggtgatctgcctgcatcggcctcccaaagtgctgggattacaggtgtgagccaccacacctggcctagaatacattacttctgttgcttccctaaatagtggttctcagccctgctgcaccttacaatcaaatcacctggaaagcattaaaaaaaacactggtgccttggctacacatcagaccaactgaataaaagagttctaagcataaggctttggcctctgtttgtttgaagcttcccacttgatcctgatttgtagcctggttggagaaccatttccaaacacactttcaacatttctacatgtactgccccacaaaagttactcacaagatcactaaatccagtggcctgttcttggcccttaagttctccttcctcccggcagcatttgacaatgttgcccacttagtaatgctctcttcccttggtctctgtgacaggagagtttcctgctttttatccccacctcctcatttggtctcactctgtttgcattgtgaatacagtaaaagctgcatttactgaacaccaggcatttttgtacatgttataatcatctatgacttgtctttttcccttactaacctgcaaatcacttaaggtaattttttctttacacttttccaataaacttttattattggttaagtcagttttagctgttttaaaactcaactttgtttcccctttatcatctaagcctagatggtggcacttagtggaccttcaaaatatatttaaactgaattatcttttgaatttcaggaggatgtgaaaatgctctcccatctgctccaggctttagattatggggcaccccctcatggaggaattgccttaggtaaacaacttttccttttataagataaactgaattccattgcactgtctcaaattcaggttctcagtttgtgttggtagaggtggaaggatgagtccaagagttccatgagaatgtaagtttctgttgaaatttcagtaatatattttttaaatatatcttaacagttataaagatataacttaactgataatttgcatttgaaagatcattaatagcttaaaactgcagatcttaagtcaatattgttcaaatccccatggcctcacatacgcactcattggagtctggaaagcactgctccataatgttcagcttgtatgaaaacaggaagatgccagtgtccttctgattgccatggttactcactttgcttgttttgtcaaagcaaggaagagtaagaaattctaggaagctcacctagattgtaggccccaacaacagggacttccttctgtgtttatggagttccctgccaagcaccaaatacactgttgaatctgttttagggcctttagtaagcctttactaggaacactaatcgctgtgacaatccaagtagcatgtgaacattagtcctgaatacttttccagaatgagatagaaaagaacctctcaaacaaacaaaagttctctaaaaaggtagggaacgatggttggctacagtttgttaaagattcttatttaaaagttttctacaacttttatagaaaaactaagttatttccaacattagattacatttctcatctgttatctttgtattttactcacagggttagacagactgatatgccttgtcactggatctccaagcatcagagatgtcatagccttcccaaagtccttccggggacatgacctcatgagcaataccccagattctgtccctcctgaggaactgaagccctatcatatccgagtctccaagccaacagactccaaagcagaaagagctcattgaatcatgcataccatgcagaaagttgagcttttaggttttgtcctctttgcttccccaaggctaaagtcagatctagagttctgccacaggtctaacaatcaagtctttagatggaaggaatccaggcaacattcttcaccacaacgaagaaacagataaaagatacccaattttgacttgatttcatgcatcatttggattttttttggttaggactttttttgaagttcctttttacttaggtgtgaaagatggttctttgttgaaataatatagtggtttagtgttttcaaatcatgtttctcatacccagatagtagattattcacttaggacagaggtaatcaaattatgtgtgaaatgtaggaaaatgcttgcccctgtaaactagtgagttgatggagcatttgcttcatcatcctcatcaagagaatcatataaattaagctttataatgacatttcaaccatcaacataatatagtgaggagtagcataatattttttaataatgcagaaaacatcactgaaatgagagtcacaaatttttcttcagtgtttcagcctgagtaagttacataaacctcgcttagcctcccttcctgctaatgtgtaaaatacatacttgccctggctacctcaccgggctgttattgctggaatcagaggagataacatatatggaagataaagtgaataaaagtactttgaaaaactataaagcattccacaaatatgagatgatggtattatccatccataaataggtagatatatctctattttatagtttcagattaaacaaaactgatatcaatagtaaaagtcattttacttatcaattttctgtttttttttttagttttaaagatattattggccgggagtggtggctcacacctgtaatcccagcactttgggagattgaggtgggtggatcacttgaggtcaggagttcaacaccagcctggccaacatagtgaaaccgtctctactaaaaacacaaaaattagccaggcatggtggcgcatgcctgtaatcgcagccactcgggaggctgaggcatgaggtttgcttgaacctgggagatggaggttgcagtgagccaagatggtgccattacactccagcctgggtgacagagcaagactccatctcaaaaaaaaaaagacaacaaagatattattaatcactgaacactattttctctcaattataagtaattgaaaattctaatcaaccttagattaacctcaaatgtgcgaaaaagtgaacaccaaaactcattgtgattttaagttctaatcatacacataaaagttttaataaactaataattataaaatgaggccgggtacagtggctcacgcctataatcccagcactttgggaggctgaggcagacagatcacaaggtcaagagactgagaccatcctggccaacatggtgaaaccccatctctactaaaaatacaaaaattagctgggtgtggtggcacatacctgtagtcccagctactcaggaggctgaggcaggagaatcacttgaacccaggaggtggagattgcagtgagccgaggttacaccactgcactccagcctggcaacagaacaagactccatttcaaaaaaagacaaaatgagaacaaggtcttgatcagtgattttgaaattgttttcttctactcagtcttcacttctgccttgaaattcttttgatttataccttttttttttttgagacagagtctcgctcttttgcccaggttagagtgcagtggcaccatcttggctcactgcaacctccacctcctgggttcaagtgattctcctgcctcagcctcctatttaattaattaataattgatttaatgatttagtttaaaatgttaaattcattttaaaataacccattacatgttaacacaaatagcatgtttttattttattttattttgagacagagtctcactctgttgcccaggctggagtgcaatggtgcgatcttggctcacttcatcctccacctcccgggttcaggcagttttcctgcctcagcctcctgagtagttgggaccacaggtgccctccaccacacctggttaatttttgtatttttagtagagacgaggttttgccatgttgaccaggctggtctcaagctcctggcctcaggtgatccgcctgcctcagcctcccaaagttctgggattacaaaggcgtgagccaccacactcagccatgtttttattttaaaaataattattttcaaaaaaaaaatagaagagtaacattgttttatatttctgcaaatattttttatttctggcttaatagaagacactagattctgatatctgcttctgtatcctatctgttgttatatgctgttttggttgaagtctgtgaagaaaatctgaccccactcatatataaagttggaaaagggaggagtattttaatagctttgtctgataattatggatactctctttgataccacaccaaaatatgacaagtagtagagttccttaaaggctagttgcaatgtggattctgaaatcgtattgatgagcttttctaaagtccattggtgtaccttgtatttaaatagaacttttacctatgtgtgatatttgtaacaccagtccagtgattgatcatttggaaaatattggttcactgagttatgcaaatcttccaaatgttgacacattttgatatacaatatctaaaacaaaataccattaattaatattaccaccaatcccattacaaaagtctaagtctgaggaagctataagggcacagaagtgtatacaagccttccaaaattttaggtttcatttggaagcttgagttttatcattggcaacaaatgccatcagttttttccaagctgacttgttcttttttgagcaaatctctgccaaaattacccctaaaatatgaataatcaatttgtcaggttttttcaaactaaaaatgttctgtgaaaacaagcagctagttcagcttgtatctcaaacaattgtaactactttttctagggaaaaaaaaatctagacatccatactttatggcagatgtgcttcatgcatacttcccattttgtcacacagaatatcaaaataacgtgtactcaaggtcaagatttactaacaactaaaattccaaaactgctaaacaacagaatgctgaataaggtgatccaatttttaatattttatttgagacaacatctcaccctgtcacccaggctggaatccagtggtgtgacacagctcactgcatcctcaacctcctgggctcaagcgatcgtcccacctcagtctcatgagtggttgggactacaggcatgcaccatcatgcccggctcactttttttttctttttttttttaattgtagacacagggtctcactatgttgcccaggccggtcttgaactcctggactcaagcaatccccccaccttggtttcccaaagtgttgggattacaggcatgagctactacatacaactgaaatcttttaatatgcttgtcaaaaagttttctgattcagcaaatggcacttatatataaaagagagaacaagaagctggatgcggtggctcacgcctgtaatcccagcactttgggaggctaggtgggcagatcacgaggtcaggagttcgagaccagcctggccaacgtggtgaaaccccctctctactaaaaatacaaaaatagccaggcatggtggcccacgcctgtaatcccagctacttggaaggctgaggcaggagaatcgcttgaacctgggaggtggaggttgcagtgagccaagattgcgccgctacattccagcctgggcaacacgagcgaaactccgtctcaaaaaaaaaaaaaaaaagaatagaacttggctggatgcagtggctcacacctgtaatcccagcactttgggagggcagggcagttggatcacttgaggccaggagttcaagactagcctggctgacatggtgaaactccatctctactaaaaatacagaaaaaaaaattagctgggagtggtggcacacacctgtcatcccagctactcaggtagttgaggcacaacaatcacttgagcctaggaggcccaggctggagtgaggtggcacgatcttggttcactgcaacctccacctccagggttcagagtagctgggactacaggcccacactaccacacccggctaattttcgctttttttcagtagagaccgggttttgccatgttggccaggctggtctcgaagcctgagccataacctggcgaaaagatactttgaaatgtaacatcgtttttcacttcaaaatcaaggtattttaccaacttgtctttggtacctccccaaaaactgatctactacatttgcagtttcattcatttttccaacattaaggaataaacttgaagcgcttacattcttgtgggggaagtaagaacaaaacacataataggtcatggtggtcacatgaaaagtaaagggtaaccgattggggtaggtggtggtagttttgtgtgtgtgtttttttttgagaccaagtctcgccgttgcccaggctggagtgcggtggcatgatctcagttcactgcaacctccacttcctaggttcaagcaattctcctgcctcagcctcctgagtagctgggattacaggtgcacgccacacctggctaacttttgtatttttagtagagatgggggtttcactatgttggtcaggctggtctcaaactcctgaccgtgtgatccacccgcctcggcctcccaaagtggtgggattacaggcatgaaccaccacgcccagccttcttttttcctttgagaaagtctcaccctggcacccaggctggagtgcagtggcaggatcacgggtcactgcaacctcagcctcccaggttcagttcccctgcctcagcctcccgaatagctgggactacaatagcccaccactacacccggctagatttttgtatttttagtagagatggggtttcaccatattggccaggttggtcttgaaatcctgacctcaggtaatctgcccacctcagcacccagccaggtggtggtagttgttttacagcctgtgtgagacattcgggtgagccccaggaaatgaaagaatgtgcttatttgggggagggggaggccttttttcttagacaaaattgggcattcccaacttacacgcatttagtgcataagctgacatttcaatgagattgtgaaatgacaatgggaagggccctgaaaaaaacatcaagcataaaaggcctgggaggccgggcactgcggctcaggcctgtgaaatcccagcactttgggaggatggggtttcgtctctactaaaaataccaaaatgagttggttgtgatggtaggtgcctatagtcctagctacaagaggctgaagagaatcgcttgaacccgggaggtagaggttgcagtgagcagcggttgagatcatgccattgcactccagcctgggcaacaggattcagtctcaaaaaaaggaaaattcagagagtaactgaagttttatcattaatgggactaaagtgctttagcccagaaacagatttgtaaaaccattactgctaacaaagacatcattataagcacagctgtactgacactgaaattaaaatttgacccatcttggaattttggccccttggtcctgtttccctgggacagattgccttaaaccagttgtgccctttatacccacttttggcatccctaaacacttagtgcttgccaaaaacctatcaccatggctatggattgtagattttcccaattccattaatgcctatcactagttgggcatttctatagtattttctataacttattttcccagcctcagactcaacatgactttctccaagtagctccatcaatactttaagctcaaaaccaattagcacaggggcctatgaaacctgacaatttgctcatatggagaattaggaaatattgcactttaatgcataagacaccttgtaaaatacccataaaattttaactggctgcagtgttaatgaagcaaataccatggagttataatagcttttgaatgtgatttatgcttacagctaatgaacagatgaaaagcactgtccttttttaagtaaacactacacactccagatggattgcaaaaatttattaaaattggagacactgttttaatcttcttgtgccatgagactccatcaggcagtctacaaagaccactgggaggctgaggatcacttgagcccagaagtttgaggctgtagtaagcttcaaaggccactgcactctagcttgggtgaggcaagaccctgtctcaaaaaataagacaagacttttagccacatttacagacttcaattaaaatgctacatgggaatgcagaatatcagatattttattgtcatcaagtaatcagtgagagagttcaagttggattgagatcatcatgtattctgcaattataatagtcccaacatttccaatcctcacctttcaagcagtaagctgcatgcttgcttgttgtggtcattaaaaaccctgaaagcgaagccaacatattaatcagggcaaaatacaaatgtgtgatgcttgttagtagagtaacctcagaatcaaaatggaacggttttacagtgatatcattatatttcatttggcagaatcattacatcattggttacactgaaaatcatcacatgtaccaaaagctgactcacctagtttaggataacaggtctgcctgtttgaagatgaaaaataatacccatttaaaatttgccctactcaatttccttctcagtcacattttaacttttaaacagctaatcactcccatctacagattaaggtgtatatgccaccaaaaccttttgccaccttaaaaatttccttcaaagtttaaactaacctgcatttcttcaatcatgaattctgagtcctgaaattaagggacaatacacagtaagacaacttgcatacaattaggagtaatccaaaatctccaaacattatagaatggctatattccccttttcggggcataaactagaatgttaccgccagatacatcagataggagcgaaagacttaatattgctcatcagcgttagtctgctgaactatgttatcatcattgtatcggctttacaacacttaaaaaccagacttgaggcggggcatggtggctcacgcctgtaatcccagcactttgggaggtcagtgcgggcagtatcacttgaggtcaagagttcgagaccagcctggacaacatagctgtacaaaattagccaggcatggtgtcacatgcctgtaatcccagctactcaagaggctgaggcaggagaattccttgaacctgggaggcagaggttgcagtgaactgatagtgccgctgcactccattctgggcaagagctagactcttgtctaaaaaaaaaaaaaaaatacttggaactgctatacctttgcttctttaaaacttgctccacacagtgtagtcaagccgactctccatacctgtagaaatttaatctcctttaccaataggtagtaataggtggatttctaaaagatttcccaactactgtttcagtttaagattaatctccattttctttctcagagagattcccatctgctttaattttaaaatcatcactaacagtagctcaatcaattaacgttaacatcaataaaacatgtacctttaaaaggtatgacaggaactgtcttcatgtccttacccaagcaagtcatccatggataaaaacgttaccaggagctggaatacaaatgaggacttccattaaaatgctaaacatcattaaactcttttcaaagttgtctgtcacagggttcttcagtgttacctttgtctacatgctcatttcaggtcagacatttgatcaacatcattacacaaaccccgttccaaacatgctcaaggaaaacacataaacactgttccagacatgctcaaggaaaatacagtcagtattcatcagccaagccttaagccattagctcagcagtaagcatatcaccatcagcattttcattaagtctatctactgttttcattaatacttaccagaaccattaagctggtccaggcaagttggactccacctaagaaataagagtggtcttagaatagccacagatgagtgttcaccccctgccaaaactaacaaatgcctttagtcagttagagctaattaagaccttcatgttcagtcagcatttgcttatcatcatccaggctgcatttacaaactttcttattaatcataacaagacaagaatccgccatttatttaatgcattcagcactaggaggtaactaaaaagccatttgtgccgtaggaagtttgcccagttacctgcttacttggatacagtttcacttaccatttcaacttccagctttctgtctaatgcctgtaattttaatacaaaattgtcagcaaaaaatattttaatggtagattggtggtacactgcttaaccattaacagcaaaccacaactaccccagatacatcagacagatagtacatctcttcatgattaaatctgctgaactatgcaaccatcatagtatctgttttcacattttcttcagtattaaacttagtatcaatatgagagcaaaattctcatttgaaaagaggggagagaagcactaacatagataatcatcattgctttggctattttctaatcccttaaaagtgagaagtacaaaatagaggtgtctcacctgtgtgccaatggcttgagttaggcttgctctttaggacctgggaagaaacaacttcatgtgaacttaggtgtactctctatgttccccaactcaccattttgggtgcctcagttaagataatggtggttaagatcctcatcattctagcactcaagagtagcaaataaactgtcatcattgtggcacatccaatggctttaaacctttttgagagggaattttcaacttacttcagtagctattctcatccttccttggggacacaactagaaaacaaaaagatgcaagcaaaacagtgagaatgaacctcacagcagtcacgttaaatataaatgctgttaacattaaagcctcagaatagaatttcagaaatcccttctgtccactactcttaaagcatcacaggctgagaccacctcttagatttcattcttcccaccatactttccccaattcttacctgtccataaggtgctatccagagccacactgcatctgcacccagcaccatacctaaagagatcaggtacagattttaattcattgttccacggttcttttttttaaagagtgttctttaaaaaaacggttcgtctttttaaaccaatgatgcaggtaacataccattcattatctagcgacaggtaaaggatacacttaatgttacaaagaagcactgcacccgcagttaagaaccaccgatggcggccgggcgcggtggctcacggcttgtaatcccagtatgttgggggaccacggctggtggatcacctgaggtcaggagttcaagaccagtctcgccaacatggtgaaaccccgtctctactaaaaatataaaagcctagcatggtggcgcgcgcctgtagtcccagttacttgggaggctgaggcagaactgcttaactcgggacgcggaggttgccattaaccgatgtcgagccactgcattccagcctgggtgacagaacgaggctcggtctcaaaaaagaaaaaagaaacactaatggaaatattggtgacactgcggaatgcaggcacttaagcacgtggactaccaccgacagcctttcatgagagcggacggctgatggaggctcgggtcacggcccttaacaatagcttactcgggtgactcggcatgtgccaccatcagagcggttggcattcatcattactctcagatgtccctaccaacacaggcttcatcagaggcagggcacgagagccgaggcttctccgcagttctactctaacatagtcgcagcttaggtcacgcatgcaccatatgtgcaatcccccaccatcctcaacttgtaggccctgcaaaggcgcgcgactggcttagaagtcccagtcaattcagggtgaccttagcagacaaaggctggagcgccccaaaacccgcaacattcgcaaagataaaacatacctcacaggagtcgactcctacctcgaaaagacagtatggtgcctgggctcctgtatataagagttcttttgatgacgtcacgacgcacgctcccggcagcgtccgcttcggctcctccccctaacctccctcaatcttcctctcatccagtatcaccttcttcccaccccttaagtccgccccttttccccgcccttcctcgccattgtgggcagagacatgaccgtccacgtgatgccgtgctcccgccctcctcccgactgaggaggaagagcagagaggggagggggcgcgaggcaaggaaagctctggggatgggggaagggggggcggtgtaaggctgagtgatttccttccggcacgtcgcccgctccgtgggagggggtgggggatttcacttccgggacggtgttccggcccattccggcccatttccacccccggaggtaggtgctgctccttgactggactcgggccccacaccccagtgccacttccctgcaccggggtcacctcgcccgccctccgccgcagcgcgctcctggggcgctcagctactttccttcaccccgcctccaggcaccg

SEQ ID NO: 503 - DNA, 28461 bp, Homo sapiens
gaacgcacagctgggagggtggagttggagctggggaccctcgactggcagggaggacgcggatgcagggggccgactgcaaggggaaggggaaccggctggacagggagaagcaggtctgcttttcgggatcccggtgccagggaccctgcccagttccaggcgtcgccctgacccagaaacgactgggcgccgccgtcctggaaaggccccagcgcacggacatctgagggttcgttcagagctctgtttctcggcgctgcatggtggcggaagggagggagcgaatgggatcccctaaaagggatcttagagtttcacccagtgggatgtgacacttgcaggtgtcccaaactggtgggaaccttgactggaaggctggggttaaggatgaactttctgccgtccagactgtcccctgcagagcagctgctgccagacagcgggagctgccagacagcgggagctcccacttcgtgcacaggatgggggcagggagcccgcagccgcgggaggcaggaatgactgtccgggaacctcctttcttctccctgaatcccagccctggcatctcaccagggggcacagtgatggtccagggctgggcccgggactctagctgaatctttcagagtatcccatccctctggccagtggcccaagcgagtgaaccagaatgcttccttgggagttttgaaactggaactggagagaggagctccctatggggaggtaaacgggagctggggccacctgtagtgacatttcctgagttcgaggagtagacgagactgagagagaaaagctgactcagagaaagggagtgataacagggcatgctggcccacacctgcaatcccagttactctcacgggatctgtttctctgatgtctgggtatgaaaggactttctaagcctcagaacagtgggagaactcaacaaagaaaaaaccaatacatatacaaggttactttgtggaggaaaaaatggattaaccttaagcaaaaaactgggaaggatctcggtaaaagatacgtcagaaggaagtaatgtcctttaagatgttcttagaaacccatcagacaggtggggtgtggtggttcacgcctgtaatccctgtactttgggaggcagagatgggcggatcagttgaggtcaggagtttgagaccagcctgggcaacacggtgaagccccgtctctactaaaaatacaaaaattagctgggtgcggtggcacactcgggaggctgagacaggagaatcacttgaaccttggaggcagaggtttcagtgagctgagatcataccactgcactccagccgggccactgagcgagactgtctcaaaacaaacaaacgaacaaacaaaaagaagagaaactcatcagacgaagacacaggaaaaaaatgagcgaaggaaatcagcagaggtttcattgaaggacaaagagaaatggtcaatacatggatgaaaacatgtttaacttcagtaataatcaaggaagcacacaccaacacaacatgcacatactgtttttatttatcaaaggcacacatatttttgaaatgagtactcctaattaatatgtacagagcacttacccagtgcccagcacaggggtggcaccctgtgtgtgagacagcatgaaacaggtagacacgcgccctgctgaaagtaagggaccgcctctctggaggatccatcgggcaataaggaggtttccacaccttaactgtgtctgccttgacctctggggcctgggagcagagccccctccagctggtggggaaggaagcgtggtgtgtttgaggacagaatggagagaagttgagtagagcaagtgtagactcttcctatccaaagtgtggtcaatggactgggagtatcagcatcaccagggagcttgttggaaatgcagaggctcaggccccactctgaccttactgattgggagcataaactgtaaccagattccagggaggattcatacacacattcccgtttgataagtggggggtagtaggaggtgaggtgaaaagtggggaggggatggctaccgcactggagaaggctggctttgtgttgaggcctttctcatgagggcagtggggagccatggaaggctttatgcaagagagggtacgggcagattgagattacagaaggatcccactggttgccttgtgtgaggacccagggagaagggggaggctgtccctgtttgagtaggagatgagagctactggtggctatgagtggaaagaagtgagcagaggtgagcagaaatcccaaggactggtgatgataggatgatggtgggaaccaggatgggctttgggcagaccctgacccctctctctgcctgtcggcccaccagataataatccctgtgttcctgggcgagtcagtgccacccgagatgttggcggccactttggctgagctggacggatgcctgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtcttttctggctgtgggaccctgtgtgagtcacttctccttctgagcctcagtgtcctcatctataaaatggggctttacaaacccctcaccgcagctatattaagaggcttccaagtgtccccagggagggggacatcctagcccatcacacacatggtggaggagggaaaatccaatcagagaacccctaaagcaggtcatgctgccttacacttggctatgcccagcccctccgctgactctgtcttcccctagcccatcagtgctggctgctgagtctttgaaagcggacccacggtggcagcatggtgcccaacacgtggaggctgcagtgcgggaggacctcttccaggaggccctcccagctgtcctgaaggccaaggacctgcctccagtagaacctgctgttaaagagaatctgaagaccttaatgcagcttttcttgctgtgagtgcgtgtcccacacttgctgagccactgaggggatgctgtgttggtagaataaagacatggagctgtccgtctccttggttgaagagaagacatatctgcaaaggctctggtccacagttcctccagatatcatgcctgcattccttttgtctcctaccccattccattctagcttccatgtgacctctgaaaagagcttgggcaaacgcttacttgaccctgaccttctgtgtggaactttgtatggttcctcactgcccagaagctaaagtacaagtcattgaactttgcattcaaggccttgctcccactcctccaggtggccccttctgcctgcacactcctaacccctctctgggctcccaccttggcctcttggcctccgctcatgctgttccctcctcatcttcgcctggtgcccttcctggtcttttggcatttggcaccctgtctcttctccagggagacttccctgacctccccagccccagtccaggtcaggcgacctctctgggctcctcagccccagtgtttccttgcgggggatacccccggactgagcatgtatcatcgatgaggggtgacctggtggaaagatgtctgaatcaggatcagccttggtctcctcggtctctctcctcactgtggggcgatgttgtgttccacaagtggggtgcagggctggttcatgaacctccttgcaggaagggaagtccctggttatttcctggccctctcccatgcctcctcataaccttgaccacagtcttctctacaccccactcccggaccactggcttgtccatgccccacacctggtcccagacttgccacctgtccctgccctctccccttaggactgtcatatttacctgtcgtgtgtctcagaccttctgatatctgagtcatctaataaacaaactgctaataggacaagatcatgacagacagagactctgtcggcctttcagtggaggctcctttaagtatgcacacttatagagaattttatacacgtagttgaaattgtacatataaacttgcaaattttttctttcttttttgtgggggaggggggagcctgggtctcactctgtcatctagggtggagtgcagtggcacagtcatagctccctgcagcctagatctcctgcgctcaagcaatcctcctgcctcagccgcccaggtagctaggactacaggcacacaccacagcacccagatttctttctttttttttttttttttgtagaaaataaagaagagaatcttgctatgttgcctagcctgatctttaactcctgggctcaagcaatcctcccttcttagcctcccaaagtgctgagattacaggtgtgagccacattgctcgaccacaacttcagtcatatttgtaatgtacaattcaagtgattttgccacactgaccacactcatgtttaagccacgccaacagagttccatgttttctgatgttttttcgagatggagtctcgctctgtcacccaggctggagtgcaatggcgcgatctcggctcactgcaacctccacctccccggttcaagcgattctcctgcctcagcctcccgagcagctgggattacaacgtctgccaccacgcccggctaatttttgtatctttagtagagacggggtttcgtcatgttggccaggctggtctcaaactcctgacctcaggtgatccgcccgcctggacctcgcaaagtgctgggattacaggcgtgagctaccgtgcccggcctttccatgttttaaagaacatattttgccaccccctggtggacagtggctcaccaccggcacaagaggctacacaggcagatgtcaatggggaccaggcagggacaggtattgtcgtgagcctagccctacccgcgcccccgcgagtaaccacatctcctgactgcccaagcgcagatttccatactgaacatgaaattgcctgacttcgaaatggtggcaaatcattcaaaaaaactttaagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggacgtaagcgtgggccgggcagcacggggcgaggggaggttggtgggccaggggtccggccctgtccctgctccgcctccccgacagtgaccccgaatcttttccccagggaccactccccactcctttcctcacgccaagctctgactttccgtgctccacgatcccgcggctccccctccgcacgtctttcccttgtcgccctccccagtcatgacccgggcgtgaccttcagggaccgcggcccgtatcgggatccctgccccgcgaacactgcgcgtttcggctttcgcgcgctcgggtcccgtccccagaggtagcccggccggctccaacttcgggcaaaacttttcatgtccccctcagcgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttggggccccctgaccccttaggttcctgctgttaggaccatcttcaaagtgcgagcaggattgaatgaatttctggctctgctcctcagtgtgtaagtctgtgaaccgggaaggctctcttttaacacccccggggcagtgcaagggtcatgtgggattgtctgtgtgctgtacctgccttggcacctgacagggtaggtacacgtggctgaagtgtgattttctagaacttttccaggctggtcagaaggaattctgggtatgttctgaagttacgtattttggacctgtgtcccagccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttgggtaaaagatattcttgagccacatccatgtctaggaggaagtaagggcatgagaagcttgaaaggacactgtccaggcacggtggctcatgcctgtaatcccagcactttgggagaccaaggcgggaggttcatttgacccaggagttgtagaccagtctgggtaacatagtgagatgccatcccccaaaacagttttaaaaattaaccggacatggtggtgtgcacatgtagtctcacttagttggcaggctgaagtgggaggatggtttcagcccaggaggttgaggctgcagtgagctatgattgcgcattgcactccatcctgtgtgacagtgagaccttggctcacaaaaaaagaccttctgaaatggagcctttgttagtccatgaaggtcgatgaggaatggctgatcctgctgggtcctccctcaagctacagaggaataatacagtcagccccctgtatcactgggttacgcatctgttgattcaaacaaccatggattgaaatattagaggaaaaaaaattgataattgcatctatactgaaaatacgtatagactttattccttgtcattattccctaaacaatacaactatttacatagtacgtacattatattaggtattataagtaacccagagattatttaaagtatatgagaggatgtgtgtaggttacatgcaaatattacaccattttatgtaagggacttgagcaaatgtagattctggtttcctctggggattctagaacaaatctcccacggatactcagggaaaactgttactctaacaacaagtgttatacacttaccatgtgctaggtcctctacaggtactttacactcatgatcccatttgatccttacaatccctatccactctccctttgctcagacaagacatgctatccccatgaggtagataatctccattatgccaattttatgatgagaagactaaggctcttcatactcccccgccctcagccaggctgtcccaagctgtggcgctcctcactgaaaactgctgtcacctctgagaggggcatgttggcttatggcacagacattagtggtgggggggccaccctgtgcccaacctttgagaaaacaggtgtctgaggtactgtgtccttagggagtctgcaattaggaggaggcagattgcccctcagcccacagactgacagagatgatggagtgtgcagcacacacgatgaggctactgtgttgagtgtctgtcctaggtgggtcatgctgatgtgcagccaccattccacacctgagtgtcccactgccctgctgggggttggggaatgctcattaccgggatgagcacttttgcaaaatgggctgaggtgggaggatcacttaagcccaggaattcaagaccaccctgggaaacaaagtgcgaccccatctctacaaagtcatacaattagcccagcatggtggcatgagcctgtgatccaaactacatgggaggctgaggcagaaggtttgtttaggcccaggaggtcgaggctgcaataatctgagtttccaccactgcactcactccatgctggctgcctttggattgttcctaattggatggttttgctttcaacagacactccaataaagtacacgaaataaagaataaagttaaacagtcagtcccagtgctgtgtaggtggcagtaagtctgggagagcgacctcggctgaactaactgtggtgtgcatcattgttaagcagggccagcaggatcctcatgtcacctggcaggaggagggacagggaagggtccctagaagtgaccttgagttgcacttagtgctcttggcagagggaagggcttgggctagtgctggaggcatgaagatggggtgtgttcagggctctccagcagtccaggcatgggaaggggacgctgagggccaaaggcggaggtgacactgggaagggaactagcaaggtgaggactggcttttggccatgtgactgaattgcctgtgtggtgcgtgtgtatgtgtgcgaatgtcagtgaactgtgtgtgagtgaattgtgtgtttatgtgtgggtgtatatgtgtgtgatgtgagtgaactgtgtacatgggtgtatacgtgaattttagtgaattgtgtgtaaatgtgagcagtgtgaatttgagtatgtgggtggataagtgaattgtgattttgttggtgtgaattgtgtgcctgtgtgtgacggggagtatgtgtgtgtgtgagtgaactgtgtgatgactatgaatgtcagtgaatgctgtgattgtgtgtgtgtgtgtacgtgtgtggggatttggtctatatgtgtgaatttgagttgtgtgactttgttggatgtgagtgaattatgtgactgggtgtatatgtgtgtgtacacgagttaactgtgtgtaaatggtatgattgtatatgtgtgtgaatgtgatgaatcgtgactagatgcgggtggatgtgtgtatgtgcatggtgtgtccatgagtgtgtaagtgtgcaggtggcacagttgcaacaggagagaagacacaggaagccttacctgccattcatccccccagctgtcctcccagcctggggacccctgggctggaaaggttatgaaaagtggtgctactgccaggaaggggtgatggggcagctgggaggacggtttgagtcttgccaaagggagggagtcgaagcttgcaaccctggggaggaggaggggcagactggggaccctgcttctggaaaaccagcgaccaacccccaaagggacacaggcaacccctgcctccactctacagtggggaaaaggggagagtggcgtggcaggctgcccagccagtcatggagggagtagacttcaggaggagtacagaggtctggtcccattttggggctgaggacaggagcctcaggtcagcagtctgcaggaaggccccagctggaccagctgctcacaccttcccacaggcctgcagatgggtgtggagagcagagcctccaggctgagtctcccagccccagatctgagcagtctaaatcatccccctccaggttccctacggtcttatccaccagccctgctgcccatggtggccccagatgcccaggagagataatagaaggtaagaagtcatgtttgaatgaggaagctctcttcatttatttcatatgaggatgaagaagaggattatgtgatcacaggaatgttgcatgcgggataatccaaagctggttatctccaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgcccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaacttctctttatccacctgctgcacctggccccacccaccaaaaccccccagctgccccggaatgtggcagggcagggaggcccagccagggagtgaggctgatccaggcctctagtcccagaccttgctgtttctcagggctgtggggctccgcttggggaggaggagggagggtgtagaggtgcagcgtttttactctgaagaccttttctgacttcttcctcttcagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaacaccgtctctactaaaaatggaaaaaaaagttaaccgggcgtggtggcgggcgcctgtagtcccagctactctggaggctgaggcaggagaatggtgtgaacccaggaggcggagcttgcagtgtgctgagatcgcgccactgcactccagcctgggcgacagagctagactccgtctcaaaaaggccgggcgcggtggctcacgcctgtaatcccagcactttgggaggccgaggtgggcggatcacgaggtcaggagatcgagaccatcctggctaacacggtgaaaccctgtctctactaaaaatacaaaacattagcagggcgtggtggcggccgcctgtagtcccagctactggggaggctgaggcaggagaatggcgtgaactcaggaggcggagcttgcaatgagcagaggtcgcgccactgcactccagcctgggtgacagagggagcccactccagcctgggcgacagagggagactccgtctcaaaaaaaaaggaaagaaagaaaggagaggtatctggggagaaggtacagcttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccagggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgcccaaggcaacaaagacaggaggagactcgtaggaggagggggtggtgttggggagctggagatggagggcgaggctggagggcagtccttcaaatgcagagaagcccccgggccccactggcagatgggagcagttaggggtaaatgcctggtgccagtgtccttatagccactgcccatttgttcccagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgaggagagccatctggagagtgattggccatcagggagtagttggcagtaggccggggccatagactgacccactctctgcccccatcaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcaggtgtgagctcagcctgtgggcagtgtccctcttcgtgtcacacccatgaggcagacagaaacactgaggactggagaaagccagaactttgcccagaatcatagagcaagtctctggatgatctggggccagaaccctgaacttctgcctcctgcctgggtgtggggtctcaccctggctgctcttgggctctaaggctgaacatactgcctgggcccctgtggtccattcacttaggggctggggaatggaccatgtctctgatacttctgcccatggttccagcattcgggtcggcagtgacaactgggaaagttgtatgcccacaactttttcatccttgtccctacagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaccaagagttattggttttactacattgttgtgttatacatatggagtaaaagtatgtgctagtaatcctcatcatggttaataacaaagtaacctcacaataacgagtcaacataattgtatcaccagggcaacaaaatgttaagtaagtaaccaattcgaattgcaaactgttaaaggatataggcgatgtttcacagggcatagcaacggtctttgaagtctaggaaacttaaaagatttcttttaacaagcattcatgtcttctaggacagttttgtaataactgcaaatagtaagattatacattgtcacacagacctccatgtatatccatgggatggaccccaccacaatgattttaacggagagaacttgatataaagaattggtaaccaggcattagagaactccgaagacagagagaatccagattaacacggaggtaaacactgcaagaagctaccacccctagggctgggggatcaagggaggaattaggaagaccaagatgctggaggggccctgaagaattcaaacctccaagaaaggtgttgctcatcccccctagcatcaccttccaagaagggcaggtttccccagtttgccctgaggtcttcacaggaggccatgtggctgtggatgcagttctcaaatgtgacagtagatgtcactgctgaccaataaacaggatgttccagacacactctgcgctacctgcccacatgtcttgtggctttggggcctatttcccatgcctgacctgtgcccaccatgtgccactctattgggggacctgccccaataatcacgtagattgtttcctatttttcctaagtgtcggccggcttgagaaataaagggacagagtacaaaagagagaaattgtaaagctgtgcatccgggggagacgtcacacgttagtaggatctgtgatgccccacaagccacaaaaaccagcaagtttttattagggattttcaaaaggggagggagtgtgcaaataggtgtgagtgacagacatcaagtacttaacagggtaatagaatatcacaaggcaagtggaggcagggcgagatcacaggatcacaggaccgaggcaaaattaaaattgctaatgaagtttcgggcaccattgtcattgataacatcttatcaggagacagggttttgagaccaaccggtctcaccaaaatttattaggcgggaatttcctcttcctaataagcctgggagcactatgggagactggagtctatctcacctctgcagtctcgaccataagagagaggccacgcccggggggctgtttataagccgatacctccaggtgcgtattctctttctcagggacattccatgctgagaaaaagaattcagcgatatttctcccatttgcttttgaaagaagagaaatatggctgtgttctgcccggctcaccggtggtcagagtttaaggttatctctcttattccctgaacaattgctgttatcctcttcttttttcaaggtgctcagatttcatattgctcaaacacacatcctgtacaatttgtgcagttaatgcaattattaaagggtcctgaggcgacatacatcttcctcagctgacaggattaagagattaaagacaggtataggaaatcataagggtgttgattggggaagtgataagtgtccatgaaatctttacaatttatgtttagagattgcagtaaagacaggcataagaaactataatagtattaatttggggaactaataaatgtccataaaatcttcacactccacgttcttctgtcatggcttcagccggtccctctgtttggggtcactgacttcctgtaacaccactcctagccggaagtattccaagtaaccattgcaactgtcctgccttaagggtgcctggtgatggcttctgtcttaggtcccattctggctctctcttccagtgatttctcatactttgggggacactctggcctgctttcctgggccttttccattaccaccccctctccccatcaggcactggggatggcggccacagcctatgccttcttgatccatgctggctgccttgggattgttccttattggatggttttgctttcaacagacactccaataaagtacacgaaataaagaataaagttaaacagtcagtccccgtgctgtgtaggtggcagtaagtctgggagagcgacctcagctgaactaaccatgctgtgcatcattgtcaagcgggaccagcaggatccttaggtcacctggcaggaggaggggcagggaagggtccctagaagtgatcttgagttgcacttagtgctcttggcagagggaagggcttgggctagtgctggaggcatgaagatggggtgtgttcagggctctccagcagtccaggcatgggaaggggacgctgagggccaaaggctaaggtgacactgggaagggaaccatagcaaggtgaggaatggctttcggccatgtgactgaattgcctgtgtgtggtgcgtgtgtacgtgtgtgaatgtcagtgaactgtgtgtgtgaacgtgagtgaattgtgtaactttgtttatgtgtgggtgtatatgtgtgtgatgtgagtgaactgtgtgtatgtgggtgtatatgtgtgtgatgtgagtgaactgtgtgtatgtgggtgtatatgtgtgtggtgtgagtgaactgtgtgtaagtaggtgtatatgtgtgtgaatttgaatggtgtgtaaatgtgactgagcagtgtgaatttgtgtatgtgggtgtatgtgtgtgagtgaactgtgtgattttgttggtgtgaattgtgtgcctgtgtgtgtgaggtgtgtgtgtgtgtgtgactgaactgtgtgatgactttgtattaatgtcagtgaatggtgtggttgtgtatgtgggtgtatatgtgtgtgtatgtatgtgaattgtgtgtggggttggtgtgtatgtgtgtcaatgtgagtgagttgtgtgactgttgaatatgagtgaattatgtgattgtgtgggtgtatatgtgtgtacaggagttaactgtgtgactgtgtgtaaatgttatgattgtgtgtgtgggtgtatatgtgtgaatgtgatacatcgtgtgactgtgggtggacgtgggtggatgtgtgtgtgagtgtgcgtggctgtgtgtcgaacagtgtgtgagtgtaagtgtgcaggtggtagctgtggaattaaggcacattaggggaatccttccttggctctggtccttggtttccctcctatgaaacaagttgggtgaattaggcagtctctggcattccaggatttggtctcaggtctaaacaggattttgtaaagtgaaagcagcatcccttgggcatcccgggaggtgtccctgccctccatggctcaccttctgccacatggcccagcagcagctactctgcagggccatgtgctgccatgacaggtactgatccccatgggcgcgggcctgcaggtcctggaggtaccagtggtcaggtgctttgtacatgcagctcatatagagcaagctagccacactggggggacatggcaggggcagaagacatgccctgaacactcttcagccattttctggggcattttcactatccccatgatgcagaggagggatgtgaggctcagagaggttaggtaactgcccagggtcacacagccctacacggggccagattatcatctcaactaatggcagcaaggaagaaacaaaatgtcatgaacttcagcaggggctcagggaaggcttccaggaggaaggggcacccagtgtgagtctgaagaatgagagcaagttgggtatctccccaacatatccaaagcatggacagggccaggagcaaggccagcagggagagagccttccaggtgacatggcagcattgctccccaccccgtcccatctcctgttcacctatggtgaagggttgtgcagtctgacccccagagctcatcatgcctctatgggtgttggaccatccagtgatcccaggctctgaatgtgaatccagctccaccaaggaggcactatgtggcctcggtaaaggacgccaccatgcggccaccaacctggaggctggttttggctttcatttttcccacccacctccaacccttcagcacaccctgcagttagagtttcaagaaaagtcagaaccgaccatcaccccaccaaccctgcaccaccaccaccttggtctggggctccagcgctgcatgccagatgactgcagtggctttctcacccctgccagggggatcctttatgacgtaagtcagatcacagttctcctctgctcaaaatactccagcgactcaatccccctgcggtaagagccaaagccttcccagtgtcccatgctcccctctgtcgtgacctcctgctcttcctgctcactacacccaccctggcccgttgctctccagtctgaaccccatgcattgtcccacctggagccttcgccctcactcttccctccagccagaacacccttctcctcatgccttgcacattcctacagctctctgctcagatgccacttcctccagggagtcttccctcaacatcctactcacacacccccaatcttaccctgtttattttttccatggcatccatcaacatccgatatgttccatgtttacatgggttactgtcagctcccccttctattaatggaatgtgagatccatgaggagaaggacgtagacacgttcactgctcaagccccagggcttaaatggggtctggccctggtggatgtttagcaaatagccactgaagctcgctgagtggtccctcgactctccagggaaacagcacttgccccacaggatttgtgggcaaaatggtagcactaagatgcctggtacagccgctcctcgaaacttagcactctccttttttcggaggggaaggctggcggtgaggaggcccggaagcagactgggccctgtggccttgtgcaagtccctcccctcctccagcctcagtttcctcacttgtacaatgcaggaggggacttctataacccttgtcaacactgggcaccactgcctgcctccacccattcttcaccctggggctggtgcagggcccacagtccatgatccaagccatcaacagtgaacagacagccgactggccccacaaggcccggcagcagcccacggaccggttacctctcagccaaggtgaagtccccatccttcaaggcccggcaccttcctcagggggttcacctgggcaaaggcatcgctgtgctgctggcctgcaggagagatcagagaggtgagtggggataacccagagttctctgaggtctctgcccacccccaccccaaaatcccagcagcagctttctgaggcccctatctgggaggcatcagggaagaggaagcctctctgctagtcactgggtcacagaccttgaccccatcagagggccatctttcctgtgtccagctccttgaagcatggctcaaggacaattccctggagctgtaattcacaccccacccccagccagttccatccataggtcagacccctccagcctcctccctgggctctaggcttgccccctctgattcagcttcctatcccagctggggacttaggccctactggccaggctgggtgacctgtcaataccccagagtcccagccaaacatgttcccaaccctcagaccaacctcattcttgctgggaatccctgccccattcagccactcagcccccggtggctcagctcttcttcctttcttatgccaaactctcaaggctccctccccactgggggttcccaggtctgactcactttagcattctaggccagtgctagaggccgcattaggtgcctggtgtttggatcagagga

SEQ ID NO: 504 - DNA, 280827 bp, Homo sapiens
ctttctattcagcctgttatttactttatactcctttaacatctaccacccatataggggttaattatatactatctcatgttgatttataaatgtggattagtcttgtttaagtaaggacatggaaagtctgattctcccactcaaatccacccaccttctgtctaggctgatgctggatgtagaagttcctattaaatactccctggtttaaagcacagatcttgaaatttttatggtattggatacagactccagagtaatggactaagagaaccaaatggctctgagttcccttaaaatcatgcagagctgtgttcaaatcccatctcagtccttactagctatatgcttctaggcaagactttcacacctctgggcctcagagtccttacctatgacagggagatcagacgcctaccttcagtgttcttttgaggggtcaatgagttaaagcgcttagcaccatgcctaggacacagaaagcactaagtagatggtacttattatcacttctaggttttcctctttattggaaggctctcacctgaaccatcaaagctagctgctcaacttttaattcatttctaaaactacataaggagttggaaacttactgtattctatttttttctggatttttttcccttgcttttaatagaaagggagtctgatttgttccactttttcggtgccagtggttctcgttctcgacggggggcaattttgtcccccattgtttggaaatgactggagacattttgggctgtcacaactaggctgggtggagatgctattgacaactagtgaatggaggtcagggatgctgctgtacctcctacaatgcacagggcagttccccccacacttctcaacaaagaattatccagctgaaaaatgtcaatagtgctgagattgagaaaccctggtttatagcggctagcagaccggagcccgggtgagctccaagatgatgtcatgctgggggagacccacgctggcctgcggtgagacacattacacatgggggatcgcaccatttccttgcagacccctcacctcaccaccgccgccgcctcatatcctgctcaggtccctcctgggaacccagggaaacctcgcagcagatggggtttcgtttagtcacattctctgcagccagattggattacatcgccagcagctctggctctgagagaccaaagttgcttgatgagctctgggctggcctttcaccttccaggacccaagctcaccccaacacacaggaggagaggggcttgtttgtggttctatctctcaaaaggacaaaagctgagaaacagaaaaagccaaaaggatattggtatcttctgttgaaaatggtgcctggatatttctgtctttatttcttgtgtttattatgacaggtgataaatattccgtagtctttttgaagaaatatataaattatagagatctccagggcgtctgtatttcatacgtgtctttgttataggctgttagaacaccacagactgggtggcttataaacaatataaatgttatttcttatagttctggaggctgggaagttcaggatcaaggtaccagcaaattcagtgtttggtgaggacctgcttcctggttcatagacagccatattcttgctgtgtcctcacttgacagaagggacaagaaagctctctgagccctttttcatgagggcattaattccttcatgagggcactgccctcaccaccttcctgccggtggttccacctctaactaccatcacattggggattatatttcaacataattttagggggatacaaatattcagcctatagcaatgtaaaagagtcaaaatggctattaatttttgagcagttataataacataagtactgtgttatgtgtttaacaagtattgcctcatgtaattctaaaacgatgatgtgtagattagcttctccacttgaaagcagatgtaatggaagatcagcaaagctggctcacttcagggccacagctactaagtggaaaagccaggattcctactcctctctcacttcctgcaagacctaagtcttaaccactaagccagatgcttcttactaaatggtttagtttggttcgagtgagaagatagctaatgttttgcagaaagcatgactaatccaagatcttccagcaactgaggagtgatggaagcatttctgattcctcttgttgttgctctttagcaaatgggtgaaacaggtaaaatgagttaccaaagcctctcatctctcacctgggcatgaattctatgcctttccaatatacacatgctgcctcctgcctcaaattccaggtgttcccttttactagatactacgctaggaaccagggacctaaacattcagtacctgctcttcaagaagcttacagtcaagtgtgaaaacaagacaaggaacaatgttattacaatgcagcagaataaatcctgtgactgaggtaggtacatgctagatgtaggttgtctaacccaggctatagggaggattagctgatttatctctgagttttgaaacatcctcaaagcaaagtagtttgggaaggataatctggtagaatatacagcatatgcaaaagcaaagaggcatagaagagacttcaggagcagtgagtagtttgggagagatgggcacatgatccataggggagagatcatgatgagtactgtgtgctaagcagtgtgcatttattcggtttttctgacctcccaaaaataacaatgtccacttaggaatagagattttcacaatatacaagggaactgcccacagctaacccttatgagaacttgctggtcttccatagggatttcggcaccaccagccaccccagtgtgcttggcactaggttagggacttctagtcaagtgatccttgaggccgtagtccacatacaacatctgctacacattctagtctctcatggctatgatgcatgccggagtgggcactgattctctacctacttaggtacgattctgttttgccaaggattctcctatacaatgatgtccttcctccctccatgctcagggaactagatagctgtttcctttcttcagagaggaagatagactcactgtatagttactatgaagagatttagcaccttcccgccaccagcatctatggaagatacaggggatgaggattctttgggaactagaatctaaacttctcgtttgtaagctatttttggataggaagcagagccacatggaaaagatttgataatgttaacaaatgacacaataatgactagcgaagccaggaagtgtttctttttatgctcaaatgatgcacttcagttacatagacttctgagaagatagccttcccattctatctaaaatgccattacatcttctaatatgcaacaaaatgccacctgatccataaatcattcctccatatttagcccagaataccgctttatattttagttttatctctattccttgattaccctactttgccaggatcctaagtaattgctttcttatgttcccctctcatgagattataaaataaggagagcaacatttattatgaacctctatgtggcaggcactgggataattgttttataaattcttgttcatggaatcttcccaaattgactatgggcagatgttaccagccccatattaaaaataaaactgggtgtgatggcatgttcctgtactcctgtgactcagaaggctgaggtgggaggatcgcatgagcccaggagttcaagtctagcctgggcaacatagcaagaccctgtctctgaaaaaaaaaataacaaaaatgagtaaaatggaggttctgagattttaaactcctggagggcttaaaatttatgcctttatttagctctgtatgctccaccaacgtgacataacagttctctgaatatggtaagaacaaagtgagttttattgaaattcttggactatttcttttccctactgaagtaaggcaatctccatccaaggttcatcttatattaaaaaaaaatatgctaggaaatctcaacagtgttgtatcaaaggagtcagagcattaaatattttgggctcctgccacaggcatttactgtgaagtaaaggacatgtattgttctgtgcttcatcgtgatagaaagaacgccagcgacgtcatgaaatattttaggatcagatttgcaacactgtgcttccaaacagctgtgtgtcacaatgaggggcagggcctgggcatctgggccaccggtgttcggctccttctcttcttctctcttgacctttagcagactccgtgtctctttcctttgatggaacagctaatgaaacacatcctttccttgagtcaatccctgatttcagaaaaatttttagacatctgtgtgtgtgtgtgtgtgtgtgtgtgtatgtgtgtgtgtgtgtgtgtgtgtatgttggggggatggagggaagagtgaggaaatagtttccattcagtagtctggagcctgatctattggaaaatccccaccccccaaaaggaaatgctacaagagctcttctttcacagagtttggagtggattcttttctgttgtgaagtgcagatgtgaaaaattcacctgttctcacctatggtcagacagactgttcagacttttaaaactgtggcaggagcatttgctagccctagttgccaatgagctggatatgtgggtttcccccactaaacggaacttggtcttatggcaattataaagccacattgaccatacttgaaagagagaggctgggggtggccctaatgagttaatggcaatgttcaagttcacttaacttttgtaatcatccagtttgcaaatgcatagcatctactaggagaatgtataatattcattaggagttaaagatgataatgagaatatttattcatttgtttaacacctatttgcctgtctcttgctatgcattgagtattgtgctgggaagtgaggaatttagatgaaccagggggtttgtccttaaggggctcatagcttagaacaggagacagacaagcaaagtgacaatggtaacccattgtgatcaatgtcattaaagggaaagtacaggatttaggaactaatagtggctcagggtgtggggaaggaaggcttgctagagaggattacacttgaacagaatcttgaatatgatttagagcttgggaggaaaagggaagaaaggaggcagtgggagagaggcagagatgtctatccataccagagtgtgaagaggagaaacagcatgctgcatttggggaaagtccatggagtgagggtcaggaatggagggagggtttggatgagacagatgaaattggcagaatctcatgtaggaccttgagagccctgggaaggattttgaactcttcttttctagaaaagttataggaggccatttttggatgtcaacaaggaggaataaagatagatttgtgcttgaaaaatatcatcttggctataattgtgaagcagaattgcaagcagattggagttggagagaccagcaaggggctgctgtagtcatttaagcaagaaaggatggtggctcaaaccagggtgggagttgcagggatggagggaattgggcagagtctagtgatattaaagacaaacttgcaagggtttggtgattgatgggatatgggtaaagagtagagagaagtaatatcctgaaatggaattggcaggtagggagaagagggagaagtgactgttgtttgggcctggtagttccagcttaggaatagaggcaatcgaaacaaaaaaattctgttgtagacctggcctcagcaggaaaccgtgcctgtgctctccttatctccagacttggcctgccagcacatacatatatcaccctctcacttaagatggagctaacagcaggcaaagttcatctcttagaggcccttaccctattggtttggcatgtctttattctcacagtccacagcagtaaaataataatattgcttacagagggatggcaccatggttaagtgcatgtaagtcagactgctggatttgtaaataggctcattcttaattagctatgtgagcttggacaagttactgaagccatctgtgattcagtgtccactttgataaagtaggggccatagctcttatttgacaaatttgtttaagagaaaaaaaaaagcagaattatatgtacatgagtaggcacctgataaatactgataaaacaaatgaatagttcttaccttattcttggttcattttctcttctcagtatataatactggatgcactttgtcttggggattcagagccctgctttctttaagggagaaagggaagttgaaaggtcaattaaagttttttggagaatctgtatcctgtgctgcattaggcatttttctcatgtcctctaacctcggattatcattctaaagtctttatctcatcatgttccttcctgttgcccaaaggatcaagttcaattttcaaatgttgagtaaggctttctagagtctgaatgtttgtgtcctctccaagttcatgttgaaaccaaatcctcaatgtgatggtatttggaggtggggcctttgaaaggtgattaagtcatgaggtggagtcctcatgaatgggactaatgccttcataaaagagaccccagatagccgcctttcttcttccactatataagggcacagcaagaagacaccaggaaggggccctcactagacactgaatctactgctgccttaatcttggacttcccagcctctagaactgtgagcaatacatttctgttgtttataagccacccactgtatggtattccgttacagccacctgaaaagactaagacaactttcatggccctttgtgacctatccccaacttgcttctttagccttatctcctgcctccacctgctaggtgctgactctaccctctgctttagatatgatatattttctatttatcaaaatgtcatgaccacatatggccccatgctaaaatgtgtgctgtaccttctgctgggactgtcctcagttcttactccttaattaaggctttgctcaaatattaccacctcttatagaattgatcattctatcctctgatccctggaaccttgagttttttctaatatagagcttattgcagagcatctcaattatttgttgagttcatctttcccttagtaaactgtgactcttcaagggaaaaacctgtaccttcttggccttggtagcccccaatcctaacccagaacgtggcgcagagtaagtgtttaggaaaactttactgaatgaatcagtggataagcagattcaagttaaaactgaaacaacagtaggtagatgacataccttttttcctcccaccaccttcttgctttgccttgccttcaccccagctcagcaatctgctcagaaaagagagcatcagaactgaccaaaaaaggaaggaatatcctaagaaatgatgcagctacatattgcttggcttgtgtttcctagataaggcattgattcctaggcactagaattatatactataattaaagagatttttttttaaatctatcaacaaagacctagagtttgaaaatctttcagttttctaatccaaattagggaaccagttacacagggtagcataggtcaaagggtagggctataagacctggattggctggctgaggataaataaggaagtgtagacttagtccaattgcagcccaaacttgacgtgtaacatttatacttagaaaatgtgtcattctcacgtcctttatacagatttgtccatcagtacattggattttcttaaacaactaccatttgattcccctattataattattgaagtgaattcactctgataaaatacagtccttagtagttcgctttaatgctctctaaaatattcttggaaaaatatgaacgtttttaagttgacaagtgcttttattataaaagtttaaatagttgtgagggatataatgtaaagtatattgaatatatagtcatttaaaataaaactaactattataaatagatttaatggattgaaattccactttaatttgataccaccattcatccatttaaaaatatacaagtagaatcttccctaacagttgaaaacttacatagttcttttgttttccttaaatgtttatttccatttcatttgctctatagaaatgtttcctaatgtagtatatttttttatactggaaattctttcactgatcatgttgttatattattctgaaacaaaacatgtatataaattcatattaaaatttctttaatgttctgtaaatataagatgctaacaaaacccaatttcttctggattaaattatcataacaattattagatgtatacaactgatcaatctaccatacacttattaaaattttgctaaatgtgatgtgaaacataaggttttattagaaatgcttctctgaatgaggtgaactttttaaaaaattaggccatatgtctgctgaggaatattcattattgctaacgtgagatggtatttcataaattttatttacttttcattttttggttgtaagcactgagaaacctattcacaaaaataagtagatgggaaaagaaaaacttttcttatagcagtgttataacttcttaccaggttgtatgccaaaaatcacataaagatcaatcatcaaataggatttttaatactttctcaggtgacattttaattaggttccccttcagttttgttgtaactaaagcattgaaagtcatctgacttgcagaatgatttgctgcaaggtcattagtcattcactttctcaacactttttctcgaaagaattttgagttgtacctttgtttggtcccccagaaatttttataccccaaagcaactcgagatgagtgagaggtatgaattccatttgtaaagtgagagaaaagcatttacgaaaaagggactctcttcagattcctgagaaagagtgcaaatgaaagctgagaatctgaaaatttccttatctctgccaactagagcccatggaaaatctttgagtaactctgggggtactatgcatcacagtctgaaaattattatatgggatgtactttctatacttaaattaaatttccccatggaggcagcattgttatacaggtgacaatgagataacaatgcaaagaaaccagaagtcaagttcatatcgacttatatagctctgtctccataagtcagaaacaggaaaaattaacttgttcttcagcaatctaggttgacttcatgaacgagctggcgttcaaatgaatccttgaattgtggaaacagaatgttaaatctggaatgaacttcagatatcatctagtatggagaggacaattaaatgttgacttttacatcaatttggattaaatatttgtgattgcttacaattctgtgtcaagaagtagtcagaggaatcatctgagatctgtaggaaagcatgttgtgattgattagctatgcctgtcagaggaagcagggagagaggggcacaggtgatctgctcttgcccccctaggtacatagtccttatcacatgaaccacagggaaaactgaggctgactgagagcaggaagcttgaccaaaactccacagtgaattattgccaggatgggtagaattacatatgttttattcaacatttggtggtcattgtaaatttggtaacatttgcaactggaaaatttggggatgttttagagctggaagggagcaaattcttaattgagcaatacacgctgtcctttctttcaggctccttcacatttgatctctgtgcaatttgataagaggagggaatgggccgtcaattatgaagagactgaaaacctgaaaatactgagtatggtcttagttccctctccaaagggagctcaggaaaaatgccaagccatacaagccactgattactcatctagctattgtttctacctcaccctggcccaggaagacagatctactgaggaaaggtaatagaggctggcaaggttcctacttttacatctatctgtaatatccactcattcttagcatcttgcacatccacagggccgtacaggagtcttcttgccttgtattattgaatcttgggataggggtaggaacagacagaggtattagcagagatccaacaggatgtaaaacatacatgttgatgcaggggttaactttatgtataataaatagatttttaccatgcataccaaactgaatattccttcctcctttttctctcagacctctttctatgtgtggctcattcttttactctacaacataatgttcagttgattctggactttttctgtgacaaacaatgctgtaataaacatcctccttgtgcattcatctgggtgcacttctgagaatttatctgaaggataaattcctagaagtagactgtctgtaacatagggtctatgcactttcaatttccatagattctgccaaatggttttcttaagaggttataccaatttacactctcagctatggtatatggtaacccctgctttcccacaacctgccaacactgggtatttacaaacataaataaatggagggtttgaataattgtagttttgaattagacttggggcgtccctctcatctgccccaacttgtgtctccccaaagcaacctaactaggggatggctaatgccatagactctgaggcttactcagagcagaggctgaatgctcctgcttcagtgggaacagggggtgtttcttcagtctgtgccctacttggcatctgtccctgacagacccagccagtgtggggagccagcctctctaaccataagaaagaatggattggaaacaaattgatcttttcacagctggctgttcccctctttcccctcaacttggactcagctcagaacaaggttgccgatgttctgctgcaacaaagatggcattattgaggactgcctctttggggggaaatgtccttctccaagaatcgcctctgtagtttcaactatgacaagcctggagaccgagcatagctgtgcatctccaagggtctccaaagcgacacccaactctatccgtcctgttgatgaccatgtactcttctattggtgtccacaactttatttaaatgatgtcagatgactcaattcaacagaatctaaccctttattcatcctccctggagacctgtggtcagtgggcaggagagtttgggattcaaaaagaggagaactgtgtgaacacagggaaaaaggatctagtgtttatttctagcaacaccattactattgctgtccatcctattattctgcattcttttgcttcatagcatttttttaactgaaagaaatggctccacgaaggcagaaatattgtttagtttaaaactgcatcatcagttcctagaatacctccttatacattggaggtgcttgatacctatttattgaatggatgaatgaatttcatgagcacctgtgttggacaatttaatgtacatgatgatatttaatattttaactctgtggggtatatatattatctttatttatagctaacgaaattgggtctcagagattaagtaatgcttccagaaccacacaactggtaattggtaaaactgagatttcatttagacctgactgatcccaaacctatcttttagaacactgggattccagtttatctaagcttaagctcaaaagtattaaaatattttgcaatcaatgagggaagttgtcatcaaggacatttccaggtgagcatggtgtgttcaacaggaagagaaactcctccatactcccaccaaagtgagcaagtaccaaaatgttaagtgttaattaaatcttattcatctggggacaagcagtagggtgaatttatatgcatgtagcaccgattttgagctaagtaacaaggggattctgaaagacccttatgcggacaatgagtgaatgtaggcaagggcactaatatttaacaaagttatgctgtgtgctaggaaccatgctttaaatttatgattccacttaatcattataataatttcctttctttcctcttttattgtcttgcccttcccttcccttcccccttctctccccttcccttcctctttccctcccctttcattccctttgtccttcccttcccccttcccttctcttcccttcctgtcccccttctcttctcttctcttccctctttctccttctcaccctcccctcccctcccctccctttccctctccttccctccctttccctccctttcccttccctcccctcccctccccttcccttttctacccttcccctctcttctcttcccttcccttcccttcctctcccttcccccttcccttcccttcccttccaccttctcctctctcctctcctctcctcccctccccttcccttctccccttcccttcccttctcccctccactcccctccccttctcctttcccttcccttttcccctcccttctcccctcccctccccttctccttttcctccccttccctccccttctcttcccttccctttcctctacccccttccccctttcccttcacttacccttatttcttttctttctttttctttgtttctccctccctctctcctcttttttcttttctcctttctttccttcctttctcctttttttcccttctttctttttaaattcccagacaagaattttgaagttcagctaaggtaagccacgcatagtgacggaaccagcattcagatttacatctcttgctacccatcatgtcacatagtgttaggcagagactggggtctcagttgcctaagtaaagtcataggcatgaagggtgctgcaggaatgactgagtggcaggctcctgacagcctggttgatagaccccaaggactacttgggttttggcgccatgcctagtatgactttatcctttaactgtttctcttgtcagtcagccccctgagggagccctgtctcctccttgaaactgtactataatgagaggtctccacaagggttccagaaagccacacagtgtgctgtggttttcccgagaactggctccaaggtagtgctctgagatcagtccttccagctcccatctcaaagatcttcaaactccaggctctcaagggttttgagctgccagttatgatgaaatattagcacagaagaaaataatttttttttctattctgtgtttcttaccaggacaccatggtttcagaatgatttatatactttgaatattttcaaaaaatttctttcaatgttgttccttctttaggtatttctcttatcacttgggctcagcttgatgcttctctggaatttttcttttttttttcctcccatttataaaataccaaacatgtgtccccagtctggatccatgtaactgaaaatcatggggaaattctttatgtaaaaagccctatagattgtttcggacaaaatcaaccccaaagagtttgtccccacaatatttgtgaataaaatcatccctctgaaataaaaacaccaccttaaataaaggagttcctctcaagcattttactctatatttattgtttgttcattcatgccatcatttgaaaaatactaattaagtatttaccctgtgttggtaattgtgctgggcacaaagaacataatagtaaatcacataaaattccatcctcaaggatcccatgttctatcatactagagaactgagtacagctgctcctcgacttatggtgggattacatcccaataaacccatcataagttaaacctatcataagtcaaaaatgcatttaatacacctaacccactgaacatcacagcacagacaatgtcaggcactttattacatgtagtaaagttgacatgactcttaatcctactaacaaccctaggagatagattctgttattattaccatttcatgatttaggaagctgagaatcagagaggttagtggctggggttgaaattcaagtagtacagtgtaagagcctttgcttctcctagaggctctgtaaaggtctgttgaataactgagtagacgatagattgattgcaatatagttcctctgttgcctttttgaagtgttagtttagtaagcaaccacagagaaattattatctactagagatgggaataggaacggtttcctaaatcagggttggccaatagtctttagttcaaactaaaagccatcacttctgcaacattatgtgtcaagcatgagctatatgacatgaaagataaagtgatgtagcaaatgtattcataattcagcaatatgagattatgagaaggagcatattcctgtgcactcactctgaggtcaaaggagacacccattttcctcttgagggaaatagtgagaggtgtttacctgaaggcccctggtttgtgctcccccatagctggggagagggagctgctgccgccctttccagtaggagttgtatattctataatgtccttatcacaattcctttaagggcctccagcactttggaagcatagaaaaaagaaacaacattcctgcatcgcggggccattgatgaataagaatgtttataagaaggcaagcatctttgcactctatacatttccaaatcttttagaaacatatctaagaacttcttagttcccctccatggttactggatctacaaacttggaatttccccattggccctctgattgtatttggagtctgttcttcatcttgtggatcctctgggctctgtcttgaactgttggaacattttgctcccacagctgttggaagtgacccattaaggtagccagagtcagtcactcagcatcttaatggcaagaccaaaaggggtgaaagaaatagaagtcacggttagtaagcgactgacctcattctgcaggaattctttctggaaagagagcagtagaatgttgtgacaggcagtaagtcatctgtaagaatgtttaccgtggaattctagcaaaagaaatggctcaagaaacttcctgggtaacacaaatagagtctgctcagaggccccaaaagagagtgactggaaaactttagccttgtgagggaggctgtctactccagtgttggagtcagctggaggtgcagcagcgcttgagctatccaaactgctaggatgttgttaataaaagaaccttctcgttctcgagtcaacatggctaaaacagccagccatgagatgtatgggaaagaagtgcagagcaagttgttatttattgaatgtgtagttaggaattactatttccatttcatggaggcttaagtagattgagaaatttgtctgagttcacaaagtttgttaagtttcagactctgggtttagacccatgtgtttctgactccaaatcctgcatggttggcttttgtgagagcaaggttacacactgtacacattttttttcctccattgcaccattcactgtcctaggtatatagaatcctggaacacaggattggaaggacctttaggcatcccatggtctaatcttctcatggtacagatgagaatgggctcagagaagggaagggccttgctcagactcacacaaaggctagggccagaatagatggtgcctgactctcagttcaggatgcttattctgacaaggcccgtcacttcacatggatatttaatgtattttgctagttggttaaaaataatgtaatgtatggcagaaccatctctctttcttcaaggtaagccattgctaagtctcgagtccttttttgtcccacagctccttttttcattgattattatcatttggtctataaagcctttcaccttcatttcagtgaacaatactgctgtgggagacactggagatgcaaagataaatcagtcctggttcatgagcttcaggaacttaggagcagtttggagagtcagatatgagaacagcttgttttcatacattattacacaatcatatgtaatatatagctggggggatatagaagtgaatatgagaagacctaccccaacctgggaaattagaggagtcttcctgtcttcctggaggattaattgattaaagtgactcattatttcattcctacaacaaatatttagcagacacctcttctgtgtcagatactcttccagttattaagggatgcagcactaagaaagcaaaaatattcctcaccttcatgggagaaatgcaacaagtgtaactaaacaaaatattactcaagtttgcagcagtgacaggcccataacaaggcaaaggtctacagactaatattgggttgaagatttatttttacaagggtggccagggaaggcctcttcaaggggaagtcttttgatcaaagaactaaagcaagtgacagggaagaaccttgcaaatatctgcttcccaggcagagtaaaaaccaggaccaatgtcttaagtcaggaaccagcttgatgtatttgaaaaagagcaaaagccaggcgtctgtagtcccagctacttgggaggctgtggcagaatggtgtgaaccccggaggcagagcttgcagtgagccgagatagcgccactgcactccagtccagcctgggtgacagagcgagactccatcaaaaaaagaaagaaacaaagaaagaaagaaagaaaaaaagaaacaaagaaagaaaaagagcaaaagccagtagggatggaggagagttattgaggttactgcaggaggagatggagatacagacatagacaatgaccagattgcagatgttgtgcaagtcacaggtgagtaggtcttgtcaataatttccctcctggtcagcattgctggcaatactatggcatcatgcatagagaaagaaaaagctaatagcaaatgaatcactctgatcatgcatcttgagatgttgccatggattacaattaatgcgttcctatccacaaggccagattccctcaaagcatctttttgggaaatgcagcgagctctcctggccccagcactcccacccaccccatcacacaccctacattcatcatctctttctctgtttctttgtcatgttgctaacatcccttgatggagatggtgcaactccaagtaaaactgtctccataaatatttagactgaatagaaaatgtgccaaagatgcaaataatctgtccagagggagaagagacctttctctttgttgttttcttcaggcttgtaatttaattcgtggatacatgtctttgaataatacataactatcaatttacctaaaagagtcccatagaaaccttagcctcttcatccttctgccatgcccctcatggcattttcttcttacgctggagtatacatttctctgcttttcttttatccctttctttcttctttattcccatgtttttgatcacatactgtgtgtcagcctctgttaagctcatctgtgcagagtctatactcactgcctgtcctcctctcatagtcacttgtcaattcattttcattagccttctccctccaccctcctttcctgagtctgttcccactgaggtcaacccagtgttcatattactgaacccagtggccatctttctgtttcttcttttaccagacctcttcactgaactagataatgttaattagtcctggctggagcgcaagtctcctttgacatctatttgcactgttcctctgcttgaaccactctgtctattccttctctgtcccttaaatttttggcttcttgtgggttgggtttttggtattcttctttgtctagcaccacccttgcttgccatcgtgccctcattcaggcctgggctttgacttgaatagcttctgaatctctatgctctgcctgtattggatagctggcaggctatgggcatgggctgctaggtcccagacaactcacactctcatctgataagtgggttttaatgtgacccttgttgtacctccttatttctatttcagtctcacttactgcttcctctttatctgttttcaagtcttcctactagatatttccttaagaaggcagagaaaccgtgctctcttagtaattgcacaattgaaattattcctcttgaatatttgatgatgacatattttgacttgatatagctttttcaatcttacaggaattctaaagctggaggaatgtttaaactccttccagctgccagtttcacgtaaagaactcttttctaaacctggggatatgagggactcttacattctcctttaatcaaatcaatttaggctgaaaagaaggccaagttgacagccagcatttcactgctggctgtgtatccatatacgtatgtatggatgcttagaaaagtggaatgctagtgatatatatatatatgcatatatatatacatatatctatatatatagacatatttctgctttactaggtgagaagagttgcttgattttaagggctctcaatcaacaggcaccaaatgaacttacagcttgcaaaaatataaagcgctcaaggccgtacagacaaaggtaagggggcacagacctttcagttgtctacaggtattatcatctgaaattgacatacgaagaaagaaggtcagagaagaaatgtgacatgcccaaggcaatccaactgaaaaaatagccaatgtggacaataatcccagtttatagcttctagtgcaatgacttttgccagcacccagcatatcagaagataaacccactgactttctttagtgaagattgcgaattgtttaaatcagagcatgtgtgcaaagtccagggtactatctaattcaacacttctgtaatttgaaagctaataattataagaattattgtccttgtccaactgttccttatactatttcattgttggttaatacattgaaaattacgaaaccttatttttgattggaagagtggtataacttctcttaggaattatactactagtatcctagtgaattatgaattcctacacttaaggaagcacaattataatagcattgtttttctttacttttgccaataaatcagtaagtactgcatgactacattctgctaaaacttaatagttgatgtggaagggaacttactccttattccatatagagacactgtagagtccctggaaatgctggctctcctccctcttctcatctgcccccagcaggggagaaatgagtttatgtattcaattgatgagttttggagctgctgaatatacttagctcaatgttcttattgtggtctccggactagcagcattaatagcgtgaagcaacgtgttagaaatgcagattctcaggccccactccaggctcctgaaccagaaactctggagatgggcccagccatctgtgtgttaacaagcccaccatatggtcctgatgaccatttgagtttgagaaccactagttagctggttccttcatcctctgtggacctgcctgctcacagagaggctgtgtctgttttctgccttgtggttaaaaaaagggtctgcctgttggagttggggaaggacatgcagctatgcagtgctgtccttgaataggtgttcctgtatgctaatttcaggtgcactgttggaaagcccatgatttcagatacctaaaccatgttctccaaccaaaccttatctaatgaagatgacattttaattcccttgtttaaatatgactctaatttcaaagtaggaagttggttctgactttgtgggtgagaagaggatatggtgtctaaacatgtgccccttaaaaccaccataatagccaattacttattctttatggccatatgtcaggtatattttaaagttggaaggagctttggagtggtctagctgactttatagctgctggcaactgaagtccagaaatgggaaggcattttctcaaagtcactcagaaagtaactggagatagcaggctcccagtcctgggctcagacccacacatccagccaacataaccatggtgcactttaaccaattccaagttgaaacagaggaaatgcatatttggagcaatttatctcatcacattaaagatttcctaatttacatttctgcccggtaatcatggatgcctctgtatctaccccatggtcccctggtgaatatggcctctctcaatgtcaggtccttgtattcctgccctagcttcttgcatccaccttccttgacaggaactgaaaatgaattgcagctgttcatcatctctatggaggggaccaatttcttactcctaaactgagctcatcccagggaaaacacatagggcaatgaggaattcctcttaactatgacactaaactaccccttgtttttttttagtcgtttatattttcagtctacagtctaattatttctccaaattgggttacttgatcacctgccaaagacagtttctattcattaacaaatcttggccttcagaattatattttcaccaatctaattttcattggcattatgcttttctgttttctgactcctcttatcggttgtctacttgtatgcatttttcatgttcaaaagtttcatagcagctcctcctcactttgatgctagggaccaaccaatttatctctacttttatggcttgatattgccagctaatctttattgtgtaattactatagccagaaaaaatgttaagtgttttatatgttagcttaactgattctcactgcaatctatgaagcaggtactgttataatttctattttttagatgaacaactgagacacagtgaagctatgtaacctttctaagattacccaactagtaagtggtggagtcaacatctgagctttggttatctgagcccataaattgcccgttagccctgcgttatactatgatcatgcacaggggtctggaaaatgccttgatgttatactttccttcttcttttttttttttttttttttttttttttttgacagagtctcgcactgtcacctgggctggagtgcagtgacgcgatcttggctcactataacctccgcctcctgggttcacgtgattttcctgcctcagcctcccaagtagctgggattacaggcacctgccaccaaacctggctgattttttttttatttttagtagagacagggtttcactatgttggccagactggtctcgaactcctgacctcgtgatccgcccacctcagcctcccaaagtgctgggattacaggcatgagccaccgtgcccggtctatactttccctcttgaaacaccattcctttctttgttcaggatctactgtggcaagcatttgagctcaggtcatgggtctccaaagccattttacacaatgatacgtgtgatggttttctgggatggcccagctagcaggtgggggagggatcactgaggtaggggacagtgtaattgacaggcttcatagaagctaagcaagggacacatttagttcaagttcagtggcaaggggaaaaaaactaatgattgggagatgcttaggtgttttctagtagtgtacaacaactaaaacttatccccatagacaactcttgggtctgaagatacccagcaatacagagtatgtggtagaccctggagatcctgctgctcaccctgtgttccagattggccccaggtcataggaaggtccctggaagtccacagaaaggattctcaagttctggtagggggaaatttcaaatgtatgcaacccatagaaaatggattctttggggacacctacagaaatcaaagatctaggcagaatttgttcctaggatctaagaattgtagggttaataaaactagctgtttatagaaaatttatgtaacttgttttactgatccaggcagaatggatccagagtttgtgttctggcatacagactaaactttaggagggatataatgactgagttgaatcttgaaatgttagtaggaggtagacaatgcaggaagatggtaaaggttgatgttccaaaaatgaacaacttatttcctggtatcagttaggatgtgtttggttgccactgacagaaaaatctgactagcaatgggtaaaacaactctgagtttattttttcacttattaagaaatctggccctaacaatatcaactaatatcaaagttggtatctgtatttgatttgatttttcatgagcatctcatttggcagtcacagttttggacatttcactcaaatcaggaggaagggggatgagtggcattacctacacgcaatcctctttatcagaaaaggaaaagtttttttcaaaatacccagaaaatttccacttgttcaggctcaaataatgtagccatttctggttgcttttccagattctaaggactgtgtgttaagttaggttagccaactgacagtcttccatcacccctgccatcccggaagatttatgaattcagagttggtgtttgctctttgtttatttcttcttagtagagagcacagtgtcatgcccaaagaagggataacacaaaacattcattgcaagaataaataaattcagttaatctcaaaaggcatttattatgcagtgtgacctgcatgccaggaactgtataggtacagatcaaggaacatagagcccagggactggtgaacagatactcaacatatacatgttccaatatgccatggtacatgttaggacatagaaacacataggggcttttcaagggaacccagagtgggaacacacggcccatgttagagggctgaagaaggaggacaaaaagggagtcagtcaggatagtttcaattatgcttaggtaacaaatgatccctaaaccttaatgtgcagctacaactttcaactccctactgtgctatgtggccatgttgcttagctgtggctctgttccacttcagtctctgcctagggcccaagctgactgagcagcctctatctggaactctgtcagatggaccagagaatatagcaaccacacattggctcttagaagcatcttcctagaagtgacacacatcacttctgcttatgcttccttggccaaaacaagtcttgtgaatctaccagaattgaacaggatgaaggtatataatcctccatgtgaggggcacaggatagaggcacaggataggtgagcagtaatatcatctcctacaaacagcaaggacagggcctaactggcggtgctctctgctccttctggtttacctccccgtctttctcctttcactagtgaccagctgtcaacctcacttagtgtgggagagctgtgagctgggctgagtcgccggggatgagttggaggagccaggagactgacttcatctccacctggtccaggaagggagactgagggaaggggcctggatccagagctggaaagatcttggcaggatgtggctttttaggaggtagaaagatggatttcaccatctgtctctttcctaatgtttggaggggtgttctcccgggatatagaggctggtggcccagatttctgagacatctttgtcagccagcactggctcagcacatatcaattgtgaagatcaactcctggcaagtgtggagtttggcatctacaggggccagtaggggagtgaaccagggatagggacaatgaccagaatccttacttgttgtcagtggaaataaacacgcataaatttgtctttagcacacgaagacccaggataagacccgttcgacctgcctatatggagccttgggtgagagatcatcttagatttttctgccaccttaaggtatttcaaactcccttatcttaaccctgcctgccagctgtgtttgtggaccctgcattcaaatcctcctttaaaatgctatttggaaaataagctttaagatcaactgtttttaagatacaaactcaggcttctgtctgtaggcaccaaaaatcatgccctggacttctagcatcaaggtagttagaatacctgttaagaatacatggaattggccaggcacagtggctcatgcctgtaatcccaccactttgggaggccaaggcgggcagatcacaaggtcaggagtttgagaccagcctggccagtatggtgaaaccccgtctctactaaatacacaaaaattagccgggtgtgatgttgggcacctgtagtcccagctacttgggaggctgaggcaggagaattgcttcaacccgggaagcagaggttgcaatgagctgagattgcgccactgtgctccagcctagaggacagggtgagattccttctcaaaaaaaaaaaaaaaaaaaaaacatgaaatttagttttatttctggctctgaagctttcttggaccatcaggcactcattaacttctctgagtctcatttttcccatctgttgaatggagatgctgatcatagctctcctgcttaccttaaaggactactgggggaattcagtgagagcctttacttactgaacatctactgtaaagtagacattggctttaagacaagtgggaacacattgtcatttataagatttatgtaaagtaaataaaagaaatttttattgttgtagttattctattggagaaaattaaagttgggtatacaatcacggactgtacctgattaattcttgcatctgattcttatgcctctgtcttcagaatatttgtaataatctacaattgtccattttggactgtgaatcttttgaagttgaaattaccttttcttaggttggcagtgtttctcacctggattatggcagtatcctcttatcttgcctctctgccctcagtctcagctgctccaatccattctatgcatagcagacaactataaagatatttcacttctgctgaaaatccttccattgctttatgctcttctgagacatctacttttttagactctctttagagaatctttaaatcctagcctctgatagtttctccaggcatatctctcaacacatctcttcctaccccactaatacagtcatgtgcattcccacagagaagcccaaaatcaatattggagtctctctgaaatacctgaatccttaatgaggtcccagcaccttggacctttgcatagttttggctagaacatctttgttcctgtgacttcccacttaggttcaactccaaaatatctctcagatttcaacttgaaagtcccttcacttcctctggggaatcttgcatgatattccttttttttctttttccttcctagctcattatcaaacctgacatctagtaattgtagttgctattaggcagtgtctgtttcatttttaggtggttactagactttgagctctttgaagacagggattgagtctcactcatattctcttttcttgaattctttcctttcttccataaatagtacgtgattttccactttgggccaggcacagtattcttaacgtgctcatatcttcatgcctaatatggtgcctggtacaaagcaagcaataaacatgaatgatggaatgagtcaaccagtgaatcaaaggtttagttcaaacaagttaagccctccctatggtctaggagcttcgagaggatcaacaccttttctaacttttgctttttaccatattctagttccttttttgtttcaccctctgacagagagaagctgagtgggaacaggctgccacatttttgtaggatatatcatccaactggtgaatcacccaggcccttgatttggcttactatttaacttttttttttttcttttttttttttagatgggctgtcactctgtcaacctaggctagagtgcagtggtgcaactttggcctgctgcagcttcaacctcatgtgctcaagcaatcctgctacctcagcctccagagtatgggactacaggtacagtccagcatggcaggataatttttatatattttgtagagacggggtctgtctttgttttccaggctggtctcgaattactgggttcaagcaatcctccggcctcagcctccaaaagtgctgggattataggcatgaaccaccatgctcggcctatttgaccattttaatgttcttattaacttgctctcctgggtggtaggaagatcatggcatggagtccaaggttctctcacttgcaagtgtcctttgtgcacttcgctgagtgtccttgtcctcatctgtaaaaaggagatggtgatatttagtcttgtgagaaactacttgagagaagtattataagtacctggttacttgatgtagtccttggcaaagggtggattctccaaaattatatcttcctatttctttcattcaacacccactcagccaggataagaccataccagagcaaggagggggactataaataacagcaaaaggacaatatctgcagagaaagtagggagctggaacactgactaaaggaaagttttcatattaccctgtgaattgttggacaaatcattcattgttttttgtttgtctgtttgttttttgagacagagcctcactctgtcatccaggctggagtgtgcagtggcacaacttcggctcactgcaacctctgcctcccaggttcaagtgattctcctgcctcagcctcccaagtagctgggattacaggcatgcgccaccacgctcggctaatttttttttaattttttttttttgagacggagtcttgctctgtcgcccagcctggagtgcagtggtgtgatctcagctcattgcaacctctgcctccctggttgaagcgattttcctgcctcagcctcctgagtaaactgggattacaggcatgttccaccacacccagctaatttttgtatttttagtggagacggggtttcaccatgttggccaggctggtcttgaactcctgacctcaaatgatccacccacctcagctgcccaaagtgctgggattataggcgtgagccactgcgcctggcctggctcattgtttttatatataaaacttacatattttctttcctatgggagtgttgtgattactaaatgagagaatgaatgcgtagtcattcttcaagggattgtcacacagggaagcttcaatatgtttgggtaacagtaatattatatgatccattttcatttctatcaatttggtcagctaaactgtactttaattctgagattctttaactccgacagctggtccagactggcataggtcctgggggcaatgacagagtccagatgtccccatgggcatgacttgcaaattatgtactttgacagaatatggtgaggacaagaaccagaccatgcagcactattttcacgccagctgcagagtctaaatgtgtttcctgacacctcagaaccttcttgggggagggcattctgggctgggtgatgggacatgctgggattttgttgctctccttcccttgtgggtcttaatggaaaagctaagtcaccagcaacagagaaatagcggtgtcaggcattgttgaaactttccatgtattctcatgacacatcatttccagttataaaaaagagtggaggtgttgggctctgttgcctaatcgtggtaagaagtcccttttactagaatgcattttttcatcacagcatcatggtcaatgatcaaccatgtgaacttgtgtaagttgcataaacttttcagtatcttgacgtctctgtgggaaaagatggaggccatatgtgggagaacaaaatcatgattagagacatgggagagaatagggcttcagagtgcagctccacttcagaccagtgcatggcatagtacacattgcctgaactctctgagactcagttttctctcctgctaaatggaagtgatagttggtccattttatggagccgatgtaaggactaaaagttataatgcatataatgtcctttgtctggcacacattaaaggatcaacccacttctgctaccattattattaggaacaaatacttactaagaacctaccatattcaatatcacctgagtgcattttcatattcaattctcacaatgacacaaggagatattatcctaatgttgactgtgaaaaaaattagacctggagggttcaagtcacttgcccagattcacatgggtgtgagtggcagagttggaacttaaaccaagaatttttgataccaaaacctattgatgatctttccactgaaagatactgactagatgtcaccttgctttccctgtcaaatgctaatcagagatcaatgactaatcaaatggaactaattaattctgagtcaacaaatatttatagagcccctggtatttgccgagtgccatggagatgagagctaccatggacaaaaggatggtcacccaatcctcggtggtacaggacttctgtaaatgccccaggaggtcttccctttttcccaggttgatgccttctgaatcacttctgtccattcactgctttgtcagcagcagtttacttgactgttaccttgggtaattccttgagcttatttatttactatttttgagatggagtctgactctgttgcccaggctggggtgcaatggtgcaatcttggttcactgcaacctccacctcccgggttcaagcgattcttctgcctcagcctcctgagtatctgggattacaggcatttgccaccatgcccagctaatttttgtatttttagtagagatgaggtttcaccatgttggccaggctggtctcaaattcctgacctcaagtgatccacccacctcagccttccaaagtggtggcattacagatgtgaaccaccatgcctggcctccttgagcttcttgagagcaggcactggatctttcttctttgctactttctctgcaacacactgcctggtacatactaaatgccaaaatcttattgacaggcttgcagcgaggaatgagcatctaccttgctggttagattgcttttatccagagtggtgatccctggggagatgttttgcacttggcctcgtggcagatgggtaacaagtgctggatcccagaggaatgatgcattcaacaagtcctgagttttatctatagtgccatgcagtgagttcctcctgctcctactgccatgggccttgggatgcaccttgagcactgaccccaccttgtcatgcttcctatgtgataagtttccttctgcagccagatagctctttgactcaatattacatcagtattataaactgagtaattgtgttttccttcctccaatcaacatgttgaagtcctccttcccaatgtgatggtattaggaggtggggcctttgaaaggtaattaggattaaatgaggtaatcagggtgaaacccttatgaatagaattagtgtccttataagagtcatgagaaagcttgttttcacttctgccatgtgaggacacagagagaagatgatcctctgtgaaccaggaagagagggccttcatgaaattctagatcttggagtttttgatcttagacttctctgaccccagactataagaaataagtattttttgtttaagccaccagtttatggtatttttgttatagcagcccaaatggactaagacactcagaaaccttcctgtggcctcctggaagacctttactatcctgcaatttctccagggctgtcagaaatttagacttcagtgtggttccagaactagtgtgcagaaatataaggcaaagctcataaccatcctccagtgttcaggctcagcataagccctctaggaaacctttgtacctttctttgggcctcccccaccatagccctcatcatgctatgattaattgctcaattatctttctctctacattgtcggttatttttagctttaattagtttgccagataaatgtatcagctacaagcccttagaggacttagaagtctggaaactttggagaaactgtttataggactggcagtttctgatggagaacataggaagtagaaagaaaatatctgggtagtctttggatattccccagtgagggtctctgagactgatatgattgagcagctttatgaataagacccaagaggaaaggctggagaaaatgagtaaaacaaagggaaattttacgtacgtttttttgcccatgagctagtcatgaaagggagaatcaaatgtgatctcatcaaagatgttcccccttgagatcataactatatatatatatatatatattttttgagacagcctctctgtcacccaggttggagtgcagtggcatgatgtcggctccctgcaacctttgcctcctgggttcaagcgattcttgtgctttagcactgagtagctgggattacaggtatgagccaccacacccagcccataatcatatattcttaagtgggtgtgtgtgcataggtatgtgtgcatgtgttttgcttttcaacctaaaagcgatcatacaatatgtcaacagccttgtgtgttaagcacaacagagttcctctcattcgtaaatgaagagtctgaggcttgagacttggtttgcccaagtccagtagcattaatacaggcagccaggtcttcagatagctgcccaattcccttttcgcatctcaaatatgtgaggtcttcagacaccttggagataatatttgctctcacctctttcctcaaagaattaaatgtgacttgccatcttgagttttgttacaaaagattgtaatgctattcaatagtggtatcatatgttatttaccatggaaaaagatggcaaaaactccccctgaggaactgcactaaaagtaaaagatcaagaccaagggaagagaaaatacaaatattcgaaccctatgtatctaacatgattaatatatccgagatacatatgcggctctggttaccagaagccaaagaagaaaagggaagaagattcatttatttgtccttaggaaaatagcagttccccagtcaaagaaatattttgcaagcacttagatctcagagaggtcatttaaaaggcctttagcatttattcaacaaatacttatttactagctactatgtaccaggcaccatgctaagatatgaatatacataatgaagaaacaatgtccttgtttctgtgaagccaagtctagtgagggagaaagatgttaaaattatactcttctatatattatgatatggtcagtgatatcttttggctctgcgtccccacccaaatcccaccttgaattgaaataatccccacatgtcaagggcaaggccagctggaagcaattggatcttggggcagtttcccttatgctgttcttgtgataatgagtgagtgtcacaagatctgatggtttcataagtgtctggcatttcccctgcttgcactcattttctttcctgctggcctgtgaagcagtgccttccaccataattgtaagtttcctgagacctccccagacatgtggaactgtgagtcaattaaacctcttttctttataaattacccagtctccagtatttcttcatagcactgtgagaacagactaatacagtcagtaatggaaaagagtaagatgatgggagagaatttgaaaggatttggtttagctagaagatagctcttgttaaagtgatactatagctgagattgaaagctaactaggttttaaaaatttggagcattaagaagaatagtgttcagcaagaacagcagatgtgaaggtcccaagtcaagtacaagactgatgtattccagaaacttttaaggacagtgtgttagtgtgaatttcagaggccaaggaggagaatagtctgggatgagccctgagagtagcaggagcccagtccccttccctgcagagctttgctaatgttggtgagatgtggtctggagagagacattaaaactactgaaggatttcaagagagaaagtggctgtcagatttgcatttaagactattgctctggctattggaaatgatagcaagaaaagtgggtgaaaacaagagtgcaagtctggaaactagaaggaggttatggaagaggcacctttgccagagattagggtgatctggaaatacgatagaaaatagacattctaggacgggcacagtggctcacgcctgtaatcccagcactttgggagaccgaggtgggtggatcacgaggtcaggagatcgagatcatcctggctaacacggtgaaaccccgtctctactaaaaataccaaaattagccgggcgtggtggcgggcgcctgtagtcccagccacttgggaggctgaggcaggagaatggcaggtgaacccaggaggcagagcttgcagtgagccgagatcgcaccactgcattccagcctgggtgcagagcaagactccatctctaaaaaaaaaaaaaaagaaaaaagaaaagaaaatagacattctagagttaaaaactcaacaagcttgatgcaaccatcttgtttcaggggaaggcaattactgcacagagaataatcatggacaatgcccctcaaacctccacatccccaaaatcaggacatatagaaggttggagcaaaaatataaccttggctaaaataattaatagtgttcttcttgattcaatttgcaggagacattcagagaaaatatccacactcaaaactgaaatatgagtgccacacagtcattgcagctcacatctgggaattttcaccaagcaactgaaaaaaaggctattttcagttctttcatatgctctttttgtcataagttgggttcggggggtggggttcagaaccacagttgctgtggtgagagaagcaaatttgacagcttctggcagagcaaagcacaagtatttcctgcagagtttttcaaagtaaatgggtctccctccctgggcagatactggcaatccttgatgactcacttctgaggggcttagcccatcaaggattcaaagagagggagaggcctggcaccaggcccagtgctggtgacaaagtggcttcttgcctgcttttttgtagttgctccagtgggcacatctgtgcccggaatttgtcatgagacaatgagggtttgttccctgtatccgaaatgatgacttcatgattcttttatggcagagtaagagttggagcagaggagatagaggattaatggagttaaaggagcatattacaaagattgagtttcatattggttaagatctggaatgctttctatctggcaaactgtaaaatccaaagcattaattacattgacaataaggacccaagtgtcctcccatttagctgttttcaaaaggtattatgagtatccaagctgtcagggtgatgtgtgtagactttttttcctttcctgtgtcaaaagcatgatgttgagcagtggcttttaacatttttgacaataacccatagtcagaagtaccttttttttttattgtgactctcaacacacacatgtagtggaaaaagtttaataaaaaataccactgcaataagtaacacacacagtttctatgatattttacttattaaattatttcctgtgtaaaaatgtgcctgtgacccagtagattgttttcatgactctctaacaggttgtgacctgcaattggaagacatagatattgaggaaagaacacaggtcttggctgttgaggctcatgacctacctccccagctgtaggagatttttctgtgctttagtatatgagtaagcatgagagaggtgatgcttcagtaatacacactcccaacatttcagtggcttaaaacaacaaaagtttatttcacactcatgctataatggaggcttgactccatatgatgcagagatccaggctgcaggagccttcacatcaaccctactttctcctcatctgctgcaagagcaattttacttctagctctgactcttttttttttttttgctgtatggagctgggcaagtcatagaaccagggctgactttatgtgcatgtgacttaggcagttgtatagggcctggtgctcagaagggccttgtggcttggcttactactctgctgtcactgccttgaaagtcttaataattttttaacaagaaggctctttttgcaccaggccacacaaattatgtaggtcatttgcatacaatcttttctaagtctccatttcctcatctgtaaaatgggttaatagagaagaactcatagcattcttaagaggactaaaagaaagagcatagtacatacacatgtagttttcaacttgctgcctttatcttcagtagtaccgctacagaaaacttttacttaatcaagttagacttctcaccttgaaaagctgtacttccttatgttgccctccctactcccttctgtttatctaaattttgttcattattcagggctctactctaacacctcctcagggtcctcttccatgactgtccaagctgttttcagaacccctaccccattaattgtggatcccttctttatgactcacttacttttgtttcctcttctcctttggacccttccttggttaggatccctcctacctcgcctggaacattaaacagcctccccattagtaacccttttagtagcccctctccagtttgccctccagttccactctccatcataccagggtcatcttcctgttaccccgaaatgtcttttctatcatgccatttcagttttcagagacttcagtggctcttctcacctaaagggcactgcccttagtcttgcatttaggatctggctctcaggccacattttgggtctcattttcctccactccactcacacactgctcctgcattcctgctctacaccatctctggaatagagcttattctcctgcctttggttctttgtacattctcttccttctactaagatggcctgccaccataggcgtggtggctcatgtctgtaatccaatcactttgggaggctgaggcaggtggatcacctgaggtcaggagttcgagaccagcctggccaatatggcgaaaccctgtctctactaaaaacacaaaaattagctcggtgtggtggctcgcgcctatagttccagctactcaggaggctgaggcaggagaatcacttggacctgggaggtggaggttgccgtgagccgagattatgccactgcactccagcccgggcaacagagggagactccatctcaaatataaataaataaataaaatggcctgccccaagatttaccccacacccctgaaataatccaatctaccttttactgcttggctgaaatcctatctcctcaaagacctcctgtgccagctcaggatgaaaagtctcccttattccttggaatccctatggcatttcttagaatctgacatatatcctgtatgtgtggggcaattcccccaacatcttggttgccttttctgctgggtctgtgttccagggaataaggacaaaaacaaaatatggctagagtttcagtcacacttcgtaggaactccctggaatgaagggttcctgcagagattgcctggggcccttcccgatcccctcagctgttctgaatcatcatcctcctctgggttctccaggaattttgtacattcttctaacatagcactgactactttccatttgagttatttcttgacatgactggatcccccacgaggcatatcttattcattattgcagttctaacagggactggtgtcaacagtgaatggatggattgattgaaggatagagactagagaggaaggaaagttgctggggaggagattccctgtatatgtaagtgtgagacaaggtgggctgtaataacaacctcttactggcacaaagcaacaaatatgtatttctcattcatattcatgtccactgtgagttggccaaaattctactccactgcctttttttttttttttttttggagacagggtttgttcttttttatagcctggagcatagtgacatgatcacagctcactgcagccttgagctcccatactcaaacaatccacctcagcctcccaagtagttgggaccacaggcctgtaccaccatgcctggctacattttaagattgttttgtggagacagggtctctcactatgttgcttaggctggtctagaactcctgggctcaagtgatcctctcgcctcagcctcccaaagtattgggattacaggtgtgagccactgcgcctgtattccctcttcatcctacaaccaagcctgatggagaatccctaatctggggcatgccattcagtggcagaaggaaaggaaagatggcagagacacacaatggctctcagagcatctgtgaagaaatggctcatgtcatttcaactgacatcttgttgaccaaagcaagtcttgtggccacaggaaggataacactctcaaagggatgagcacaggagaaagaggcagtgagtattttgacaaggacacaatcttctacagtgggggcagagcttcatgtggaattccactcacataatgctctttgtctgtctgcatacccacactcgttctgaccagggaagaaggagggggccatctacttggtgattccaggagctggatgtgcagggcgttgcatctgtctctcctcttgctattgagcataagctgcctctagcgggcatgctttctaccttgccctctcagggattgagggatagactctctggatatatggttgtctacaacttggtaggtaggtctgtctaatcctggagctccatttattcatccgcagagccatatcctccaatttgagatctacaagtaacaacggtggttttgattcccgccattgcctttactcctctgccttaattttcaattggtttcaagcttggaaaagaaagagagttcaattttttgatctctctctcatatctccataacagactttgcagaaatatcaggtcaggtcctgttactgatgtgttcattctcatgggcaggaagagacacttcagtgttgctgctgccaggattgtttcacttaaaggaactctctagctgtcagagaaagagtgatactctgaaaatagtctctaacatgctgcttcctgctctaggatcatcttatagaaaagacactatgttcatcctgagccaacctggtccctttatagtcagatactagagaacaatgagaaatggacatgggggatatctttagcgaacatccttagtgaggatctgtctcttcttttcctgttgggcatgagctgcttctagagagcatgctttctacattgccacccaccccaccccaccctgagggatccaggaatagactctccaaatccagggatgtgtacaacttggtaggtaggttgggtagggagagtgttttgcacaagctagagctggggttcatatgtgtctggcaagtggagttaatggtactgttttctatcaagtgtccagttgcataagttgttatacaaagacggtgctttagcttttaactggaggaagagggggacatactgacatgtgggacagagggtagagaaggaagaggtaaaattgagagggaataacgtgattaatttccactcagcctggcccgatgagagactgtgagggtgctatctaaagcttaaggaatcatgtttatgaaaaaactgtaagattttgggaagcagcagcgctctttggagattggcaacaaatatgacaatttactcaaaagatttttatttctggtggttctagactgagtgacagcattggacaaagatgtgtggagcaggatggtagctggaggagtgccagagagagacccgggatctcaccaaggttacagtgtctgtggctttgcgaagattcctcctaaaattctgctcatggaaggatttcaaagaaagactgagtgaacttgttcctgagaatgcttgaagggacggggaaacattaaaaaataaagactgggttattggaaattgatggtggtgttggtgggggttgttaagaactaccgttatttacacactgatgaacttgtgacctcatctatattcacaggctgctggtctctgagctattgagtccacctacttatagggatgttctttatattggggtgaatgttttgcttgtgatatatcactctgtattagtttcctattgctgatttaacaaattagcacaaacttagtgacctcaaacacacacacacatacacacaaactcacacacacatttattatcttacaattctggcagtcagaagtcctaagtcagcctcacgggctaaaattaaggtgtcagcaagctatgttccttttggaggctctagaggagagtttttttgcttgtttgtttgtttgtttgttttacgttttctagattctgtgactgcctgctgtccttggctcatggccttttcctcattatcaaagacgacagtacagtatctttcagcctttctcctaactctgatcctcttgactccatttcataaaagccatttatctcaatatcttcatctcaatatccttaacttaatcacatctgcaaaggtttttttttttttttttttttttttttttttttaacatataaggtaacgtctcccggggagcattattcagcctgctatattctccaaatagttttcattggctttggtttcatcttatcaagaggagatcaattcaacctttactttgtacccattgagtgccttttgtctgctagaaatttttcaggctttatttcaatcaacccccactgtgattctgcgaagtaggtatttatgtgcattctatgaatgaggaaacagggttgcatgcaaattgatctggcttaaaaactcactctttctttacaactttaaatatttcatctccagaactactatattgtcatgattgaaatgactggatgagaaatactcagaaatttcaagtccctgctcccctggtggctacagaagtacagttgagaggcctttcagtatttcttaatagacagccaccttccctctgcctggagtagatgagattcctgactcctgtctttcttctgagactctgcccaggataccctagttttgcggaactgacacacccaaatgtcctgaatgagtcataaactcttcccgaagctaacatgtgatgaggagggaaggctctttctgccacagcctgtgaaatggtttccattacagtgtttctgctgagagcagcaattctgtctttatcctctttcccatgactacagagcctccaacatctgactgagttgacagaagagtgagggggacactggaaaaagtcccaggctggaggccaggggacctggaggccgatattgtcattgcctctgactagtcctatgctcttgagcaagctgctccagtgtctgagtctctggtctcatttggactaaaagtcttggtccttctttgtgcttacaatttaaaggatccctgcatagccaaacggtaccattcttaatggcatgaacaatatcagaaagactttagataacattcatttggagataactttgccatgtgcttcactccctctcaaccggcaatatggcagagtggttaagagtgtagaatctgcattaaaattccagttctgccttttttgactggtttatcttgggcaagccgcttagcccctgtgtcttatattcttcatctatccaatggggataatgataaagatgatgttctcccccgagggttttgatgactgctagttagaccagcactgaccactgttcagtccaatgaaagtacttgtctcatgccctgctattcattcttcctcaatctcccgtagagaaagagacttcagctttaaactcagagtctttataataggccatcagctgtgtgaccttaggcaactcaattcaactctctgatcttcaggatttttcaactttaaaataaggataacaataagagcaacttcatggtgaagggggataaggattaataaaacaacacatgtaatatttctaggagaatgcctggcatatggaaaatgtttgctccctttagatgttatcctcgtcttgtgtgaatcttaaaatttctagcctgcttcagatttaattccattttctttctaagatgtgagaaaacataatttgatatttcaggccaagttaagcttttttattgagctcacacagttgtaaatatgtacattaaagtatgtcctcatgaagaacaaagggcatggatttttccagcaccctccatcccccaactcacagcctcaacatccgcaaataattaatgcatagaggaagtttacggttggccacccaaatgcatctcaaacattaaatttaaaaaactaaaaggatgaacccagaaaactgctataaacttcaaagaatctattaaggacttagacatatggtgttaaaagatatgtccaagatttatggcactgggcctacaaaaaagaattctggataggcttctgctatgtgaaatatcaggaaagggtcagcagaggtgagctctgtgtccccaactgcctggagtgacctcacgagcagaatcagatagcagtggacttagctcagttcttggctcctccagatgcaagccaaacttcaatgcttagggcagcgagaatgtactggacagagagccgctaaagataggagaagatagatcagatatgttttgcatttaggtcctttcttttttttttctacctggaacacaggcagtgataattatggccactaaccatattgagcaattgagcaattgcaatgtgttagatggttttacattgaatttaatttatacctcataacaaactgtaaagaatgtactaccgttttcttcttctagaggggaagaaactgaggctcaacaagtttaagaaagtttctgggagacatatagcacacaaacataaaaccagaatttgaatacacatctatttcatgatggactacttttgtggaactgttaaaggaaacaagtaatggccgaaatgaatggtttagtcattgatctgcttgaaggctgagcagcagatcaaatggcctcttggacacccaagattttgggagtctaagactctgcctttctgaattgcataccttatatgtctacatgagtccttccaaataagctgctcagcacccctggtccatagatcctttgtaattattgcctcctctcaaaagcacaacattgattttatccacctggaagttactgtctgcctgcttttagatagagagcaaatctcctctttgaacaaattcatacaaaactctcactatagtcgggacccaggatatgttttaaaattgattagaagtgttccttgagcttttatttcccttctgtttgtggaggaaggaacagaaatatttccaacttaccttatacaataatgactgttacaggtatgacctcagacccagagtttggggatggaattttctgcctttgatcttggtttgtactgtctctaagatgtgacatctcttctacactgttgccacccagcatccatctgtcatattccaaactgccaatgtgtgtcacccaaaacattagatgacctagttgttctccctgcctagagccttgcctcctctaattcacttcatttaaaaagaaagacatttatcttataaaagaatacaagcatacggaaaagtacctaataatatagtaaataactgtattgcctactgttagcaacttttaaattacatatagatgcatcaataaaggcaatatatagtattgttgtaaacacatttaaacctggtttaaattttatcacattacacaaaccattaagtgagtttctttttaaaaactcaacatcatgttttaagaattagctctgttaatatatgtagatagtttattcatttttaactgctctatggagtacctttgtgtgaatattccacaattgaattaatccactctcttactggtatgcattatttgttgttataaacaacactgcaataagcatccttgtacacatttctttgtgcatatttgcacaagtaactgtggagtacatacctagatatagaatttccagacacataatattgtcatatttatatttactaaagaatatcaaatttactttctcaacagcgttgaatgagtttccattgccctacattcttaccaataattggtattgtcagatatttgacaatcttatgggtttgacaaagggtttcgtttcctaactttgtgtttgttagtgaggaaaattaattcacatttatttattagattttaattcaaatttattagtgagaataattatcttttgtatgcatattggctactgggattttctctctcgtgatttgcctgtttgtgtcattgtgattttttttgtcttgaatttttaatatttaatctgttgatttgtagaaatttttatccctgcatggtatgtgtactaattttgacacaaaacttgcaaataacttcttcaagtctgtggtttattgtttacatctttttggagatatatttatcatttacaagatttttagctttaccatagtcaaatttataaaattttgaatgtttttatggtttgagctttgatgtctgactcaataaatccttgcttctgacagtcaagaagttatttttcatttatttatcatttatttcatctatttatcattttataagttttaaagttttactttttgtattgtgatcctcagtgtatctggaatttattttgatctaaggcagtcttctaattttgttttgtttccatatggaaacccaattgcctttgtaccaattattgaatagtctaacatttctctatttttttatagcagcatctctgataatgccaattttttcattcatgtccctgtgaagagaccaccaaacaggctttgtgtgagcaataaagctgtttatttcacctgggtgcaggtggcctgagtctgaaaagagagtcagtgaagggaaataagggtggggccgttttataggatttgggtagataaaggaaaattacagtcaaaggggggttgttctctggtgggcagagtgggggtcacaaggtgctcagtaggggagcttttgagccaggatgagccaggagaaggaatttcacaagacaatgtcatcagttaaggcaggaacaggccattttcacttcttttgtggtagaatgtcatcagttaaggcaggaaccagccatctggatgtgtacatgaaggtcacaggggatatgatggcttagcttgggctcagaggcctgacattcctgtcttcttatattaataagacaaataaaatgaaatagtggtaaagtgttgagatggtgaaaatttttgggggtggtatggagagataatgggcgatgtttctcagggctgcttcgagcgggattaggggcggcgcgggaacctagagtgggagagattcagctgaaggaagattttgtggtaaggggtgatattgtggggttgttagaagaaacatttgtcctgtagaattattggtgatggcctggatatggttttgtatgaattgaaaaactaaatggaataagagaaggagaaaaacaggtataaaaggtctaagaattgggaggacctaggacatctgattagagagtgcttaaggagattcagcatagtcctgccagcaaagattatttatttacttcaagagtttagagtggcagtttggggatagcactaggagatatcagctgtgatggcttggagaaacagtgtaaactggcagtgtaaacaagagcagggcatgtatgagtagttgagaacagtgaataggaatgactagacagaagatagtagggatgacaagttttttggggcacagtccaagttggtctggtgtctggaatgagactggggcctaataaaaatgagcgtctatacaggagcttaaatgggatgtaccttgtagcattctgaggacaggcctgaattctgagaagggaaagtggtaaaagtattatctagtcctttttaagttggtggctgagcttggtgaggtgtgttttaaaagactattagtccgttctacttttcctgaagactgaggactgtaagggatataaaggtttcactggatattaagagcctgaaaaaatgcttggctgatttgactaacaaaggccagtcttctatcggactgtgtagaagtgggaaggccaaactgaggaattatgtctgacagcagggaagaaatgaccgtggtggccttcttacaccttgtgggaaaggcctctacctatctagtgaaagtgtgtacctagaccaagaggtattttagtttcctgactcagggcatgttgagtaaagtcaatttgctagtcctgggcaggggcaaacccttgagtttgatgtgtagggaagggagggggcctgaataatccttgagaagtagtagaatagcagatggagcactgagaagttatttctttgaggatagatttccacgatggaaaggaaatcagaggttctaagaggcgggctagtggcttgtactatagcatagcctgcctttgctggtgtgtggtgattaggcctggtggaactgccatcaataaactaagtgtgatcagggtgaggcacaggaaagaaggaaatatggggaaatggggtgaatgtcaggtggatcagagggatacagtcatgggggtcaggtgtggtatcaggtataatgtgggaggccagattgaagtccgggccaggaacaatgataattgtgggacttaacaaagagtgagtacagctgaaggatccggggagcagaaagtatatgcatcagctatgaggaagaaaatagattttggaagttatgagaaatgtagagagtgagttgagcatagtttgtgattttgagggcctctaaaagtattagggcagcagcagccgctgcacggagacatgatggctaggctaaaacagtaaggtcaagttgtttggacagaaaggctacagggtgcggtcctggctcttgtgtaagaattctgaccgcactaaccatgcctaggaaggaaaggagttgttgttttataagggattgaggtttgggagattaattggcacaatcagcagggagagcacgtgtgtttttatgagaattatgccgagataggtaacagatgaggatgaaatttgggcttgactgaagtaatgggggctgtctgtgaagccttgtggcagtacagcccaggtaatttgctgagcctaatgggtgtcagggtcagcctaagtgaaagcaaagagaggctgggatgaagggtgcaaaggaatagtaaagaaagcatgtttgagatctagaacagaataatgggttgtagagggaggtattgaggataagagagtatatgggtttggcaccatggggtggataggcaaaacaatttggttgataaggcacagattctgaactaacctgtaagccttgtctggttttaggacaggtaaaatgggggaatggcaagaagagtttataggctttaaaaggccatgctgtaacaggtaagtgataacaggctttaatcttttcaaagcatgctgtgggatgggatattgggattgagcggggtaagagtgattaggttttaatgggatggtaaggggtgcatgatcggtcactaaggagggagtagaggtgtcttatacttgtgggttaaggtggggagatataaggggaggatgtgaaggaggctttgaactgggagaaaaggcagcaatgaggtgtggctgtagcctaggaatagtcagggaagcagataatttagttaaagtgtctcggcctaataagggaactgggcaggtggggataactaaaaaggagtgcttaaaagagtattgtctaagttggcactagatttggggagttttaagaggtttagaagcctggctgtcaatacgcacaacagttatggaagcaagggaaacaggcctttgaaaataaggtaatgtggagtgagtagcttccgtattgattaagaaggggacggacttaccttctactgtgagagttacttagagcatctgtgatggtcctgtaggcttctgaggcgatcaggcagtgtcagtcttcagctgctaagctgagaagatctgggaaggagtcagtcagagagccttgggccacagttccaggggctctggaagtggctgccaggtgagttgaacagtctaattttcagtggggtcctgcacagatgggacatggcttaggaggaatcttgggctgtgggccttccttggcctagtggctagatttccggcacttgtagcaagctcctgggggaggaggttctggaggaacccctggcagctgtggttcaggtatttggagttcttgttgtgctggagatgtggctggggtttgtctcaccgtggaggcaaataattgcaacttagaaatacgttgctacttggctgcctctactctattattgtacaccttgaaggtgaggttaattaagtcctgttgtggggtttgagggccagaatttaatttttggagttttatttaatgtcgggagcagattgggtaataaaatgtatattgagaataagacggccttttgaccttttagggtctagggctgtaaagcgtctcagggttgctgccgaataagccatgaactgggctgggtttttcatatttgatgaaacagcctaaatgctcactgatttgggagaggtctgataaagaaaaaggagcattaactttgactatgcctttagctttagccacctttttaagaggaaattgctgggcaggtaggggagggctactcacggaattaaactgtaaactggaccgggtgtgaggagaggaggtgataaaaagattacagggtggaggactggaggctggggaagaattgggacctagcttggcctggcgaggagcagcctggggaggaggggagaggtcagatgggtctgtagaaaaggaagattagaaagactcagcgacgcttggggttgggacagaggggacaggcgggagggaaagaaggaagatttgggatgagttgcactgggcacagagactaggaagggactgatgtgtaaaagaatgcctggacgtcaggcacctcagaccgtttgcctattttaccacaagaattctttagatcttgcaggatggaaaaattgaaagtgccgttttctggctatttggaactactgtgagtttgtattggggtcaagcagcattgcagaagaaaataagacgcttagattttaggtcaggtgagagctgaataggttttaagttcttaagaacacaggctaagggagaaggaggaggaatggagggtggaagtttgcctatagtgaaggaggcaagcctagaaaaaagagagagtagagacacagagggaaggggtttgggagttcttaccttccagaaaagcagaaaaggggtcaaggcacagaaataaggggttggggcacggagataagaggtcggggtgtggaaataagggatgggggcacagagataagaggtcggggtacttgcccctcctttagaaaagcgggacttgccgctaagggtgaaagagaaggggttgaggggttcttgcctctccttcagaaaagcagagaaggggtagagacacggagagaaggggttggggtacttgcccctccccaagaaaagcaggacttgctgctaagggtgaaggaccaaggcaggcatccttgcatggtatgacacctctgaaacatgagtgaataatcagaggtgtccctgcaatgattaaacaccaagggaaggctgccttcccagtctgtgacaggcgctggagttttgggtccacggataaaatgtctcctttgtctctaccagaaaatgaaaggaattgaaattaagagaagggagaggttgaagtgtggcgccaagattgaaaggagaacgaggttgagggatagtgagggaggttgaagaagagagtaaaaataggctgcttactggatttgaaattggtgagatgtttcttgggctggtcggtctgaggacctgaggtcataggtggacctttctcatggagcaaagagcaggaggacaggggattgatctcccaagggaggtaccctgatccgagtcatggcaccaaatttcacttgcatccatggaagagaccaccaaacaggctttgtgtgagcaataaagctgtttatttcacctgggtgcagctgggctgagtccgaaaagagggtcagccaagggagataagggtggggacgttttataggatttgggtaaataaaggaaaattacagtcaaagcggggttgttctctggtggccagagtgggggtcacaagatactcagtaggggagctttccagccaggatgagccaggagaaggaatttcacaagacaatgtcatcagttaaggcaggaacaggccattttcacttcttttgtggtggaatgtcatcatttaaggcaggaaccaaccatctggatgtgtacatgaaagtcacagtggatatgatggcttagcttgggctcagaggcctgacaaattttccatggatttgtttcaaggtgcttgactgtattgtattgatctgtttgtctcttctttatataaataacattgtgttacatacagtgttagaataacgcttgtatgtggtcttgtatgctttattcccttccttcaaagctttatttctttattctttcttatgaagagtataaatactggctggtccattttaatgaaaaccttattataattaactaaaattgcaacaaatatgtagattattttggtggcagaacaggaacctctttaataataagtcttctgttccataaatgtttattcaggctttcttctatgtctttaaagagattcttaaaattttcttctaaaagtttatttatttttttgctagaattattcataggagcctgaagtttttcttgctattgtaaaagtatcttcaatttccattacactttataattggtatggctgaattctagaatgaaaataaatttgcgttgatctaataacttgctgaattctgttatcttttgtaatattttatccgtatttttttaagagtttctaatcatattgtttgcaagtgaatgtcattgtatctctttttatctatttaaaaaatattgtgtttatttttcttattgcattggccagggcttatgtacaattttgaatggtaggagtgatagcgggcatttttggctttttccagattttcaagggaatgtttctaatgttccatcattatagaggccacatagcacactggttaaaaatgcaagatcaaggaggtttgaatttaggctctgtcagttaaaagttgtgtgatttgggccagataacttaacccctctgtgttcgtgtttttccattagtgaaatgaaaataaacaaaagcaacaacaacaataatatttatatcagaagaatgttgtgaggattaaacatatatgtgtgtatatatacacatacatatattaatatatgtatgtatgtatgcatatatatttgtgtacttagaacagtgcctagtacaaatttaatgctcaataagtatttaataatgataaaaagtgatatttactgaatactttttataaagattccttatatgtttgaggaaatttcttcatattcctacttttcctaaagttgtctttatagttgagagttaaattgtatcaaatgcttcttcttcacctaataagataaatgatatgcttttttgttagtgttctaaaatggtggttaattttaacagattttctgccactgaactatatttgcattcttgggctatcattcattgttactgttgatgttattggtacactatatatttgaaattattattttgctttccatttataagtgagattgggcttttttttatttttgtactgcctttttacattttgaacaagaaaaggattgtttgttctttggtgattagtaaaatgtgactgtatgaatttatctgggtattgtttctttttggtatgaaaactgcttatcaattaaaattatctgatatctaattttgtgtaggatttttgtttgtattgatgtcaatattgattgtttctatggtttccataaagtattttatttatgctacattttcaagtttgcatatttggaaaagctatgaaatctacaaattgaaaaatctacaaaaaatagcatgaaagttggtttaatttataatgatttaaaaaattctctactatagccctaattgtggtcccactttgttactatagtttaatttgtgatctctttttttttttgtttttgtttaataatctcttttgcttctttgttttcttgtacattaatatcagttgtttacctgtttctgtcagaggcatttgaaccagaacgactccatcttgagtaggggctggtaaaataaggctgagatctgctgagctgcattcccagtaaattaggcattcaaagtcacaggatgtgttaggaagtctgcacaagatactggtcataaagactttgctggtaaaacagtttgcagtaaagaagccggccaaaattaccaaaaccaagatggtgagagtgacctctggttgttgttatggctcattgtaagctaattgtaatgcactagcatggtagaaggcactctcaggagcagcatgacagttttcaaatgccatggcaatgtcaggaagctaccctataaggtctgaaaagggaaggagccctcagctcctagaattccccagctctttccaggaaaactcatgaataataacccttgttaagcatataatcaagaaataaccataaaaatgggcaaccagtggctgatgccactgctctgcctgtggagtaaccattcttttatttctttactttctcaatacatttgctttcactttatggacttaccttgaattctttcttgagcaagatccaggaaccctctttcggggtctggatcgggatccctttccagtaacatttcccattcttttaatttttattgttttattacctttactttcttgagttgaatgctgaacttattttcaatcttgcttttttttaaaaaaaaaactaataaatgttttttaaggaatacattttctcctgttgacaaaaagcatcaaactccgtaaaatatttgaagagatttattctgaaccaaatatgtgtgaccaatggccagtgatatagccctcaggagatcctgagaacatgtgcccaaaatgatgggctacagcttggttttatacattttagggtgacaggagacatcaattaatacatgtgaggtgtacgctggtttggtccagaaaggtccagacaaccggaagtggaggcttccaagtcctaggcagattcaaagatattctgattggcaattgactgaaagggttattatcaataggaaggaaagtctgtgttgtggtaataaggggttgtggagaccaaggttttatcagacagatgaagcctccaggtagcagccttcagagagaatagattgtaaatgttgcttgtcagacttaaagagtctgctctatcagtaattccaaaagggaggagggtataatgaggcgtgtctggctcccctttcccattatgaattgaaactagtttttcaggctaactttagaatgtccttggcccagaagggtccatttagatggttggggaggtggggtgggccttagaattgtaaaccaaaaataaaattctaaggcccctcccaaccaactaaatggacttcctttttagtcagggttcttaaaatttaacctgaaagactggtttaggccatgaaaggaagtgggggtcagacatgcctcattaatacctctctggcattaacaacaacacagacttcaagtctgataagaaacattttacagcctgttctctctgaagcctgctagctaaaagcttcatctgcatgataaaattttggtctccacaacctcttattgcaacccaaacatttctttctattaatcccaggtcttaagacaaactcaaccaattgtcaactgtcagccagaaaatgtttaaatttacctatagcttggaacctacccccctccccaacagccccctgctttgagttaaccaaaccaaatatttcttaaatgtgcttgattgatgtctcatgactccctaaaatgtataaaaccaagctgcaccccaaccaccttgggcacatgttgtcaggacttcctgaggctgtgtcacaggtgtgcattgcatccttaaccttggcaaaataaactttctaaataaactgggacctgtcttacatgttctgggtctagagatttttatttttggtttacactgggtctacagaattttatttttagtttacacttctaataaactttagaagtttttttggcaactcagaacttttgatatttaggagtttacttttacttttccaaatatatattttaaaatctatatcttttattgttgattttgcatttaactgtttgtagttcagaaggacgttggcataatttcctattgtaacgagtggcaataaaagcaacataaaggaattatgttctctaaatatatcatgtgatgtataataaatagtatattaaaaacccataattaaatccaatttctctggtcttctcatgtcacattagtcacgtttacaaaggcaaaatcttaaagtattagcatttgcttgccctttggtgttcttaaacagcagagcccccaaacaaaagcctatccagtgaagactcttattttgctaaacatccaagcacttcattttctgagtgagagatgatttatccgctccacaacatcagtcatttgaacctcagtgcacagtgtgtgaaccagtggcacttttaaagaataactttgaagaataacacacatgcaaaaaagtgcacagatatgtctatagctcaaagaattttctggaagtaagcacactatgtggcctgcttacaaatgaagaaacagaatataaacagccctctcatgcttcttccagtgataactccaccatcacctggggtaacctctaccttgagttatagcaacacatatgcactcttcctgttattgaactagatgctcttttgtgtctgtcttctttggctcatcattatgtttatggaattcaccaatattattgcattgttatgtagtattgccttgtaagaatataccacaatttatccattctccctttggtggacagtggaccaggtttccagttttgggttattatggataatgctactacaaatattgttgttatatttttggatgaatatgtgtatgcgtttttggggggttgtatacatctataagtggaattgctgggtcatgggatatgcatatgtatgtttaattttagtagatatgtgcaaaaagtattccaaagtggttaaattgatacaatttattgaaagttctggttgttctgtgtctttgtcaacactttgtattttctgtcttcagttttattctgtacttcagtaggtatgcagtgatattgcattggtatttgatattggaagttacctaatgactgatgaggttgagcattctttcctgtgctattgatcatttgtgactcagtgttttgaagaaatttttagtcttttcttcatttttctattgtgggtgtcactgactcaggccagtgtgttggatggtaaaagaatgtaccaagacacttgtggggaaagaaaggcagatttattaaagaaaatacaaagatatattgcaaggtgcaatgggcagcacagcagagaaggggctgtctgcaaagatgtaggcactgcggggaagttttatagggccatagtggaaggggctatgtgtggaacgagataattgggaagaggatgttgtgccaaggagttgtctgtgattagccatctctcagaaaaatgattctcccccaccctgggagccctttttcattgttgctgacttaccaggactccatattttctatgggtttatcatttcttcttgatgtgtataaatcttttacatatttttttgatacatatcttctgtcagatacaagtattgtaaatttttcatcctaaatctcgttttcagtttttaatttttttagtaaacagatgctcttaaacataatatagtctaatttatcatattattattattttatagctgttatttttaatgtcatctttaagatgtttttgcctactgcaggttactgaatatgttgtcttttgtcctacaaattttatcattttgcaggtacaaaatatgtttatcttaatctaactggaattgatacttgtgtatggtgtcttatggggtcaagatctattttttttctctgtattttattttacttttgccatgtggatatttagttgtcacagcaccatttattaataaggcattctttctttttctgcactatcatctcacctaattttaccaccaatctggtaaccactattctacttactattaggttggtgcaagtgtaattacttctaatggcaaaaacatacagtaggcaaaaatatcttaaagataacattaaaagtaacaactacaacaattataacattaaaagtaatgacaaaaactgcaattacatttgcaccaacctaatacctccatgagatcaattttttttagcttccatatgtgagtgagaacatgccatatttgtctttctgtgcctggcttacttattttacttaacataatatcctccagttccatccatgttgctgcaaatggcaggattttattctttttatggctgaataatattccattgcgcatatatatatatatatatatatatatatatatcacattttctttatcccttcattctgtttctgtatgtattttttattttttaatttttgtgggtaaatagtaggtatatatatttatggggtgcttgaaacattttgatataggcatgaaatgtgaaataagcacagcatggagaatgaggtatctgtctcctcaaggatttatcctttgaattacaaacaaaccaattatactctttaagttatttaaaaatatatggttaagttattattgactatagttatcctattgtgttattaaaaaatgtcttatacattcttctattttatttttgcacacattaaccatccccacctcccccactgtacttcttaatgcttctttttattttttttttaaattttgagacagagtttccctcttgtcactcaggctggagtgcaatggtgcgatctcagctcactgcagcttctgcttcctgggttcaagtgattcccctgcctccacctcctgagtggctgggattacaagtgcataccaccacgcccggctaatttttttttttaagtaaagatggggttttgccatgttggccaggctggtcttgaactccagacctcgggcaatccacctccttggcctcccacactgctgggattataggtgtgagccactgcgcctggccaatgtttcatttttaaaattatcttaattactatggctttagaatagattatgtaaatgctctttttcaaacagaaagtatccgtatgtatttcagaataagcggaagcattacatttgaatcacattttctttatgcaagtgagagaattattggaatgcttaggcagtgttataacctgggaacaagaaactagtttaaagtaatcaaattgtcagtgactaagaagtcaaaagtcagtgaaaaacatgcacatgcactaacgtgttagaagtgcccattttgaaaatcaaacgtgtgactgactattcgatcatcaatataagataatactcagttgacgttttaaatattttatctttgcttatggaattttttttactgaatttttaaaaactcagcctcatcgataactttcaataactatgtttgattcattacacttattgtgttttattgatgtatttggaaattctactttgggggctgtgtgtgtgttctccatcttacagattttagagagattgtcaaattttttcatatcccattgttccctaaaatgatttaaaagacctcaattgtagtttcatttgttttaggacacagtcttagattttaacatacatacttatctattatatttgttaataaagtcttaggttagtggatatttctatactctttctgaaaatgacatgcatcttacaaccagttggacttttaagatagtctaggccaggtgtcagttgtgatacagcagtcatatctcaaataatgcccagtttttgagtgcttctttttttttttttttttttttttgagatgaagtcttgttctgttgcccaggctggagtgcagtggcatgatctcggctcactgcaacctctgcctcccgggttcaagccgttcttttgcctcagcttcccaagtagctgggacttcaggcacctgccaccacgactggctaatttttttttttttttgtatttttagtggagacgggggtttcaccatgttggccaggctggtatcgaacacttgaccttgtgatctgccagcctcaacctcccaaagtgctgggattacaggcgtgagccactgcacctggccttgagtgctccttatctccataatcatgtttctgctggttagaattttagaaaagtagtctttttgtcttttcggttgagtgatttatctaccaatttttatcattttatgtgctcattattgtattctacatctcagtcactacttttttattcttcagaatttctgaactctgctatgtgtctaaaatatgttttatgttttgtgtccttcaaagtgcatgtgttggaaacttaatccccaatgcaatcatactgggaggtggggctgatggcaggtgtttaggtcgtgaaggcaccactctcatgaatggattaatgctgattgctaaagagcttgaggctacaagttcgatctcttgttctgtcttgcccttccacctttatcgtggaataatacagcaagaaggctcttgctaggtgctgacttttcaatcttggacttccaaacttccagaaccatgggccaataagtttatattcgttataaattactcaggctgtgggtgttctgttatagcagcacaaaatggacaaagacaatgtctaagtgtgggtttagttttcttttttctgatcactaattaatgttcattttctttttcttttttttttgttttgttcattcagagtcttgctctgttgcccaggctagagtgcagtggaaagctatctcagttcactgcaacctgcgcctcctggattcaagcgattcttgtatctcagactcccaagtatctgggattacaggtgtgtgccaccacacccagctaattttccctatttttagtagagacagagttttgccatgttgctcaggctggtcttgaactcctgagctcaggtgctccacctgcctcggcctcccaaaatactaggattacaggtgtgagccactgtacccagcccaatgttcattttcaatcaggtgaccgccattctactcactactttaatgagatcattttttttagctctcacatgtgagtgagaacatgtgatatttgtctttctgtgcctggattacttatttcacttaacataaagtcctccagttccatccatgttgctgcaaatggcaggattttattctttttatggctaaataatattccattgtgcatatataccacattttctttatccattcatccactgatggacacttaggttattttcatttcttggctattatggatagtgcttcaatgaacatgggagtacagatgtctctttgatatactgattttctttcttttcatatatacccagcagtggaattgttggattatgtggtagttctatttttaagtttttgaggaacctctaaactgtttttttttaccctaatttacatttccaccatcggcgtttgagcattcctatttctctacatccttgccagcatctgttattttctgtctttttgatagtagccattttaactgaggtaagatgatctcattgtggttttgatttgcatttccctgatgattagtgatgttgagcattttttcatatagaggttggccatttgtatgttttcttttgagaaataactacagatcttttgcttatttataattggattataaagggtttgtttttgctattcaattatttgagtttctatattctggctattaatccatcagagagatagtttgcaaatattttctcccattccataggttgtctctttactttgttgattgttttctttgctgtgcagaagctttcacttgctacaatcgcatttgttaattttttcttttcaaacccacagctaatacaatactaaattaaaaagaaaaattgaaggcttttctcataagatctagaacaagaaaaggatgattatttttatcacttttatgcaacatagtactagaagtcccatctggagcaattagataagagaaataaataaaagctatccaatttgaaaaggaaaaaaggcaaattgcccttgtttgcagatgacattatctaatattcagaaaaacttaagactccaccaaagaactgttgtaactcaaaagcaaatttagtaaagttgcaggatagaaaatcaacatacaaaaatcagtagcagtagcatttctatataccaacagcaaacaatctgaaaaaaaaaaaaaaaatcaaggaagcaattttatacctaagtataaaaataaaatacgtaggaaaaaatatagctaaagaagtgaagatttctacaatgaaaactataaaacatttacaaaataaattgaagaggacacaaagaaaatggaaaagtatttcatgtttatgaataagaagaattaatattgttaaaatgttcacacttttaaatgataaacagattcaatgcagcctctatcaaaatatcaatgacagaaatagaaaaaacaatcttaaatctcatttggagccagaagaccctggatagtcaatacaatcctgaatgacaagaacaaagctggaggcatcactgtacctgacttcaaaatatactgcaaaactatagtaatcaaaacagcatggtactggcataaaaacagataccaatggaacaaaatatagagatccctggaataaacccatgcatttacaggcaattcatttttgacaaaggagccacaaacatacactgggggaaaggacaacctcttcaataaagggtgataggaaaactgaatatccatatgcagacgaatgaaactagaattattgaaactctctcaccatataaaaatcaactcaaaaagaatgaaagacttaaatgtaagacctgaaactataaaatgactagaagaaaacactggagaaatactcgggacatttgtctgggcatagaattttttgagtaagacctcaaaagcacaggcaattattttactcattttggttcacaatttcctgttttttatgatctctgaaaattgcagccctacctactaaaaatcttttattagattagaaatttgtttttgtttgtagttgatttattgttgattattagttgattatagttgattattgtttttatcttgatttttatgattgtgatctattttttatgtttattgggttttggttttgctgtttggatgttgggctttcattttcaggatagctctatcacatatttcgtaattttgttttgtagaattatcttatattgaaggaatgttgttttgtgctaatacattttctctttctttagagcatatgtgatgttttcgtccaatggcccctggatctgctatccacagttgtgttttatgtcaactgtttgagattccttctccatggacataatgaggctgttttgataccattactcaagggagcatatagcttggttcagcttgacttttgactgcaaggctgggtttgcatatactgccttttttgtcaggtggctgtagccctagacagcctcttattaacgggggatttccagtctcgcttattaacaggggatctcaatctccctcttaatcctcagcagggagcctgactgcagtctacagcttcagcttcatgttggctgaactttttctctgttcttcccatagaagtagaaaacctggatgcctcttcctgtgtggactaggagcccagaagcctgtagcttcagcccattttaccttttacttattctatttctcatccacagagatgttgcatatttgaagccagctatgcatttgaatgttctctttggaactgttatccgttatcattgtgagtttggagcaatgccacttgcctggatttcttcctttgtttcctacctggcaaacctaatggtattccctaaactccaaatatctgcacatcatttccctgtttataacatttcattctatcccaattgaacttcgaacaagtgtaaatgcattaccagacctttgaagacctttaatcacagggcctttgctcctatttatatgaagctgctttcagtttcccgaatgcattgcacttccttcaaccacaaggccttcacatgggctctttctccatctgataaactctcacttctctgtcttgtttgtacttagtcttcctgatctttctcatctccatttaatgtcacttccttcccttttcttcactccacggactttccttcctccactcccacttcccatgtgataacacttgtcccatttccttgtaaccactttttaatcactctttcctcatagactgaagctttttgtgaatagagaacatgtcttgctcattcaattcttaatcactgcacctagcatatcatagacacccagtaaatattacagaataaataaattaatgaagaggcaatttactccttcatcttagttcttccttgctgtccagacatagtcctgacttgcatgtgacatgggggaacaaactgttctatctgtaccaccagttaactaaggagtccttcaggctcagctatgaattccatcaggaaaattctgagctttttggagtaatggagggagaggtgatgggattctgttgtggaactgagagggtccagtggaagtgagtcagaatgttcagtgttctgcaacaaagacttcccttcactaccccttcaagcatcacacagactctccaggtctggggtggcttgtggtcccatgtggttattacatgcacctctacgtactgaatttgttgatccttgcagactagcagtgcaagagctgatctgaactcaggggccctggagaagcaaagtcactcctccccattctgaagcagctgtggttccttacatttggacacaggcctgagaccttggctacagtgagctagtgctggggaatctacttattgatcaccggagcagctgctaagcctggctttcaagaacatccctcagagggtgctttcactgtgccaaaatctttcattcattttcctctaccattttaacatgcaatttagttaaaacactttcctttcatgtgtgtgccaagatggtgacttcataaaggtcaggaaatgaggaagcaagaacttccttgaaagatttaaaataaattatttttagtaataataaatgacaaattgggagatttaagacaaagattcctggtagttgaatgcgctgaaatctatgatgtttggggattgttaacaatcttcttccaggatttgatcggttttgtacttgtattttctcaatctactattctttacttgctctccttcctttagaatggacaaatttttgtaaacttttaagttttctctttccttgaggtagtaaattggagttgagctacacaggttcctctttcctgatatcccctttctgctatttgatgtgagatggctcttgaggctaaaagtgcagtgagggaaagagagtcacattagcagagctatccagaatatcctctggttattttggagcctatttgtaaaataagcagggaagtgtttggggaagagtgttggcttaggtaggaaagaaaccctccttggtctttgccctgctgtttaccagccacgcggccttgggtaagtcattcaagaaatgtaagcctactaactgtcaaagcctcagttccttttacttgtaaatgagagagttgaattaagtcaaagtagtcagttcaacggcttgcaaagaataagggaatttaagaaagcagagaagtttcagggaccatggagaacaaatcgtgtgtagctaatatgtaactccagaggatggttactgtacaaaaaaagcagatcaggcattgtcagcacatctgattatttcaagggaaccccagatctggatttttatgtgaaatattctaatttcacatataattagcaactcattaagaaaaaaactaaaaatgtcctgcttagggcaaaggagacatatctgtgggctcatcactgcctgtggacaatctgtttgcaaccttgggaatagatgacctctgacaccagattaatcatctgccttcaaaattgactaacttcactggacccagtcccaggtggagagtctgaaagcctagaaattgctgcagcagcatcaacttcctgttggaagctggggaggcaaagtcttaccctgagaaagggctggatttctcttaaaattttgaaaggccaaaggtggtgtcagcatttttgtgatatggcaggaataatactgtgcagtggatagggagctctgaattcttaccttgggtgtgctaaaaacctagcctggacttggttacatcccctcctttctccggtgttctcttggtgggtttataattttagattaaatcagtatttctcaaacttcaatgattggtgtattacagtgtggtagccagtctctgagatgattcttattccttgtttttgcttccttgtgaagttccctcccatatggaataggagtgatttatgcaactaattagagattgcagaagtgagtgtgtgacttctcaggatgtgtcataacagatattgccattttcaccttgatctctcagatcacttgctctggaagtacactagctgctatgtcatgaggacacttaagcaacactgtggagaggtccacatggtaaggaacagccagcaccaactcacaggtgaatgaaccaccttggaagcagatcctccagccccagtcaagccttcagatgactgctgttgcagctcacattttgactgcaacctcatgagggactttgagccagaatcatccccaattcctaacctacaaaaactgagagataaaaacatttatcactgcttaggcaaccaagttttgcattattttattatgcagcaatagataactaatacaaaatcatgattattgctatattggcctaccattgataatgttacacattaatgcatgtcaatgcatttaaatggtttattctttcaatttaaatagatttattttaagaggaaaagttttatgttgtaaataaaaaataagcatcactagccacaaaataaaaataactcagaatttaatttccttttcctgtgactcattttttatttttatgttttaaaataaattttattgcatgtatttaaggtatacaacatggtgttatggaatacatatagatagcaaaaaggttactacagtaaggtaaattaacacatccatcatcttacacagttatcttttttttgtttttgtttttgtgtcaagagcagctaaaatctactcatttagcatgaattcccaatatagtacaattttattacctataggcccacgttgtacgttaaatctctaaagttatttatcctacatatttgttactttctctcctttgacctacattttcctacttcttccttttctatctcctcctttgccccagtaaccactgttttgttctctaactctgtatatttgattgtttttaaaagattccacatataaatgagatcatgcaataattttctttatttttctgtctatgtctggcttatttcactaagcttaatgtcctccagacacattcatgttgtggtaaatggtaagatcttgttctttattgggctgaataatattcccttgtatacatataccacatttttgtatccattcattcatcaatggacacttaggttgtttccatatcttggctattgtgaataatgctgcaatgaacatggaagtgcggatatctttatgaggtgttgatttcatttcctttgggtatatgcccaggagaaagattgcattgctgggtcatatggtagttctatttttaatccctttagaaatatccatactgtttttcataatggctatcccaatcttctccaatctaaattccatttagataatgttgcctgcagaagactctgagcctaaggcatctcatgtctttggaacaaaactgggactttatccttgaattaaacaaagtgactgatacgcaattgagcagggaataactttctcacagtgaaatttgatgttaaaatgccccctctctctacacccccaaactgtcttacagtcttccaaaaaatgttggtgttttcttttcccccttttgggaaaattagctaaagtttatgtgtttcttcacattccaaaacattctaagatagcacataatctctgtgtcaagtaagattgcctataataaagtcctgtaaaatagctcaccccagtttttttgaagtattgctactaatataacgccttgtggttatttaaagatgcacagtttccaaaaccctgctctgttcactgggctttagtagcaacaaagagactaggtctgcctgaggattatcatccttaaatgtatagattaggaagttgaagcctggagaagtgaaattagataagataataagataattcatctagtaattagtagggctggggttagaacctgggtcctctgggtcctccatcactctgtgtggcctgcacagaatccagtccatggactcttcacatgtgaggactctagctgcacatgtggggactcccaagcaggtatagtatatcagagcttgaaggaaggctggcatggcagggtctggggtggtttgggggcctgatgcacggttatcagaggagaatctttaaggaatctgagaagctgagaagatagcaatgtcaagctcgccaagcagctgccatggcaaatgagattacagaagcagtcttccctgcatcccagaggctgccacagctgagagtttaaatttgcagcttcagaaaggaaagcagacacacaaatgtgcacacgaacacacacacacacacacacacacacacactcactctctctctctctctaatgcccatgtgatatcaaatgtagccttgacaatgctccagcccccacagagatgctagtctctcccacttctcagtcaactccctgaaccccatctccctacatggctgtaggatgtttttgaatttctactaaaaaatatttctgaatctttgtgcatcttgaatttgtccaggactaaagaaagaaaagtatattttgatgtacaggaatgcatggagctttgtggttctctactcaagtggagtagtatttttatgtatattgggtgacaaaacattcagattacatggaaaccaaacatgtcaaagcattttggagaaataatttggtagctatttccagatgcaaaaatacttctgtttctcagtcaagttctttgtcctatttaaacacaggccactagagctagtaattgtcttttcttaggatattttaaaggtcctggaacacaagactggaaccctggaaggatcagattgtctcattttaccagaagagagactgaggcacaagaggagaccaagcatggctccagggacgctagtgagtcacctgcagatgagattattcaactgtataaatgaaatcatgtttcacctgcaacgaaagaaagcacaaatcaccagtttttacttctttctcttcttttactagttttaaatggctaaatggatcacctcccttccattcccccactccatctcccttaaatttggaaaccaattacattccagggaggtagagatctggtgataaaggactcgtttcaggtttcacacttgaatacatttttacagcttgcttataaaattctgaaagctggtctcctagtagaagggaagatgctgtcaaatgctaaatggtgcagttagagggacattcagacctcctctctagcccttcctctttttctggcacccaaaggcacgggcctttcctgtcagctgtgcaggctcctcattactttctaggatcagcacatggatcggctctacggggtgtcagactcagtgagtcagcaaagcaaagcagctgggctgagacagtgagacagtggacagtcacccagaacagaggcagggctcatacaccagcagccggggaggagaagctgtgcagaatccacatcagagacatagacccaggggcatcattctaatagagggcttccacttttgatattcttctttgttgtctggtatgatgcttaataagtggaaggtttaaagggaaggtgtgggggtgagtctatttattccttgtaatatttttccgccaatttgaaatagacgaattagttcagactatgacattttggctgatgcaaccttattttattacttattttattatagatcagagtaaagggttaagtcatttaattcaggtcaaattctaaaagaaggatattactcaactcataaactatatagtctgcatcaagagaaatggcttttatcaacagcaatcaaactcccttatccaaaatagtaaaatcttgagacttccaattttaatgtaatattttccattttaaatatggataattatttgtgctaagtagctaaatataaccagagacattaatggacaaatgataacaacacaaataatatatttataacagttagcatttttaagtacatcatttaccatattatagccacactgcagagaaatttatttttaatggatgctacctttgtagctcccctaattctgaaaagattttgtttaatctttttagcaactctaattaattattatcatcttcatatacatttgttaattcaacagatattcaacagatatagctattatagtataagaaattaaaacaaagtgatgcgaaagaccaatctcaggggagtggagatctttggtcaggatatgaagggaagggctctctttctagatgatgggtttccaggtacaaagagatgtgaagatgtgaagattgttccagggcaagctccgaggtgggcaaagtgactggtgatggtggggagagggacaggagggaggttgatgaggttagcaggggctaggttatgtaaagccatgtgggttgctgtggggaattgagatgagaaaacagagacattgaaaggcattaagtctcgtttccaaggccacactgctaaccgggagtggtggcaggtgtctgtaatcccagttacttgggaggctgaggcaggagaattgcttgaacccaggaggtagaggttgcagtgagccgagatcgcgccactacactccagcctgggtgacaagagcagaactctatctcaaaacaaaacaaaacaaacagaaaagaactgaagcacagctaagccggataagaatttatctctatctctaagtgtatctctctgtcttatgtgtatttcctgtatctcagtttctacatctgtgtattatctatctatctatctatctatctatctatctatctatctatctatcatctgtctatctttctatctctctattatctatcagctactatgtgccaggaattgtaggctgaggagatgtgacaataaacacaattgccagagttcctactctcatggatttttaataagtgcaataaagcaaactaaaatagggaaaagggatgtaaagcaaactaaaatagggaaaagggatgtagagtaaaagggtgcttttgtggataagatgctttaaacagagaatatctttgagtggaggcaggaatcaagtgtggaggcagacatgcgctctgtgtctgcagctaagatagctttgtaattagcattttctaaatacaggaaaacatgattgtctttattgggtagcgtgaaacatgccatgactatcttgaggtgtgtgtgtggggtgtgtgtgtgtgtgttgatcaaatcctttcccagaccagaaagagcaagaaaaggtcagcctaagttgtataaacaaagaggatttggaggcttcaggttaataaagttttgtggggtttagagagccatggaggcggtgttcataaaaatagagaacccaaccagacagaagtttgtgtgtgtttgagacatgagtctttggtgtctacacaccaaaaatcagttatacctggagaaataattatgacattttcaacagaaaagtatttaggcatggttaagatctgacccccacaaaagattgaggaaaaattgatgagttcagcaacagccaataaaaagtcatgggaagactgaatgttggagtttagttacctttgggtctgagaaactgcattatattcccataaaagactgaagattaagccatattcctctctctgtgcattatattccttcttttttcttttttccctaacagaattttagttgcttgaaaagaattaacatagagcagaattttgaatatggctaggattagctattgtagcataaggtaagtggaaaagaaccccttgtcatgttgagtttttggaatgtctagacatgaataaaaattaaaaggtatcattgattgtttctgttttaatgagtataaagtgaattgggcaattcacaggctaactccaaccattttgggcttcctgatgactagggccaagatatttcaaagagtactaggtgatttattgggtcttatgcaattattattccaagaagagagatgtcgtgtccttggcttatgggtctggaacctactcatgcatctgtctatccaggcttctgtccatgcatccaagaggcttttatggagctctgtgaatgtcacaaagatgaatcaggcatgccctctgttcccaaaaagctcacagcacagccacagatgaggaaatagagaattatgttttttaaagtagggtaagtgtaggatggtggcaagggttagatgttttgggattgggggtaatgatcccaaattggattagagcacctggtaacagtttctcagaaacgctgatgattatgttcatcctagagaagaatgtgtggaggttgtgcaggcacagaaggaagaaagaggttttccaggaagagggaattgtacaagcctgggcagaggcacaaaggggtggaagagcaagattcactcagggaattgcagtaaattggcacgactggagtccagactacatgtttggtcaggcagtggggtaggtatagaaaaggaaagaatggccaagagtgagagactcagagtatttgggatagagttatgagaggcctgggggacactataatgaacttggatttgatgctagtagctctgaggaaccatgtatgtaatttaaattgaaggtgtctcactaagatgatggaagttccattgggctcctatggggtgagtagaattctatggcaattttttgcaataattatggcacaagagtgaggccaagagtaaatgatctggagtgtgagaagccacttaattctttgtatgttggtccttaaggtgtaagcatccctttcatggaccttttgtaggtccaatgaatgacctcaacatgaaaccttgcagataattttgaaagaaaaggaaaaaaaactcttcaatcatgaaaaggtctccattatatttccaagctatgtgaaaatttttattatatatcaattactttggaaacatggccattgcatgacactgtttctcattcatgaagggaacacttctgttttgaatccccagcggtgcctggtgtagtgcctgagacagagaagaagcttagtaaatgttcaaggtattggtttgctaatgatccaaaccaagctgtgtttgggcccatttgaacatttaccgaaccatgttgttaaatataaggaatgtcagtaataaccacaaaagtaagtcagtaaagacaatagagcaatgtcttagtagttatcatctactgaagatctgctcttagctaggcatggtcgcaggctctttatgcctcatttcactaaatccttaccatccccacactgtgtctgttttattatccccctttacagttgggaacactgaggttaactgtgtttactcaacaatctcagggtcacacagatgcagagtagaaaagcaggatgtgatcctaggactaaaggcagacaaagtctatgccttttctctcctattgcagtttccacatatcagcaggtacttcctgtgaaagaggaagcacatttgttctcctggctccagagaagagaaagcagactggcagctctcccatgagggaaagaggagaactttgacaggaatttacgaccaccagggagaacagaactaacttttctgtaaggctgtggccacctacccctgaagatgagatgctgatgtagaaaatggacagccatctcttagaggatctgcaaaataatttctattctggttagaaaaattaaatacattcactttatctttatgatcttgagatattccttggatagtaacaacagctcctgacatctggagactatttcattttagacaaaacatttgcatggagaatctaatatgatcccatgtgacattctttttgggacaaggtagctgttgctcagagaagcagcaggaattgtccaaggacacacagggtgaatgaaagacttggcagtgggacctgggtccaataatttcaagaccagtgctccttcacctatgcatgttgtctactggagtgaagcaaaaatatgggtctatagggcagtattatgcagaatgagtagtttctttccattattagcataagccatactctgaagctatttctgagacagtcatccttttctatgtgggtcaatgttcctgcagcatggacttccttctgggaacaaagcatcctttaggatcttccttaatcatcctcatcagtgtaatatgttgcttcctgtccaactgtgccccatttccataggcaatttatctgtatccatagagacaccagagatctgcttcttacttcaaatgtttcatatctaggttattcttcctgacatgtgagtccagggcacaagtctaaagctcccacttacacagcccagagggactgagccctgctttccacagtcaggtcaggagcacactgactcctgactgtggaaaatttgtctgtgtgctaagtgtaaacagatgtccccagctgccggatcctttggccatatgaaaccaatcaccaactctacacaaacatgcatcatcaggctaaaatctgaaggtgcaatgaactcaccctgcttcccataggacagtgggtgagtagaggctgtggggagtttggtcagagcagtccatctaagggcaaaatttgtgtggtttaatgagatgaaagtggtgaagcggggccaaaggaagtgcagctcagagttaggatagatactggttcaatatcatctggacactttcaaccctgtacacatgggggcactaaggtttgggggtagaagtgacttcctcatgatctcatagcactctagtgattccctcagggtttaatcacagatcagaatgcccaggccagtactcattccattatgtaaggctgcctatgacactggctttcccttgagcttcttcatgtggagtccttgcatctcttatgttttaaatcctggcagttttggattgacttttctaagccatgtgaactttcctaaaggataaaaatgatgatgccattgattgtgggttaatattaggttagcctagatgttctatgtacttaattgcattaatagccctaacgtaccatgaagtaggtcttctattttaaagaagaagaagctgatactcagaaatggaaagagggttgcctaaggacacagcttttagatggcacagcctgaattcacatcaagacaagttccaaagacatagtttaaagaatcaacgaagttatactgaggcatctgattgacaatataagatggctgcatgattaatattatttattcacttaaaagaatttattgagcatttattatgtgtctggcagtatatgtggtttcaaagttgagcatgacattattctattaagaaaacagtgtagtggtggagttggaaatacaaacaaacccctcatttatgttgaagcaattgttaaatggatgattgatcaggtataattggaatagagtaaaaggagtgcatcagtttgtctaaagggtaagagatggtttgtcagaagaggtgacacttttctatcaaataggtgaggatggaattcaaagcagaagttgacagtctgtttagagaagtgaaaacagaacaaattatggaattgtggaatacttagggaaatacaggtcattaggtattgttaatttgttaaaatataagcagggaagctaaaaagatgatattaaatatacaggttacaaggaccttataggttttactaagggagttagaattgttctctgagggcaattggaaaccatggattggttttaaacaaaaaacgcatgatggacgtattgtttaggattggatttgattgttagtaatgtgaaactctaaattaatactggcctaaaaacagtaggagtttgtttttcatctaaaagtctggcgttacatagtcgaggattaatatgatggctgtttaggaattcaatattttttcaaccatccccgtatgtgaccttcagactcacattctaaacctataatcagggcaacaaggtggaaacaatggtaaataagaagagagttacacagaggtaccagtgttcttttaaggaaggtcctcagaagcttgcacaagacacttctgcttttatcttatacatcagaacttagttacatgtctacactcagctgcattaaaggttgggaaatacagtctttgctctggatggtcaagagcccatataaaaaatcaggctttgtggttttctgctagaactgaaggatggatattgaggcaagttatcagtaagtattttcatattaaagagatcactttaataactctgtggaagatggacaaagatatagggaagacactgaagatatgagactgaggctggtgataaccatgaggctggggaatgctttccctttcaaatgacctaggctttgcccaattaaggaaattactgtcttagagttacttcttttctattgagtcagaggtagatatatgtctccttcagcaaatgagtcatacccaaggttgggtaaacttgtttagatatgcagagtgaaccacgatatgaacctggtttggactgtatccttcacagacttaaaactctgctcatcattcttgtgtcctcaaatagccagatcagattttttattctgattttctatagagctaagataggtaagaggaagtttctatccatttcattctggttagctgagttaacatgttttgtctgttaaatattcatggaattaggataagaacatgagttttagaaccaagaaaaatgggaatgaaaaactcagctctggtactaatcccaggttgtctggtttgtgagttagtcctgatcatcaccacaccatatggcatcctctggctcttggtttacttttccctcttccttaagctgttcattttcaagtaacatggggaaagtcacaccagtcttactgagtatccctaaaaaatggaggcagaagaatggacttgatgatagaaaaatttattcttgggcactaagcgtgctcagctggctatgtctacctccatacctcccctttaatatttttctcctggcccaacaagtatgtccagggccctataaaggaaataatccagcatatgtctaatgttggctcacccagtcctcatcagctttgagccatctcactttgcttctaatattcctaaagcccctcttcttcagagtccctactcctctattttactcagtttctcttgattctatatcatggcttcattcttctctacagtgtttctaggaatacgaaagagtagggatgttgtctgaaaactccaaggttgagatataacatactgtttaataacagagatgctgaaatcaaactggtatgaatttacatctttcccttactactattaattctggaccttaagtaagttgtgtacctttttcaagtttcctcatctgtaagaaggaggacaataataattcctatcttgtatgttattgtcagaatttaatgagttaacaaatatatgtaatatatatgttttatatatatatacacattttggtttagtgtttggcatatagttaagtacaaaataaatattagctattgatattaattttggggttggaggtcaagaaataaggctggaaagttgggaggctccattgtgaagagtgacttaatgattaagaagctggattttgggcaagaaaaaagaggggctttggacaggagagtgcattcattttctattgctgccgcacaacatgaaacttagtggtctgaaacaacacagactcacagttctggagatcagatgtgtaacatggtaggcagattgcattcctctggttttggggaagccgtacctttctcagcttctagaggttctccatattccctggctggtggccaagcatattccgaattctgcttccgttgccacatcttcgtgtctgcctgactctactgtgtctctctcacaagaacttttgtcccagatagtccaggactatctccccatctcaagatccttaatttaattacattggcaaagtcccttttgccatgtaaagtaacaaatttgcaagttctggggattagaatttgggctttgatggaggacatttcagcctaccacagaaagtaacatggctgtctggggattttccaggatagcttgtgagattagagttaggaaggccagttaagatgctgttgtgagaatgtgagaatgctgttgtgagaatgttgtggggaatgtgaatgtaagcattaggggcaatcaggacactggggaggaatggctgctgaagaactaaaatcaccaagacttggctaatgagattaggagaagggcttctttctagatttctagctgcagggactttcagctaggggatggtggtgtcagcaggagctggcaaataccaggggaggtgaccgacacattgactaaggctttctgagaaatcttgcttcctgtagcctgcagccattcgttataaaacacagagagcagtctggcccagaacagagtttcccacatttcactcattcttaacaactttttccaaacctgtctttttaatgtttcaatttctgaatatttttctttaaatagactccagtaaaagtagcttcatcctaaacaattagtttcacaaaaccacaactctgatatgcctggatatttggatgcacatactattcatacatactcattaaaatggaaatgtatttttccatgcaccagctaaaattatttctcaaaccatcagtgctaagcaaaccacatatatgcaaatgtcggggaaatgacaaaaacacagactgagagattcaaacctagacttgagtgtatcacttgagtccctggacttttatttcctcatatgtgaaataaagataatgtctaacttataataacttagttagataattagtgtatggaaaatgcaaggtgccatatcttataacaggaacccagcctattatatgcatttatattgttgaatcttgtgatgttttttccttatatattaaataagtcagtcttttcataagacctgtcagttaattttgataaacacactagggaattcatcgtctttgcagtctaggtggcaaagcaattttacttactgttttttattacctcatgagtcttctttacttccagggtacttctttacttccagaggaggtatggaggtatggaggtagacatagccagctgagcacacttagtgaccaagaataaattcttctatcgtcaagtccattctcctgcctccactttttagggatactcaataagactgatgtgactttccccatgttacttgaaaatgaacagtttaaggaagagggaaaagtaaaccaagagccagaggatcaagtgaccacgaggggcttagggaaggcattcattcctgttgactgtgctaggagaaccctgggtcaggagatgctggactcctggggtagaaaacctagttcttttcaaagatttaaagtaaagttttgaggtggaaagccctactgttttctggactatattagaatcattcctctcctcatggctgtggatcatattgcttataaaataccagcctcgtgacccatttgagaacatcactgaaggtccacaagataggaacaaatgggttttaaaaaacaccccagggtctctccctactgaatccctacccagtctaacagaattagactcaaagcagcatttgcagaagatagccctctttgcatgagctttccaatgatacatctggttttccttttgaaaaaggccctcaaacctcataaaactgaagtcctttgattcaaaccacaaattccttatagctaacctcagcaaaactccttacacactctgagtacttagtccctgtaacccttattcctcttttctcttccatcttcattaagttagtgggagccaagcttacaaggataaatctgattgttttgttcaattcacttcatattaataaaaattatgggtcatttttctgccttagacctttgctttagaatagctactatttattaaactctaactatggccaagtacattacatagcatcccacttaaacttacaacaggcttacaaagtaggtggtatttttccagtctttccaatgaggaaagagaaacaagcaaacaaacaaaagttattgtttcattgtcttcctgctgctagatgatagatctagtaattcaaatccagtcggtataactccaaagccctcacttctcaagtttgtctctctatataacagattcctaagagttaattttcaaatacgatttgatattttaacaattcctcatttgcctcaggcaattgttatcctgattattgacttcatggtgatgacaattattgctactatgaataacagctcttatcctctaagtgttatactgtgcattttatataccttgaatacaataacttcttgaggcaagtattattatctccttttataaatttgtaaactgagatgcaaaaggtttgttaacatttccatgatcacagagcactgaattaatgggaactgcaaatactaacaaaaaggaaaactttgtacatgccagcacttttgaaatatattttacatggttaactcatttaatccccacaacaaccctgtaaggtagatagcattatcatctgccttgcacaagtgaggaaactgaggcacagagaaataaaatgattattcaaggccacacaagataatcagtgaaagagctagagtgtgaatcagtatggccttgggtctgactcagagcttgttatcacagcaccatgctgcctaactatctgactgcaaagttcctctttgctctgggcaggtacctatgtgagtgaacttgaaactctatcactcattccaattcttttattcactggtgatctcactatgttgaaaggacaggatttgatgcatgccgtgtcagtggtgatcactgttattgagatagatttgcaccgatgtctgggagtttggactgaatgttaataacatacaaaggtgacctgcaataaatacacagctctgtcagaaagctagaggtctgcttggcagagagagtcatcatggattgtggcagattctccttctgtcaaggcttatctgaaggctaaataaatcatgctggaatcttctgggatgttggaagagaggaaaaagtgtgtattggatgggggtagggatgtggaggaggttcagatggaaatggaatattgattagaacaaaggtgaacttgatgtcagccagtgttctttttagaaatgaagggccaggaatggaagttaaaaaagagaaatattttctttaattgcaggcatagaaatagagaaatcaacatctgaagaaattctaagtgacacactgggctctagatagatgttactctatgtttgattctcaatttttttgatctaatgtttctgcaactatgaagatgtagctacactacagcataaagtgaactccttcacaatgaaaatttatttgacacatattaattgataactgacagctataaattcacatttagattgacttcaatataaaatattcacttaaattgctgtgtagtcacatttcttaactttcccaacttttcaagtataaatgatgcctgatgtttggcattagttttgaggattcccaagaacagctatctataccaacgtttaagaagcatcttcatagtgcagatttatagaaagatatcctccagcaatacagaggctatgtgaaaagcagtgtgaaggtgacagatatttgtcacctatgttatgtcaggcactgtgctaagtattatatatgtagcatctcatttaataataacaactgacatgcagagttgttattattaatccccattttatagacaaacatttccaggactctgagttatattgcacaaggctccttgatgttctcatcatgcagcagaatttgaaaaccagtctgtctgatttcaaaacttgtgttcttttaccagaacaccatacactgcctctcagagtaaaggagagataaatcagtgaggacagctaagttgggaggtcaggagactctctctcctggaagagaaacaccgaactaaaacaaaaccatgaagttcagtgttctaatttagaacaccaacctttgaagtcccatattctggcctttgctgggtatagaatacgagccatctcatgctctaagatggctggtaacctttatctctttcttccaggttagaaagttagctgtttctgaaggcattaatcttagtgagaaaatatatcatacattgtaattcattatgccacacagttcgttcattcattcaaaaatgttttctggtagattgactgaaaaaagtagctctggttttatttatttatttatttatttatttattttactcttcccatacccattgcaatgtgacattgcagattttatcaagaggtagtctatttcaccatgattttaatctgggctctccttgtatcttgttttgtccaaaagaaggtggcagaagtgacaatgtgccacttttgattgtagattatgagaggctttacatgcttctgtttctctcccctgctcttgcatccatcatgctatgggaacaaaatcaggccagaatacaggaggtgaagagagacacatgcacacagccacacacagaagcagagctgcctgattgaacacagctaacctcatgttcatgagggaacccagcagaaaccgaaagagccacctagctaagcctgctttaagttgctgacccaccgaattgtgagctaaataaatggttgtggcttcagccactaggttttgggctggtttgttctgcagcaccagataactgatatctattcactaaaatgcacttgggtgccaacattgtggcatgctgtggggacatagaggtgattaagttatgttccctgttctgaaagagccggcactccaaataggaagtcagacatgtaaacaaatgacaacatagcaagttatgggattaatcaaagtaactggtgaactccttttagtaggaatagttctatttcctctgtaaagaaaccactatgatagggagcacagtaccagttggttccaataattcttgtgatagtgtcatccaaacctcagactgcatcagtggtcactcagcaaggagccttgaagattacccaatgctatttatatctattatatgatcctcattaagtaacctcaaaggggaggcaggagcttggaaccagagctttttggaagaatttctttaaagggatagtattctgtgattaaattagaaatagcaagatacttgggagtactgattaaaaattttagtcttttggacttttaatgactgaaaaaattaatagagctctaggctccagaaatcaggaacttgctgagtatctcttttttttatttttcagagaggaaactatagcagctggcagatagattagtgtaaagaagctacacttgggtttgaatcccagctgagccactcagttacttgatcttttgctggtttctgaatctccatacattttgtggtgcttatgtctaaacagggataaagatatttactttataagtttatgatgaggactaaatgtaccaggcacataattaatgttaatactttccccattccttcatttttaattctcctttgctttctgttgccattttctacttttttcaaaagaatctgttggagccccaatacattaaccttcatgaaattgggtcctgaccatccgtgaaatggatgagtttgaacacttccccaatgtcggtctgtaaaagcacattttgaaagtggctttgaaggactgtttgaataataagatctattcatgatcacagagggccgagacaaaaggctgagacaagtctgtttggagaaaactctgtgtggaatgtcaatgcacatattagaacccagcctgtcaatttggtccacagagagaatggtggttttatgacattattggcaccacaatctaacaactctcaaccggctggggcattaaacatgacgaaggacacagatagactaccctagattttttttattcaaagggagcacatgtaatgttctcatgcaaaccagagaggaagtgagaattctttcatcttccttttctttgctattaacctcaatcacataactcttgggttaattttccttctataacgagaacaccaaacagaaaacacatgtgagaattaaataaacacagagtagaatgaaggctgaatctatggaatctatcaggacttgtttacagagaaggtaaattaacaatttcttggaggcacagttttcttacctgtatgataggaagaatcactgttggaataggcattagtgttagggatgcttctagaaagcctctctactagcatactttctagtctcaggacctttgcacatactggctctctatctagagatcccttccttgccgagatgtttttaggttaactcctcaaatttattctggcctttttccaaatgtcatcttctcacagggaacttccttaattatcttatccaaaattgtcatcctattaccgtctacctcctcattctggttgatttttacattggagcatctatctgatattgtatcatatatttacatgctgccttattaattgttcatctcctacaatcaagtgacagtctcacaaggtggggactttatctgctttgttcacttctgtgtccccaacacctataatagtacctgctacataggaaacactcaagcatttgctaaatgaatgaataagtaaataaacatgcaagattgttttggcaccaaaaattacagcatatagtaggcattctataactgttggcagaattaacgagtgtgcatatccatctgtgagcagaattagggaatcaccactctccagcaagccagtgtctctctcacttcacacccctgcagattgcataaggaatgtccagacactttctgtttccagaatgatgtaatgtggaaggagaagacctgcagaacatgttgctcacagacgagacagatgatctcatccccttcctgggcattcccaggctttgctattaaaaaaaaaaaaaaaagaaaagctgcaatgttcaattcacaggtggctgtttagtcctcagccgtttattggcaaaatactttaactcatctcttagctccctggtggctgggaggaggagaggaaagtcatgtcagatatcatctggcctatttcttcagccaaatggaatagatttaccctgagaaactaggacataaagggagagaagtgcactttagcatcagccacaggggacaagctgtgagcaaggggtgatgggggagtttaaaaaacaaagtaagccaagtgtttcattgacaccagagagctgagattgttcttgggattatttcaaaagtctagagcctgaagaaatgatgtacccaatatccctcacgtggctcatttttatttgaaaaatcctttagttttgatgtctgtgtatatattaaactgatcagaatttcaatttataggtatttattactctacggtttataacacatttcaatacacagatcttcacaaaagtcctgaaagtgaggggtatagaatgatccccctttatagttgaggaagctgagtttcagagaggggaggtaaattagccaagattgcacagctagagagcagcggagttgccattggaactcagatctagttatctttaagtgcaaatctccaaccaaatcttcaattcaagacttaaaaggtgacctgcttgtcagctacagtgtttgtatgcctcaaaggtttcccacatctcttttttccgtggttagctactagacaccttatttcagatctggggcagtttgggatggcaagtctgtgcacaaatcaagctgaagtccagttggatgtctcctgaacaattagtagttttgcaccgatttattaataagccaaatagtactgtcgactccaccctccaaactcgcccctcctctcttttctatccccttcccaccaagatgttttatttattttttttcagaagttggtgttagcagctggtcaagtcctaaatacaaaatcatcctttccacaaccatgtttcccatccaatccatgataaaattatccaattttcattgccaaaatgcaccttgactctgtccctttttctccatctttatggccaccaccttagttcaggccaccaatcctgagccttaggttattatatctgcctcacagctgctgactctccttccactcttgcttctctcattcatcatatgcaatgaacacaagagcaggtgtttttgcatacacccatttttttgtgtgcttaacctctcaaggcattttgatgcatttacaaaatcctgaagccttaacgggaccataggctcggcttgatctagcccttggcaaccttgacaaacttatttgtgcccatttcacacttgcttattttattctattccagaagctgctgtgtagagagaaagctgctgctgctgcttttttttttttttttttttttttgagatggagtctcattctgtcaccaaggctgcagtagtgcagtgacacagtcttggctcactgcaatctctgcctcctgggttaaagtgattctcctgcctcagtcttccaagtagctgggattacaggcacgtgccgccatgcccagctaatttttgtatttttagtagagatggggttttgccatgttggccaggctggtcttgagttcccgaccttaggtgatctgcctgccttggcctcccaaaatgctgggattacaggcatgagccaccacaggtagccaagagaggtagcttcttgagagtaaaacacaccaagaagaaagtagagcttggatgctatgagagcgtgaacactggcgatattgtttgaggccctgagtgcatttatgccttaagtgctgcattgagttattgagccaatatatcttttcctctgtgtttttttaaatcaaaatcaagttgatttgagtttattgtcacttgcaacaaaatattactggatttccacaaattcacaatcagttggggaaaagtcgatatgtgaacaggtaaacactgaaaatagatggtttgtatgatacaggtgaacacgagggcctttaaccagtgtgggtgttgaggtgggggaaagtgtccacttccctccaggagacaatatctggtctgaatcttgaaatatacttagcagttgtcatgatgtatctatcaaacagaggatggcagagagacattccagggagaagagaaggcatgagtcaaggcatggcgtgaaatgggatgatagtttctgggaactacaagtcactcatactagctttaatgcagcctggatggtgaaggcaaagggagagatgctacagagaaaggcacaggccatactgtgaagtgtccaatagtttgtcctaacaagataatgttatcctgggaattttgagagagcattgagaaattaatttttccactttaaaaatgaacattctaatccttccccagcctatgtaccataaaagatgatggtgaaggtctcttagtaaaatgtctgtgaaaatgctttgaaccaggtataaattggctaattatactatggaaaacagaaactggaatatgtttgatgtcttctagtttccaggccctggacaaggagagagaatctgatatggtttgactgtgtccccacccaaatctcttcttgaattgtagatcccacaattcccatgtgttatgggagggatctggtgagaagtaattgattcatgggggccggtctttcccatgctgttcctgtgttagtgaataagtcttatgaaatctgatggttttataaaggggagtttacctgcataacttcccttctcttgtctgctgccatgtgagacttgcttttcacctccttccatgattgtgaggcctccccagccacgtggaactgtgagtccattaaaactctttcttttgtaaattgcacagtctcggttatatctttatcagaagcgtgaaacggactaatacggactcaacacagaaaggagaagttgagaggatgtgtaggtgggttttgtgtcccatgagatttcagttcctggcagtgaagacctcaatggtggggcacccttggaagttgggccacatccttatagtgagaggagaaaacactgcttgtgtagttagcctatttcacaactgaccagagtagggcctgctccctacccttctgtgcctccccgttgcatcccaataacatgatcccaaagtagtgtttctgattcttaagttcaaacaacttcagtggtcaggaactttgttcccagaaactgtttccccacgtcccttcttatattacttcctgtatgtgttaacactctccccacccaaccctcggtcattatatagttgaacaaagccaagagtatgccacagtggcaggttcgcacatagtcagccccagcttcagtgtggggacatgattgaattctcggcggctttgaagcctggaaagcagggttgtaattgacaatgcaccaggacaagcatttgttctcatggggggtctcccatccgtgagatcaagaatcctaaagccacatttttggcatcagcctccctggaccattcagtatgaccactaagtgttagattgactctgggctgattgcttctgctatttagtgagttgagatgatgagcctgagctctgagatgttgcaatatgagtctgcccaaataaaaccacttaggattgtcacaggaaacaaaataatgtgcctcttcagtttaagggacaacttggctacatttggaatttaaagagtctctcttccttttctcagtcaagggtacaaagtgtgttaaagtaatatgagatgctttggctaagtattcaattatctcattcatttacttaacagttattgagaacctgttctgtgtcagaaatggtgctaggacttagataagctgaataagacactgccctgccctcccaaaacttgccatccaacagtggtgttgagcagtggtgctcactctcaactagaagatgaaggattccatttcctttccagctctgccacagtgctgggaatacttgactgtaaggggagagctttctgtttacaagcattctatttcagcaaacaggggagtatcttataatcaaggcattataagtcctgcagatttaaacttaatctctcaattgctttatttttaatgccacaaatattattcagaaaaaatatatgaacccattaaaaatcagtgcaaggtctggatatataaagaggccacctggctgggtgcagtggctcaggcctgtaatcccagcactttaggatgccgaggcgagtggatcatgaggtcaggagtttgaggccagcctggccaacatggtgaaaccccatctctactaaagacacaaaaaattagccgggcgtggtggtgggcacctgtaaagaatcatttgaacctgagaggcggaggttgcagtgagccgagattgcgccattgcactctagcctgggcaacagggtaagactctgtctcaaaaaaaaaaaaaaaaaaaaaaaaaagaggccacctgaccaaatgttaagggaggaggcaaaaatatttattaaattttgtaattattcctgatagactgcgttgcagaattcaagaatatatatgtctacaaaatgaattaagcacacacaatgttcagttgttaggcaaattggtatttgtggcttgccgattaacaaagaactagacctcaaacaaatcagatgcatccaaagtactggagctctgcaaagctgttagatgacttataatggctggaatctgatatcagaagtttgtataaaatagattcatgaaaactaagagttggaagaaaatgcaattatattgcattaattgaaaatgcaattaatatttctaattttatgacttttaatatgtggtaatttgataaatatcataagtggacattttattatttcatccacatttctaatgtttaactatataggttaaacaaagagacaaacaacttgttgtcttgtgctcgggcacccgtggtaggtggctgatatagctggttggttttcacaaatgtaattccatctctgaatcttggtgccttcatctaggaaatgaaagtgatgaagtgcctgcttcctctctcattttcaatcatggtgctgttcaaggcagtatgctatggaaaattgtacatctacacattggctttgagtttatttaatagcataaatattattcagagaaaatacatgaaaccattaaaaatcaaccttagggctggatatataaaaaggcatgtttccccattttattcctggctcattgagttggaaagcctccttaaacaaacagacctccagaactcagcaaggcctgcccctgctcccagattctaaatgcaaaaaatgaagaatattttctttctcccatttgttgtatagatttagaatttagaagacatctcagaaggaagaaaatgatgggtggcattctgataacattatctcctcactgatgttttgttcttgctgctgttcatatggaacacagtagtaagtgttgtgtgaggaatgcaattacgtttaaaaaaggaggtgtaagaagctattatagttttgaaacacataaaggtgtctaaactcacttttctctgagttgtgttgatctgccacattagccgtccccatggattggaccatcctatgtggtccatgaaatctcccaagatatttcctgtcaaatggcctctgccactgctatatttatttatcttattctacgagactaaaaacatagttcagctatttaggtgggctctgactagctattacagtctacatataacatgattagatacatctgtggaaaggaacgcatggtgagaaaatgttttattttctctaattaatgtatagtcttcagaacagaactttgggtgttctggatttgtgtttggcccatagctgctgcttttcactggagcaggaaaataatgtttaatagctttgtttaaaggttttcgcttgttccaaacttgttgctgtagagtctatctcaatctgtgtgtatttaagaaaaaaggggaaacaggctggaagcaaaattgtgttctggtctccacccaaaacaccccctattttttttctttttttttttttgcaaaccatgaaagccttttaaaagctgctttgattagcttccacatcactccccgcaacatagagtgagatgctggtttgtggcctaggatgagagaaaggggagccgggactctcacgggacagcttggccacttgagtcttccaaacccaataggctttacttaaatcagagatgcactggaaggagaccaggggccttttgagctctttacccatcactaattctggctccagctgtactccgactcgggtgatgaaagagactgaaagcagcaggactcagcaagcattctggactggatctattcaggctgcgtttactcactttgcattatggggtttccatggcaacaggcacatgtttcagcatgttacatgtaaaggggatgtacctgacagtcttcctggtcaggaaaatcggatcatgtgccgcttcttccctggttgtctaaatgggctctaccatgagtcagtctcccttccttccatatgatacccacagagaaagatgctggaagtcagcgtccaagatcctgaaacaaccatggatcccagtggagacatctgagaatagagtctgctccaaagacagctggcatggttgcaatacatcagaaactgaggctgagtctccttccctgctcttacttggctcctggccttggctgggctttgagggccatgaaatgaaaatattttctggatattggccattgtgattgtgttccaaggactgtgatccatgagggagctggtaccaaagaaaactccatgcgtgagcctgggatattcctcccctgcgatgtctgtctattgctcatatgaccaacctgagagctgagtgtttacagtttataggatcatggagtcatattcaaagtcaatctggtttagtatattagagtatgaaaaaacatccactctctttttcttccatttgcattgaccatagtccataaaataggaccccgcatcatctaagaagttttagaaagaaagtattggttctagctgggtgtggtggctcacgcctgtaatcccagcactttgggaggctgagatgggcagattgcctgagctcaggagttcgagaccagactgggcaacatggtgaaaccctgtctctactaaaatccaaaaaaaatcagccaggcatggtggtgcctgcctgtaataccagctacttgggaggctgaggcagaagaaccgcttgaacccaggaggtggaggttgcagtgagctgagattgtgccattgcattccagcttggaaaacaagagtgaaactccttctcagaaaaaaaaaaaaaaaaaaaaaagagaaagcattggttctttctagacttctcttttactcatccccacaggagaaagttagacttctctgatagtgacaagagtctgattttcatctgtgctcatttctctgagggttggagagagtatgctgaagactgtgtgacatgtgtctctcttgactttgtatgtgtctttgtgcctatctttcatactagactgcacttttcatttctttctttatgtagttcaggaatatcatttatggatagttataataattgagagtttaaaaaccagtagccctgaaaacagatctgatccaatgatgcatttttgtctcactcatagagtgattgtaaggttttgctttgaatattaaactttattgagaaactttataataaaatcctgaattttaaatttatcttggaagatctggcaacatgaggtctgcagtaattagcaggaaatgagtgcaggctgctaccctgggtgaggggctctctggtttgccagactgccttctgtgcccacatcatacatctaccatcctggccactccagtgcacgctggagtatgtgattccaagaacaagaggatgtgtgggtgacactaagcgagataattcctgattctctgttgaaagaggtttgtatgttaagtttgtgtgatgtatgacctgtccttttgggtggtttttgaaggctgtacaggaagccaggttgcccataaggctggctagggtaatgcataagctgcaaaaccagcttccccaagtcaagatgctgaggtctcattataacaccagatgtctaggcactgcagagacggcagacaggagggagagggcagcttcacctgggaagaacagggagaatggtactgagttgggctcttgagtgtgaatgggatttcaccaggcacagacagaggagaggaagctttcagagcagaaggatcaagaggtgaaaaaaaagcaactatgaagcacatgaaactcaaaagactataaatgctttggtatgcctaaaatgtaggatgtgtgatagggacctgggagagatgaggcaggtaacaaaaagtccttttctgtcaatggaaaactactgaaggttattttttaatcacttactaattacatcagtgatgcacaattacactctctttgaaaggtctaaaacattatagataaacttcttcttgacatctacctcctaatccttatcacctctttgtctacctagagtagagtttctcagcctcggtactgttggcatttggggatgggtaattctttgctggaggtctctctcctgtgcattgcaggatgtttagtagcatccctggcctccatcactaaatgccagtagtaccacccacccccatgatccacacacagtttccatagccaagaatgtttgtagatattggcaaatttccgggggggcaaaattttcccaagttgagaaccactgacctagcaggaactagtgttatccatttattgataacatgggacctatgtttacatttacctgtagatatatttactaaggaaagtgctctcttttcttgttcacatagttactgttattctatatgtatctcttaacttgcttattctcaagcccatgtatttgggatatctaaaaatgctagtgcctaggaagctgtcgggttttgttttatttttgaaatgtggcatagtattctgtgtagggatatataaccatgtatttatctacatccatgttgttgaacctttagcttgtttgcttctttcatttttcttttttttgtatttcaaataactttgcaattaatgtcctaatacatatttccttatgttgcatacagaagtttgcatcaggaatatggggtagacttgctgttattcatcttcaaaatgactaaaccattaactagattctttgtgcttctcagagaaatgcttctttcctattgaaaacaaccctaaagggaaaggaaaaaagggggacaaagaagagaagggcagaggagagagtgggagcaaagaaaacaaaaaggggtttaccagccactccactgattcaaactacagtgttgctgagcattggttcagaaaaaaaagttgaatagcgcaacagggtatttcagatgtcaaaggagacatcctggcacaacaggagggagggagaaggatgaagcttccaaatttgtttcccaaagcttctcaagacattgccccccaccctctgatttgacgcaaagccaaaaccagctgccttcaacattctttatcccaaagaaatgtgtccctttaattccctcttaagccatttatgtgagacataatttatgttctgaaaaaaaaaatcatatactttccacggacccctacttcctgggctgatagatcagcacagggcttaactctttgatgggaaattaataaattacatcgcccttgttcacctcactgcattagcaggtgtttgtatctgtcaaccttccccatggtctatccatggggaggagacccagaggttttgggattaatcagctctgatctggaggaagatgaaactgaagcatcctgttatggatgggtccttgacaggcattctgccacccaacctgcaagatctggcttcccctgtgaagtattttaacctccttgctcccctgattcaattccctgatgcttcatctcctatatacttgactgtccctaaggtcaagactgcaatgccttaagggcatgatgatgtctaaagcagccccttgctcctgactgtgctatgttgcattcaatttatctaagtaagtcacaaagtcagcccaaactcaaaagatagaggagccacaaagtcaaataacaaaagagactggatacagggaggaaattatagcagttatttttataaactatctacacgaggcaatttatgaagtttataaattcatatactctgtgaccaacaatttcagttttctttttctgagaaataagtacatatgtgttaagacattcattgcaattttatttacagtatcaaaacaacaaccacctcacaaataaactaaagtttcaataatatagttgtagataaacagaatatatccaaactacagaatactataccatatatatatatttttaaatggcagcttcctatatactagcatgtttagacatcctatgtgaagtaagcaaattacaaattggtacatataactaagtatgtgaaaaaggaaaaaaagaacattttctattgctaaatttacctaccagttaatacacagaaataggtgcatgagcatctgtagaaaatggataatactagttatcactaaatctgtgattctctactgggagtgattctgccatcaaggagcatttggcaatgttcgaagaaatttttggttttgacaccccgggggagggaatggtgtggctggcatctagtgggtggaggccagggatgttgttaaacattttacaatgtgcagagatgctccccacagccaaccattatccagtccaaattgctaatcatgctgatgttgagaatgactgccttatattcataagatgtgctgagctccagacatctggagtatccattgtacatttccagttgaatgctcaataagtaagacaaacttaacctgtataaaacactcctttaatgtctacacccctgaacttgcccctcctccaccctgccatcttacctggccactcacctgcctcacttcccacattgactccgtcaaaggacctgttggctctaccttcaaaccataacctgactgtttcttactcccttcggttactttcctatcacctaagtcaggccacctttgtatcttccctaagccacagaaaggggatagggaggatgaggaaggctggcaccatgtggccaggaaaaccactgtttagagaacgaactgatctcagtaaagtgtagtctctgagggagtgttggtgagaattggaatatggaaatctgcccttttttggtaatagaagaaaatgctaaattagaaggggaaaaaagcttcactcatgaaaacagcccactgattttcagggaggctgtccaagctgggtttgcatgtggtaatcagacattgtgagtgggatttagtcagagggcacagtagccctttgtcagggtggctacatggcccacagtttgccatggcaacaggagactgcccagtgttcttagggaggagaagagtgaaaatggtgcttctgggtgagtagaatggggagcctgtgaggtttggggctggcggttgcaatctcagccatttgtggaattgaagtgaatagctgatcaagttcaataagccctggagtttgaatcagagagaccagtttcaacacatcctaactgtctgaccttattaaacatttgagggtctcagtttatttatctgtaaaatgggtttaacaaccctggctgtcagggctcttattaagaccagtactttcttcccgcggtgacaccatcctgtgcagtctgttaagaaggcttcttgagctcatatgcacttggcaggacttgggatcaggtactgccacagtgggatttagagggcagcagaatttcatgttctcattgtaaaaacaaggtcgctatttactgccttagagacttccttaacatcgccacagcaagtaacctaagggaccagtcccaaaagggtggctaaattagaattacccacctttacataaaagaccaggaaatcaatccctccaatcttacattcccattttaatcaattgctacaataaatagagaacatcagccattcattatcacctagattcatcgctaggtggctctgtgtagctcctaaattgaactattttcattcgttcctcatctccccaattttttcactctgtcctctcaaattcatcatctctcatctatatcctcaaattcttcctttgatgcttctctttatctttcttttccaaagggaaaaatggtagaccagaggctctaaggcatactgcagccctcacaaatggtaggttttccttccacatctctagttccctaaggtaggcattttctttactatttcccaacaattctctcctttctcaaaaattaataactgcattgaaaagcataccatcaggctattcttcccacttttgttttggtcatcagccatctcccaagttgcttctccagatggattgaacagtccagctcctacattactgcctttcttttcaagactacttctgtcattatagtgacctcttaaacatctactcacgtagtttaaccttgaactttgtcattgctggtaattgtgcgttttcaagattttgatttcaagctttctacctctgaccatctccttttgttacacaggaattttgtttgcttaggaacattgtaggataaaaacgcaatgttgctgaagatctcactttaaatataagacaaacatctgaaatgtaccctcatcatcttcaggcatttcctctacatttccccaagtaatccctgctccaattttctagcatgactttgtcacattttatcctctgttttcaaactcccatacccttatcccacctctcaccctcatgggtggcctctacagtgacaaattcaatgatcaattttttttattttcacttattcaacctctaaggaccacttggtcctattaatcatagatttctttttgaaacactttcttaattttgttatagggacagcactccttcctcattctctcctggcatattagtcaggattctctagagggacacaactaacagaatatatgtatatatgaaagggaatttattagaagaattgactcacataatcacaagttaaagtcccatgatagggtgtctgcaagttgaggagaaaggaagccagtggtggatctgtcccaagacctcaaaagtagggaagccaaaggtgcagccttcattctgtggccaaaggcctgagagcccttggcaaaccagtggtgtaagtccaagagtccaaaagctgaagaacttggagtctgatgttcaagggcaggaagcatctagcatgagagaaagatgaaggctggaagatccagcaagtctgctcttccatcttctcctgtctgctttgttctagccacactagcagttaattaggtggtgcccacccagattgagggtggttctgcctctcccagtccactgactcaaatgttaatctcctttggcaacacctcacagacatacccaggaacaatactttgcatccttcaatccaatgaagttgacactcagtattaaccatcacacctggtattccagtatttcctatttccttctaaatctcctttcctggtcttttgtcttctgcttgagcactgagtcatagagtttccaagggtttgatcctcctctcccattgttttccattccttttcctctttgctttcttctcttctctctggtttcttaggtattcccaaccagtcccctgacttgaaatattacctatatgttgctgagccccagatttattctctagcatgggtgtcttctctgagcaccacacctgtatctatatctccttttcatcccacttggatgtctataagaggttgatctacacacaacagacctccagatttctaccaccccaaacttacttcttctccagttttccccttaataggacatgttcaactgataatctggttgctcactttcttcactttgcatatccactccatggataagacccatcagctctctctttgcaccatatccagagctatcttctttcactctcctatcaccccaagtcaagccatttttatataatccttaaaccacagacattttctcccaaattgatatcttcttcttacttccctgtggtcttctcaccagtgtcctaagagtaatcctttgaaaagataaatcaagtcataatactgctctcttagccctttaatagaattccttcaaaagtgggatagaatcccaagccatggtcacatcttgtaagcccctaaacagcatctgacctggtccctctttctgagcttaccttctgccactctctccttgccttctctgctctagacatgcagactttcttgctgttactcaaatatgccaaactcacccccatccctgaactttatcgttctttctgttggaacattcatttacagaccttcacatggctaattcccttgcttcattaaagtctttgctcctatattaatcctcagagattatttccttgaccaactcataaaacataagactcctcacctccccagccttcatcactttgtgagccctgattcgatttcatttttcttcattacaccctcagtctgtcaccctttccttattagaatacagtctccattagagcagagaccttggtttttgttaagagtgatatactcagtgcctagatcagtgcctgacacattaattgtccccccaaccccaataattgctgaagaatgaatgaatgagtgagtgctatttttaagatcaaaggagagaagataaaccattaatttagtaccatataaagcacataaacatataataggctgtcaataaaatgagagttgaattcatagcacaacagcaccctacagcctttctaccatgacacttatgttttaaaaattttattaacatgtttttgttgagatacagttcacacattatcaaagtcttctttctaaaacatacaattaagtgatttttagttgtttcacaaagctgctcaatcatcactgctatctaagtctagaatatttatgttaccccaaaagaaaatttagtgtccattagcagtcacttgtggcagtctgccacagttactacttgaggccatcactatgacagttactgctgttactacttgagatcatcattacaagactgaacgaaggaggacaaacatagaaatgaaaacttaaaacaaaagaaactgttttaaagaaggggtccggggaagaagaagagggctccttgcttctagtgagcaaaggcagcagcagccctgagcttctacaacccttcatatttattgaggagaaagagcagggaggaggaagtaatgattggtcagttgcttgattgatcacaggttcccattattgctaacaggcctcagatgtgcgtaatcacaagaaacacttgtgactgggtcgtgacagccctcagcattccttctgggtgacagatgcagtttgtcagtttgccagcattctgcatttatgagaacagtttgctgtttactcatatagcctccagtggtatactgagttgatcatgaccctcactcttttggtctccaacagtcactcccatagtacctcttctcagcccttgataatctaataagccactttctgtttctatggagtttgcctattctggctattttatataagtataatagaatcatagaatatgtgcctgtttgtatctggcttctttcacttaccatgatgttttaaaggttcattcacattgtagaatgtatcagtactttggacttttttatagctgaatagtattccattatatgaaaacatatgtccacacataaacttgtacacaaatgtttatcacatagcattacccataatagccaaaaggtgaaacaaaccaatgtttatcaattaatgaatgaattttttatttagggagctgggagctccctaatggcaggaactgtgtcttattcacagttttgtacataagagatgttaggtaaatgtttatgtaatgaataaataaatgcatagctatgactactataataatatgcaataattaactattatattgacaataatgataataacaatattcagaatgatggaaattactgcttgattgaccttgttaggtttctgattctttagatttcagtccatttatcaataaaattgggcttatagtgatggttaacatgagatcagggatataatcattattcctatgcataaggttagttccccattgcaatccactttgccagaactgccatatgtgtcataacaacaggcgatcgctgggcatttaagatatgtattactaaccaagagtaaagtttccaccgcttgagaattctgtgtatcaaagttccagttctttaggatgaaaattatacttattctcttggatagtataaagttagttacaaaatgttatgaatctctgaggaaaagttgaggtaatacatattttagaattttaatgtttgttctatgtttttctaatttcaataaaatcactaaatcacaagattcctaagttgaggctatatctttattgttgtgactttagtgacaagcagagtggttagcacttagtaggtacccttttaatgttttacagatgactaaagagacagtatttgatataaaaaggtgtgaacccaatgctccacagattttgttcaaagaaataccagcagcagtgaattgaggcagagccattgaaggaaattacatctctgggacaagagctttttcccagctggacttctttttgaaaaaggggtatgacctcacacacacaggcagaccctcttccactgcaccatggcgaggcaggcagagactcatccacccaggctctgggtgactagcttgctgcaggagcaagccctatcgtgggacatcaattatataagccacagcatttcagactgagggacaaaagtagattatttgtggtggggacagagacagtcattttaagcaatatcttaaatgaaaagccagtcttcgtggctgagctttggggagactaacctcagagccatatggctgttgggaatggggaggctaatttcatctgtaaaatgataggcctggatgagataataatcacttttgtctctcccagccctgaatactctgtggcttctccaagaaactctaatgaggggaatgtagaatcccagaacacccatggccttaggagagccttgagagatctatgcactgccctcagggtactgctgagggttttttgactttttctgtagctgtgtacatccagtttctctctctgtgtgagttcagagcccctcctctgctcactcatgctcacctatgcgcacctctgtgtacacacatgttacctacacaacagagctgtggtccctgagggaggaagattttcagttaagctctagtttccgaagctatctctgtcactgctgtcactggtgtgcttctaaagcagaactctaacttccatctgtaaaattttctatagcatccattgccgttgggttgaagtcgaaatccttgtcactgcacccaagtcccttcaggcagagggcagccaacatcttcaggaccatccctagcacccatttcctcagaatttcttctccagctgaaatgaatgattctttccttccttccttccttccttccttccttccttccttcctccctccctcctttcctccctcccttccttcctttttccctccctttccctcctcttttctgcccttcctccccactcatgtcccctcccctctcctcccctcccctcctctcccctcctctcccctcctctcccctccccttccatcccctcccttcccctccccttccttctctccttctctcctctcctttccttcctttccttaccttctttcctttctcttcttccatccctcctttcttttctttttttctttgtttcttccttcctacctaccttcctttcttccctttttcttcacatagattatgtcttctctcatctggagcctttgcaaatattgcttgttttatgctttcacaagaacatgagtgatttttaaatatgtaaatctgaccacaactctctcctgctaaaccctgaatggctccacatcatagttagaataaaattcaaacatctcaccctccctatgtggccttatggaagctggccttgccttccttcttcacacagttttatgtcctctttggcctccctgtaacagccatagtcaccttctttttgtgccaagaacctgctacacctgctctgaaagtcagaatttcatgctagcacttctctttgtctgcaggttattggttcccatcactgcctggctggtttcttttcctctctggtttcaactgaaaaggaacttccttagagaggacttttttgtccacagaatctcaagtagcttatttcccctgaagtctgctttatttccttcatggcacaaataacttgttgatattttgttaataatttatttttggtcagctggctgaagagttgacactataagatcaaaaatcttgtctatctcattcaagactctatccccagtgtctcaaacagttgttcctagaacatactaggtacttaggacttgtttgttgaatgaattaatgaattaattaatgaacaaatgcttgaacatctattactcagcttttcctttctttcacatgaataacttctatgtatcttttagctgcttatttaaacatcacttcctcctggaagcctttccggaccctggaggatgagctagatgatcctcacctgtgttcccttagcagccaaatagatgacgggattggggagattaattgcacctgtaaaatgataggcctggatgagataacaatcactcttatctctcccagccctgaacactctgcggcttctctgagaaaccctatcgaaggggatgtggaatcccagagctactcttgctatcaactcgccgcatgaccttgggaaaatcatttcacctggttcagcaatgatttactgagctattgaaggccttactttccagatccaggtaagattgatgatgctgaagtcttatttcctctcaacttctcgttttccccttgacgatattcttttcaggagcaaaaactgtaacctgtacattgttacattcctggtgcttagctcagttgtgagcagttgagtgattttagaaactcagaataaattatttattctcttgctaaaaatatgacgtgctttctaggtagtcactgtactggcctctatgttaaattctctcaaggaggagaatggagaaccattaatcaaatgcctactaagtgttagtgttttacacaaatattcttcttgtattctcacaaaaggccttaataggagtaaacgctgactccattttataaacgtaggaattgaggctcagaggataattatctggtcgagctagaaaataggagtagtgtcctaactctacaatttctgctctttccactaaaccacggctgtactcccaatggtagggaatgaacaacagggctctcctaataattttattagccattctcaaattaatagctcctctgctggcccctcagaaagggggcttcatttagaagtctagcctcacaagtaagaacaactctggttccaggtacctattgggaagtggctgattgaagccagtgtcactccttgtcaggccccaattggcttgccccttccagtaggtcactcaacgtctgaccccagcagtgttttctagcaactctattctgcccatagataagggaaataaatggagaggcattcatagctggctggtgatgatttgtttgttgaaagaaagggtattggatgcaattctgagtgtactggtgccaggttctttcctccttggcatttaggtaactgccagggcttgtgtctgatcttcatattctccagtctaggcaggaaccagcttggtcaggttgttccctctgctgcttgacaccctgcttgacctctgctgactcatctaccaccctctcttagcatcctcataagttactaatggagttcagggggaagaacagctgccagaaatatgtgggcaaatgaaagtcctacattttaaagacaagttaaagctgaactgttccggataaaccagcagctttgtcttcctgtcggtcctctctaaatactcagtgtaaaaactgctgccttagtgagaactcttcctcactctggaaggagctttctctccttccacagagtctcgcccttggatagttacacgtagtcgtcctttctttttcattgttgatggggacagatgtcagagaaccggggtacaagtcaagacacccgactggaggacctactctagttaccaactcgtggcataaccttgggaaagtcatttcatctctttcaacattgatttactgagccattgagtggttcaaatatgtagtggtacgcattgtaatcttaagacgtttctgactctctctctctttttcttttttccttgggaaggttcttgctctgtcacccaggctggagtgcagtggcatgaccatggctcactgcaaccttcacctttcctgctcttgaactcctgggctcaagcaatccttccaccttgagctcccaaagtgctgagattacaggtgtgagccactgcgcccagctgactttttaattttgctattttaaagctatatgaaaagacagagaaaagtgcccacagtatattaagtaggaaaagcaagttgcagtatagtcattagaatatcatacatttgttcaaatgcatgttttcatatcatgtattgttttcataatttaaaataactaccaatacatcataagcaatctttagtaagtttatcatttgattgctcaatttattccaaagcctgtatgactgtctatttaatattagatgtttgagacacagaaaacacaaaaaaactcattgtcctagaggagcctaaagtttatagaatttatgaggacttatgtttcatttctaaaagattttgggaagtttttctgttgaggttgggctgcctctgtgtctgataactaggaagaacaccaacagctccttttctacaagaggtgtattgttcccattctcttcagtgccacatccttgctttagtgcttccactgaccttgtgcttcctgaactcctacgtaaccttagtttgtgtcagtaatgtagtacttaacaatacagcatcttctctccttagcccacctcctcaccatcagctcacctcctcaccatcctttctttccctagcccaccccaatcagtttctgtctgctctgttccactgaaaattttcttgttaaggttacaatgttgaagatgttttgctaaaaaaaaccaaaaggccaaaatccatgcttgcaacaattccaagaaattggtgaattgctgaggatgctgcctttcattctctggtccctgcttacacctgcagtctcacctccactttgcagctttattgtgtctttctcaccaccaaaccttcattcatgctgctctctccctgcctggaatgcccagcttcttcatctccaattagaaaattctcgctcacttttgcagtaaatgcctttctgttttatttctcccaagccttttttttttttttccagtttaggtatcatctatttcttctttccagaggaccctaatttctctttggggaattttatctcccctattgttggcagggataccctgctgatctttaatctaactcatttggtacagtcgtagaatgggcattgacccatgctaggccaactgggctttttcccaggagaatgcataaaatgtatggattcattcatttcagcaggccatctgggtccagatatcaggccatttttgcctccaacaccgtctagtgttacctcttttctatttcaagtctcttttttcgacattgtctcgtggccctcagagctgaccctccgagcttgttcataagctcccaacacatggctttttttcaagttatccaaagttggtttctgctccttgcaattgaacaacaataacaacaacaagaacaagaaaagactgatacattcttctagactcagataagggaataccttctctgcaactttttcaggcttcctcttttgtcccttcattggcctctagttgctctaatagattcctccactgtggcattataactgacctcttctctcctaattatagtctccttttgggggttagagatcatgtctcattccaagttttgttcctagagcctaagacatctttatcttgctggggcccggatcacattcattcaggagtgaatgaagaacctgaaattttgtacctatggggttagtatattctttcttgttgacagagatagcaacctaataggatagttttctctttttaggagctaaaattttatttctgtgtaattatccttgtaagagatttgacaagacctcactaaaggtatgaatgtcctgttccagcaggttctagtcaggaacatggaaagcaaatcagaaatttcaaatagaggggatttagtatagggaatagaccgcatgtattttagaaagttgatgtagcaaacgggatgttgaggtaatccagacatcagtaactgcaggaagtggctgcttctgtcagacagggagaaaaaggagagaaaggtggtgttatgagaacttacacaagtgcaaaggagaaaccctgcatggctgagcctcatacttctggaaggttcctgtgtcttgtgactggtgcttcagcctctgagtgggggcaccctgtggccaggcttagacatcttaaagagtgctcaaagactggaactcaggcctcagggagggcaaatgcttgccagtgctaagaattcggagatgggaactgaaaacttgagttcagacttggtgagccgctcgtgttggtctctaatgaggaatcctgtggcaggtgctgggagtgcgtaaggaagctaaagaacggaaccatagctttcttttcctctggaagcatctaacagggtctgaaataggaagagagtcctcttcatcctgccagcttctagtctcctgtcaatgtcccctgttgcagggctcgaatgggaagtgggctggcaaggagtctgggaagtgtagttttcagaatctcagcttcggtgtcactgagcgtggatgggggtgggaaactttgaggctgagagacactgggtaaataacagacatatgctcttccaggaaaaaaaaaaaaaaaagtagacttggcctccaaggccatgtgatgaaatacagtctccttgttttgtaacctgtttccaacatgattcccaataactctcgagtaagaaattacagcttgggataggacttctgtggaaaaaccctggtgccagtgtaaaaagtgcctccaaagtcaaagcattcctgttagtcccgacacatagagcccatgatttattgtaatttttacttaattctgcctccttctgtaggccctggttccaagaacgtcttttgggcccgatgcctccatggctcagatacttgggaacagcaatttgccataatgtctgctgctcctcaggcctccctgccaaccccctggctgtgtgcagccagccacaccctattcctccagattgcattgctccatgtgttttttcttccttggaaacagaatgccatgtcttaacctatcccatcagcagactctatttctttttttcttcatttttcactactttttgctcatcccttaattctgatgcttggcctatgtccctggattttttttttttttaataacgataatgctcttttcctagaatcttactatataaagagcatcttgtaataacagtgacagtgaaattttttggctccacgaagctttagattactcaagagcttttaaaaatctacaacttcactgattcaatattggggggaaacaggtcatttggattcaattaatgatatttaaatcctgaatctaatttaattagaccacctttatctacttaattcctctgagccttagtttcctctactttaatagagggctaagacctacctctgaagattgctaggaggattaacataagctctgtgctacatctggcacatagtaggacagaataatcttagttctctttcttcaagtgagagtgggtgtggtgctcttatgcatatggagaaaggaggccatataaatctgtcctgagctgtataatggatttcacaataagaacaatgagaaatatctgagcaatgctatttggaggataatttttttttctctgttcctatagaaaaatgggagtgatattatcatcagatgaatttcaattatggactgacttccccaatgtaactttacccctgtacttatctattatttttgtatgtgtgagagagaaaattcggaacaaaagcaccagactgggacaatatggcgctgttcctagggagagaatggtggattgtaagacttgaaagttagtcttgtgtcagactatgcagattcctgaatgcctggctaagtagtttccattttatttcttaggcaatagaaagttgaaaccaaaaagggtaaaataaataaatgaataaataaataaagaaccttgtaaaatgaatttgacattttatataatagctcttacttgaggaatgacaggtaacaagattcagaaaaatgtaagatccaaggagattcatctttggtgagaccttttttttctttaaaggactttaggaaagacatacttaaagtaagtgctagtagatgaggtgttcctttcattttattttccattttttcattcacataaatcatgacttgtcattgtttgcttcaaacacaggagagattttacctgtgggtttattctgttagaatttgtctatttgttgtagagcaggatcattgctgcatttgctaacattctgggtgaggagaaagatgcataaagagatcagggtaaccaacatggtaagcctaatgacaaccacaggcagatatgagtccctcaaggggggaatttagggcttcaggaaaagctttctgaaaacacgcacacaacaacagaaaaagatgagcgagccaagtcttagggaatgaggagtcatcatccatgtggaggaagaacagagggcaccacaatccacatggaggaacaatctgagcaagtgcacagagataagacacaccacactacctgaggacactacaagcaatttgtgattctggagggtagcaaagcagagagagtgaggagagaggagctgaggagtaaggcaggaccaggaggaagaagttcttgtgtgctcagccaagaaggttacactttatcctgccagtgatgtggagatgttaaaggtctctgagcaggtgagtgacactgtagaatttgttttattctgttctggtggctgcataaaagaaggaaaaagatgataggagagagaccagattggaggcattgacaataacctatgtaggcatgggaggcaaggactactgggggccaccatggagtatgaaactagggtctgtgggagttgatgactgagtgaaacagggaggtaagacatactgaatgacgatgagtctggccatgatgactggtgaacgaggttaccaacaccaaaacaaggaacacaaaaggaggttccatttggggagaaagacaatatgttaggcttaggaaaggatgggtttgaggtgccttgagaatgtagaaaactatactcctaaatcaacaggcagtaattggtagaccttgggtaactcattttatcctctgagcctcaatggactcatccttttagaaggacacaataatatctagtttccagggaaagatcaatttgcccagtgaactcaaagggttgcttttatcaaactcttttcattagcaccatctttacattaatttataaggaagaaacaaacaaacttctctttctaaaattgaccacttctcccttctgagccaaggatgctctgttagtcatcttaagcttcagaagtttttctaccctttaggactggcctttgagctttatatgtgtccatgtgtaatattctttctgtttagtcttcatatcaaggtgacaggttacagcatgaaggtcctggggtggatatatcctttttgagaatacatatcaacaaattcaaaagtctggagaagtaaaggtgattcagaaagtattttgaaatttgtgaaagttttccaaataatcttcatatttatttatcccatatcatatttccaaaagttgtaaaatgaattttactgttaaatattttgtccttcttttccaaaataatgataaatagctttctcatctctgtaaaagccatctattttggactcaaagcttccttggactcaaagtttcctttttatttattttttcagtggcaggacatgaaggggacagagcgaaaaccctcagcccacatttactactagtaagccatgaaataaacaagtcctgaccatccttaccacatgttttcttggaacaaaagggatgtgggtatgacagatccaacttttgctatgaactgtgaactagcatatttttaacttggcttctgaggttggtgaaggaaactttcttgtcctttgctaataaaatgcagatggttcttcttccaaagttcctaaatccccaaagtctgaatctcatcttcttcaaggataagaatagatttgtaattcagtaagcctcaatgggcatcatcaccattcttccttccagatagctttttaaagtgcttgacatataataagtattcactaaatatgtattgaatgagtatataagaagacattgccaggcgcggtgggtcacgcctgtaatctcagcactttgggaggccgaggtggatggatcatgaggtcaggagctcaagaccaccctggccaacacagtgaaaccccatttctactaaaaatacaaaaaattagctgggcgtggtggcaggcgactgtaatcccaactactcaggaggctgtggcaggagaatcacttgaacctgaagcagggcggaggttgcagtgagcggagatcacgctacagcactccagcctgggcgacagtgtgagactcggtctcaacaagaaacaaaacaaacaaacaaaaaaagccacattatcagtaagcttagagtctgagctcttagtgtaaatcctggcattgcaggccattatcaagaatgggagaaattaccgggcaccatattagaagaaagaccttgaagtcagttaggtcaggattaggatcctggttccacctgtcctaggcacatgtagggaggagttgggtcaaaaaacatagctgctctgagactccatatggtgtagtggttaaacatcagggcttttaatttgaatactggttctgtcataaattatctagaggaccttgggccatttactcaaacgtctttgttttttgacctttaagtggagagaataattgtacctattgttataagtttgctgtgaggatttatgagttaatatacacaaagcacttcagtagagcatgggacacagtaaggactttgtatgagttaactattattctgttatttttattctactacctcgtgctactacagagtgctactctgtgagaatgtacacttcttttcctatggacaggttccatagttttcaacatcatgatagtggtattgaggcagtcatttaacctcagccacttcgggttttagttttcagacatgccaatgagacaatgcttcctatccctgctggatagataaagcataggctttttgtgaggcgcaaataagattgcaaatgtgaaaacacttagctgactctcaaatgctctataaatgtgagtttattagttggaactctttctactacaagtgacaaaaattcaactcaaatcagcttatgccaaaaaaataatttattggttcttgcagctggattctagggtagctcaaagacttgaaggaagaactttaagaactaggacattgggaacccaaattgatggccattgtaactggaatacacagtttatacctatctgttatctctgatggctgcattctcctctacacagccctctttgcacgtaatgaggaagatagcaccagaaacctcgcttcatattactttaagattccaagccagcaatatatatatatagcaatatatatatatagcaatatatatatatatatagcaatatatatatatatatgattaatttaatctcccttctaaccttggattgattgttgggtacatattaaatggaaaggattgtggcccaacttttttagcccttggtcacaactctttccatttaatatgcaaagaggaatatattaccagaagaagaaataaagaggaaaaaaggtactgggaagattttttttaaaaattactctcatagattatcactactaacattggtttctttaacttctgtagagatgactacaatgaacctctctgtgtaagtgaaagactagattaaatatactccaagcccttgagtgttttcaaatttctggccgagacaggttatcaaaatattgatcccattagaagttgtctttgtaaaagaggaatcctacccacagagtggtcttaacctttgaactattgaccttttgggctggaaagttctttgttgtggaggactgtcctgcacatcctaggatatttacagcattcctggcctgaagatgccagtagtaacttctccctctctatgataacccaaaatgtttttaaacattgacaatatcccctaagggacacgccttcccacccctgcctttgagaataattgtactagtggaacacagctaagcagtaattcatacttctctattctccactcttattccaaaatgatgggtgtaatgctggccagctagactggttttataactttttaaccttcctttgttccctctctacacatttcattacactgaactaccccaccaatggacatttgaaaggtcatattgttgaaaaagactgcagggcacgtgactcaggatattttgggtactagtccttcttctgccactgacttggggtgtgtagctgggcatctctttcctctctgggccttggatttccatattggcaaaaactgaaagatgtcctgtaatttttcgtgttactctagcatttatgatacaattggatgagatatgaactatgaaatgggaaatcaccctacatatttcattagttgaatagtttgtgattaagagtctaagtttctcacaagcatctcttttgtttcttggaagttaagatcgcacctggttgcttgggatgtacagggagtctgggcaaaagcaaggataggtgtattagtctcttatcatgctgctaataaagacatacttaagactgggtaatttataaaggaaaggaggtttaattgactcacagttcagcatggctgggaggcctcaggaaacttacaatcatggctgaaggggaagcaaacacatccttcttcacatggtggcaggaagagaagtgagtgagtaaaagggagaaaagccccttataaccccatcagaccttgtgagaactcattatcatgagaatgtcatggagggtaaccacctccatgataaaattaccttctattggttccttccatgacatgtggagattatggaaactacaattcaagatgagatttgggtggggacacagccaaacaatatcaatgtgcttatagcagggtctttgctgctacttgatgttttgtctctgaagattccatctgtggctagaaaaaacagtatgaagtggaaaaccattcactgatactgaagcataatgtatgaggggctggaatagtaagaaatacagtagaggactgtgcagggccttggatgccagggtaatggacacaacactgatacccaaagaggggggtaaggtagaatgcataatggaacaaatatccatgtaactgggtgaattatttctcatctttatgtttaaagttcagaaagatggtagagtagaattagccagatgcattttggagtagataatagtttgctgcctctttatttttcccatcaaaattaaatggcttccaatattcacataattgagaaaactgaggctcaaaaaggaggagtttacaactccacagtgatcacattgtgagttagtggcagagtggagacagccagccaggcctcagaacaccctcctcttgccttatataattaattcaataaaaggagacacattgatgctggtttttccatcttgctttcctatacctccccattcttgggagggtttttcactaagatttcagtattattgttgccatttactcctagctagaggcatcagaactaataaggtctagaacagagttcatggagcaaatgtctcctctctacttggctgaaaaaaaaaacaaaaggaaaggaatgaagatgtcagttgtgttttcagaatgagctttccagcagatggagatgggaacctatatatatttttctaacactatcttctagtttctagttcctgtattagtttccagtgcccaccataacaaattactacaaatttcatggcttaaaacaagagaaatttattatctcaggtcctggaggccagaagtgtgaaattactgttccttgtctctcccagcttccagtggttcccaggtgttccttggctttggccagatcattccaatctatacctctatggtcatccttcctcctttttttctctgtgtgtcttttataaagacacttgtcactgtattaagcgtccagtcagataatctagaatgatctcttaatcttgacagcttcaatttaattacatctgcaaagaaccttccccaaataaggtaacaatcacagattttgagtattaggacatagatatatgcttctggacaccaccatttaatccactacacacaggaactgtatgtacagtgtctcatcagctcctcacaagtctgtgagttgtggatatatataagcattggcttttgttgttaaattcattttaggatgaaaacatgcagaaaagaagggtttttttttttttttttttttttgagacagagttttcctctgtcacccaggctggagtgtaatggcttgatctcagctcactgcaacctccacctccctggatcaagtgattctcctgactcagcttcccaagtagctgaaattacaggtgcccaccaccccacccagctaatttttgtattttagtagagatgacatttcacaatgttgaccaggctggtctccaactctcggcctcctaggaggccctatctttagaggacatatatacagatacactatgttgaataggggattcccattagggtattgagtttgacccaattattattctcttaacggtttaaaggaaccttgactcaactctgaccccgtctctatttagctgtgaataatttttaatgagtctgtttgcctcttgctcctcagattttccaagtgtgaaacgagcaatctgaactatgagctctcacttagtttatgagtcaaaccttccatcaaaatcagtcctgaagaccaaggttttgaaggaataatgccatctttacaagtgtaacttttgctgaaaatattcaaactcttcccactacgactcaactagtgatacaaaatccaattgctaggaagctttaggattcaccctggtgaggaccatcttccctgaaatactcttttcttctaggctatacctcttatttcaccttcaaaacccatcttaagtattcctccttccctgatcttcctaggcaaaattcactaatcttaccatcccctttcccctcccctcaatactttatgttgtgcatgcttgaatagtgacacttatctttatatataattattcctttttcttatctcactcttctaaagtgtgagtaaatgcatgaggtactcttaatattctttgagaagatgtcaagatgaggaacctacactctcacttttcttcttgatagttgattggaagagtgccagagctgttagaggaagaaagtctgagttagtgaaatacagaagacattttttaaaagaagtctagtgctgtttttcctttgtgaaagaaattgcttctttgtttttttcctcttgtctttgctttccctcatccttttctttctgttttttaccgtttattttcatcctctatcaaacatgcatgctgagctctaactaatttgcagttactcctacgcctaaagataaagagataaataagccactgtcctgccatcgaatagctcatagtctcatggccaagatagttgaggaaataattacagcacatcatactatatcatatcatttcatatatgacatatatactagttaacatggtacaatcattgtattacatatttttacatataattttaatctataatatgtaccatattatacactacaaggaggatgtgccaatgctttagcagtcctcctcctggctttaggagaagccatatagaaaatgtgttagaaaatgaatgtcttcatcagacaaaaaaaggaaatttagaatggagcacactcaaaatctcagagactgtgaacttgaaaagcaaacccaggcagatatatgataatcaaataaaattttctatgtccacttttttcatggaagagctatttttaaggcttacttgggggttccagttcccacggtagatgttgtacctccactagctctgcaagacagtgggctgtgccaacatcatcatctgcctaccattcagatctccatccaaagcagacagcaggatactagcaagctgagactgagcatatcacccttctccctgaacactcagcctagtttgcattagtccccttctctgctacttcagactccacagaaaccatgtgtctttccattgcaaagttaatttgcaaaacactcaataaacttctaattttattttattttcctgggatctgatgttgcaaataaaagaaaattataaaatgggggcaattactgattgggctgttattgattactgtgttattttaataccaccaatagccattaattatcaggtcataaaggtacaaagcataagctgatttatcataatatccctgtatctttgactgtgcttggcataaattaggtaaccagtaaatgagaattaaattcagttgagcaagtttgaaggattaaatgaagcaggcattattcattttctttatatatcagaaatggatcagaatttaaccaagaagggagctgacattccccttgtggtgtgctagttagtccaggagctatttcttatggtacgaaacacacatactctcctgttggggtgtttctgtggctgacttgatggaggtctgcgtgcatgacctttctcttttcagccctcctctcctgcattgcatcttacttcatgctactgactataaaatctttctgaaatgcagattagatcacctgtccaagattctgtttattttcataccatttgtgatggttaatactgagtgtcaacttgattggattgaaggatgtaaagtattgttgctgggggggtgtctgtgagggtgttgacaaaggagattaacatttgagtcagtagggtgggaaaggcagacccatccttaatctgggtgggtaccatctaattagctgccagcatggctagaatataaagcaggcagaaaaatgtgaaaagactggcctggcctagcctcccagcctacatctttctcccatgctgtatgcttcctgttctcaaacactggacttcacgttcttcagctttggggcttggactggcttccttgctcctcagcttgcagacagacggcctattgtgggaccttgtaatcgtgtgagttaatgctacttaataaactcccatatatataggatatatatatatatataaaatagaatatatatatatcctattatatatagatatatatataaaatgggatatatgtatataggatatatgtgtatatcctattagtttataggatatatgtgtatatatatagatacatctatataaaatgggatatatgtatataggatatatgtgtatatcctatatatatatacataaatatatcctattagtctgtccctctagaggaccctgactaatacacgatttaagaaaattgtagtgagaacacttaacatgagatctatccttatacgaaatctttaagtgcacagtacagtattgttaattataggcataatgtttacagcagatatctagaacatttgtcttacatagctgaaaccctatactcactgaacacaactcatttctcctctctggcccctcacagccaccatttggttgtctgtttctatgagttttactattttagatctctcacagaattagaatcatgcagtatttgtccatttgtgactggattattttacttagcttcagtgactggattattttacttggctttacagagtttattcatgttattgtatatggcaggatttatttctttttttaaggctgaataatattccggtgtgtgtgtgtgtgtgtatgcaaatatacgtatttttaaggctgaatatttcattgtgtctgtgaacacacacacacatacacatatatagacatttaggctatttcttggctactgaataatggcttgaataacatatattagcttgaataaatgctgcaatagatatggaagtgtatatatttctttcagatcttaattttaattcttttggatatatacctagaagtgagagggctaggccacatagtaattccatgtttaattttttgagggaacttcacactattttccacagcaactgcaccatttttacattcccaacagtgtacaagggttccaatttctctatattcttgccaacatttatcttttttctgataatagacattctaatagttgatattttattgtacttttgattgcattctctgatgattaatgatagtgagcatgttttcatatacctattggccatttgtatgtcatctttggagaaatgtctactcaagtcctttgcccatttttaaatcgttatttatttatttattttgctattgagttgtttgagtttcttacatatcttagatataaataccttgtcagatctttggtttgcaaatattttctcccattctgtatgttgcctttttactctgttgattgtttctttcgctgtgcagaagattttagttcagtctcacttgtttgattttgcttttgttgcttgcgcttttgatgtcacgtccaaaaaattattgccaagtccaaggtcatgaagcttttccccttcatgttttcttttaggcattttatggctccaggtcttaggtttcaatctttaatgcatgtttagttgattttatggtctcacttctgcctgggcctaagccccacccctcagacataagcatactctacacctgcatggctgggcagccctcaaatatgccttgggttttctcgatccttcatggctgcacatgtaccgtgttccaggaagatacctgttcaccatttctccatttgtttgacttttttttttttaaagcccatctcagacctgactacctcatggaggctttccctgaaagcccatggcttgattagggaatcactcttccttttttcatagcctgtgttttctctattggtcatgtgtgtgctgttttcttcaattcaactctgagttccatgaggataaagataatgtccttgttcttggtaacattctcatttctaatcataggacctagcatctactagttgctcaattcataggaaggaaggaagaaggaaggaaggaaagaagaaaggagaaaggaagaaggaaggaaggaaagaagaaaggagaaaggaggaaaggaaggaagagagaacatagagggacagttatcaccaaatggcagcagaagaccatttggtgatatgaccatcctagaggaaaaaaagtgggcacagggattgctacactctgaatgtttgtgtccccctaaagttgatatgttgaaagctaatccccagtgtgatggtatttggaagtggggcttctgggaggcgattagatcattaaggtggagccctcataaatgagattaatgtcctttttcatggtgatatggttaagttcagcaagaattattttatgtataagctcttcagaaagaatttgcaacagctgcccactatctggctttggaggatcaaggatgtgtggctactcagctactccataaacattctagggagctaaagaggaatttgctgttcaccctggaagccagtgggttgcttttgtttgttgtgtctctgctgccatgactcccagatgacaccccatctacataaatgttgcagcaaacagagatggagccaccaggtggattttttcaaccccaagaacctcagcaaaccagcagctgacaatgactgagagtgggccccaaacacaggggaaggaatgtggatctgtctcgatctgcctcatgtgaggggaaatgataaagaaggagtcataacagactggcagcaactcaagtatttggcactaaaggcctcttccaaagaatcattttcaaagatgggtctgcacccctgcagaagttctcatgtttctataaatgctatgcttgtctttctttcttttttctttatctttctttctttttctcttttaaaaaattttctggtctttcagtgtaaagaattagaagggccaggtctcaggcatcaggtaaagactggaaaaaaatatataaggatgtgaagcaagcacccctttggagaaacagcaggtctgtctggaaggtgtccttctgccctcagggaccttctctttatgccagcaatgccaggcccactgagttcttcccacttaccttggtgttgacccgatgcctgaattccccatcactttttccaaatggctttccatctcttctcttctcttgactataccctggggaaaagatgctctttgggcttctctttctactttataaagtaattccctgctgacaacagagtataaccatacattcttgcctgactttccttcaaagtcatgtctaccttcctctcatgctcttgactttttattcattaatttcctcatttcttctgtgtctgtctccacctgttccctggatcttcagcttgcagggatccccttgtttatcacaattaaggtatacattggcttaaaaccctattctacagatggtgggatctcaatgtcctataatgttctatgaggactccagggattccggccctggttcaggtctctcttattctccatctcttcacttctcccactgccattcatcaatgattggcaaacatttccttttaatttattttccccaaactcaaagataataattgtggatagcagacttttactgacaatccaacatcagagtatgcatgtaaaagtgtgcaactttacagctgatcatggaaattatttcagctcagcctgcattcttactatttctcttcctccttctctcttttctagtactttaaacctccttctccaatattgtggtttatttcctgggtaaaactgtttaactgttttatcctagccctcgccagtgccacttttaaataacaaaataacccatgagagatttttgctacttaaaggccattctctcccttaagtacagtttaatcactagatattagtctaacagctttctgtactatacatttgctcagtcgacaaatggccttagtgactatggatgtgaaaaaggaaagattcccacttttctcctgtagttcgatgctttacattatagcttctttcaagtcttgagagcaggtgccacatttcatttgtttttatattgctggtgcctagtatcatacctagtatgcattgacaatatgcagtaaatgttttatggcaaagtggtttcaggtattgtcattaggcacctttaagaggtgggaagatgagactcagaaaacttatgtcgtgaagtcttaatcatagagtaaatggcagagataggtctggaaacacccaaatgttcagacaccaaatatcaaactttttcttctctatcatattagtggcatgtttcccatgaataataatttattttttcagattttacacatatgcaaaattgttcctttcaggctgattacccatccctacaggttcatcccccactgcatttgtgtgagaatgggtggtgggcaattgttgagggagggcacatgcagagcccattcttggccctcactcaggtaccaggtgctccagccatcgttacagctgactgctgaagaagctactgtaagtcagttcaaagagtttctgggctcttttttacacagtcagtccttgaaggcacaaactgggccatagcagcagaaaatgaccatcctaaaggaaaaacaaatgggcacaagggattgctacagtctgaatgtctgtgtcctcctaaaatttgtatgttgaaacctaatccccaatgtgatggtatttggaagtggggcgtctgggaagtgactagatcattaaggtggagcccttataaaagggattagtgcccttataaaagagatcccaaagaacttcttcatccccactactatgtgaggactcagggagaaattgttatttctaggaaccagaaagtgggttctcaccaaacaccaaatcttctggcaccttgatcttgaacttgccagcctccagaactgtaataaataaatttctattgtttataagctaccttgtttatggtattttgttaagcaacccaaactgagacaataatgttgcccagtatatcagttttctattgttatgttacaaatcaccacaaatttaacagctaacatataacacaattatctcatagtttctgtggattagaagtgtaagcaaagacttagttagttctctgcttaaggtctagatcttaagccaacagctttttgcaccatacatttactcagtaaacaaaaactgactacccttgagtatgatatcctaggccctactgactatagaggtgcaaaaggaaagattcccactctgcaatcaaagtgtcggctgggctgtgttttcatctgaaagtttgactggagaagaatcaatgtccaaccccattcaggttgttagcagtattcctttctttgtggctgttcagctgagggttttagcattgtggcagctatcagtatatttaaatttcttctttctggattattttaacttccatttcaatgaaaacaatataaaaatattccttaagtataagtagtaaaaattactcaaaaatcatatgggcattaattttgaagtaggtattttactatgaaattcaatctgaataagaatgttggaaatctttcctgtggaaataatgatcaaaatagtatcaagatgaattgatattttttttctttagcatacgaacccataaattgaactgaattcaggagaattgcttgggcttaattagaaaatcccaggtcttcagtaagtgctactttatgacttcatgtacttccctaacaatacccttctctcctctcctgtaacccctatgtcttctctttcccccatttatgggacttctactgctctgtatcattcaccaaatctcttgtatggcctgaattaattatttgagaagtcctgaagacttggttggggactaggtcccaaatattccaactcctaaaggctcaattcagctcaaagcatgcttacttggaattgggtatatcagaattccagaaacttaatgtaatttttaagatgaaaaggctgtatttaaatagttgtaaatagtttgctcttttctggagtagagatgtggacttgctttaggaggagcagactgtgccttttgcttctgtttgcagagggacttcattgtaggctcttgcagtcatctaggtcatgagtcaacaaactttctataaaggaccagatagaaaatatgttatgttaggctttgcagtccaggtggtctctgtcacaactactcagcacttcattatagcatgaaagtagacctagacaatatgtaaaccaaaaagcatggctgttattacaacaaaactttatggacactgccatttgaattttatatgattttcataggtcatgaaattttattatttttttgacctttgttcaatgattgaaaaatgcttaaacttttcttggcttgcagaccataaaaaatcaggcagcaggctggatttagtccctggggtatagttagtcaacttctgttataaatacaaagcaagcacctaccccttgttttttgggaaaaaaaaaaaaagtctctcccccatcccgttggaagtcatttagggctgcattcagagttacagggatctcaggagagctggggagaagagaactgtctctgaggttgggctttcaaaataactgcttgctatatttggaggcagcagccaaaagaagagccttatagactcccagcccattgcagccacgtggaggacagctgggcccagccaatctaggattgcagtgatctcatgggcaggtgagggggctgtacaggaagattacgaagggtaacagctgccacttgagtgaaatcatctcagtagagcaaggggcgacctgtagaagaacagatggctgtctggagatacatgcctggtttatacaaaaggcgacaaccaagagagagttgtggaaaattttaaagtgtcatgaagattcccagggatattttgtgaagtgtggtgcagcactggtaaaagaatgaattttcattgagtagcttgaggaataatgcacctataatttggacgcccaaagaagtgtagggtctgacttctgaggtctgagatgtatgttatcataaacacttttggtttccaagcaacatctgtatctctattcttcattctgtttttttttttttaactttctactttgaaaaaatttaaactcttcagaaaagttgaaaaataatccaaaaacctcccatattcccttcatccagattcctcaattgttaacaattttccacttctttttctagcattctctctgttttgtacatacccaactgcacatatactattttttctgagccatttgcaaataagttacatcagtttatagttcttaaaaacaaggatattctcctgcataacgccagtacaaccatcaaaatcaggaagttagcattgacccaataatgctgcctgatgcatacatccagttgaaatttctgttgtccccataatgtcctttatatgtcttggatccattccagtaacgtgttgatttagttgccatgtctttttactctcttttagtctgaaagaattctttagtctttccttttctttcatgactgacatttttaaacagagcagaattgttactttgttaaatgtttctcagtataggtttgtataatgattcttcaagatctatgagctttttatagaaatattagccaaatattcttctcatggcatcatattgttaagtaccaaatgctaatttgtaccattactggagatattaacttttatcacttggttaaaaggtgtctataaggtttctctactatgaggttagctaataggtattttgtactcatcaattaatgattaataagattgcattttgtgggtaaattcatgtcttctactgtaagttggagcttttccttctatcctatgtatttatactggtatagatgaatggatttcttttttaactcaatggattatagcctgtaaatatcgttcctcattttgatactcaaattgttctagacttgaccagtggtgcctttcaaactggctccagtggcgtctccacctgttaccatcattcattcagcaattccttggtttatcatacaacagaacattccaggtgtcttgtattagtctgttctcgcacttctataaagaaatacccgagactgggtaattgataaagaaacgaggtttaattggctcccagttctgcaggctgtacaggaagcatgaggctggcatttgctcaggaagtgtataatcatggtagaaggcaaacggggagccagcacttcatatggccggagcaggaggaagagaagcagggaggtgctacacacgtttgaaccaccagatatcgtgagaactctgtcactatacagtaccaagaggggatggtgctaaaccattgataagaactctaccccatgatccaatcacctcccaccaggctgcacctccaacagtggggatacaattgaacatgagatttgggtggggacacagatccaaaccatatcacttatcttgataagtgactttcctttcttcagctctggaaccatcaatactctttagttgttcctctactttatgtaatctttattttatgtattattttacatattactttatgtaatatgtaaaattattttacatattactttatgtaatatgtaaaattattttacattttacattattttacatattactttatgtaatcattattttagtagagaagcatatacagaaagcaagaaccaagactgcccattgggtgaggggtgccagtgtttctaggtacttttaataagcagatctagaacacccacacacagagcacatacagacacacacacacaggcatacagttacagatacagatacacagacacatacacagacaggcagagaacacacagacaggcagagcacacatagacacatatacagacatacatagatacagacacacacacagacccacagacccacaaacatgcacagacacacacacaggcacagacacatacaaacatacacacagatgtacacatacacagacacacagatacacacacctgagccagaactgtagcattgaatcaaagatagagcctgttctatcttttgaccctcaattatttgtatcagtacattttctttttaatgaagccaatttgaatggggttttctgttatttgctgatgaaagcaacctaactgataaacacagataatggttatatgcaccaggctcagttctcagaagctggaatacagagataaataagcctaatgagatcaaattaaatattataataaattctatgataaggaagacacaagacacagtataagctcagaggaagtctgcgtgaggtattgcctaaactagccagaagtttgctatacatagacatcacagaagaaggagaagccattatagacaaagaattcggtgcaaagacttggaatgccaaaagctgaaggagggtggtgatagaggtgttcatgtttgaataaaaagtatgagtcgttaatttaataatgatacatatgttggtcatatatgggtgctgtaaagatatctctgctgactgtatggggataaatatgtccagaggttatggggaattgaagataaaaggctaaattcttccagggcaggaggaattcaaagttataaattcattcctctgaaatgcctcttcttgtgagaatggattgtggtgtgcgccctacttctctgaagagtatgctgagtttgattcatgaacctgaataattttcttaattttactgacaacactgtgtattggacatgatagcagaggccaggaagctgtctgtctcaagacctgaggctgtttactcctttaatccaagatggcagatatgcctacacatgagttctcttcaactaagtcgtagaacacaatctcctgggccaaaactcaatcattctctgaaatagcatctctgctctgtggattctttctgccactccagaattggtctcttcccagtgacacagatctggtgcagttttgatatgatgttggcagttgcaacttttgggaaaaggcaataagaatctgtctgcttagtgatctccataaaaacctagagcaccagtcatgtcactatattgcttaactaattttaaagaaaatttagcttgtatcattttaattaaaatccaacaagaggacaagacccaataaaagaaagaaaaggggcaaattttggaaagaaaggcataatcattattttaggttataagatatatctacaaaatcagaaagaactaacaaaaataatattgaaatagagaaggcaatttagaaagtagtctacatacaagataagtagagtaagaaccaattaagtatcagcattaagaagatagaacatttaataatatactgtacatcaaaaaacaaaataaaattattgatgaagagatataaactgtccagcaaccttaccttccttcagacaaccaaatgtcattgtcaactgaactgaattgagcatgaaggctaacaattatttagcatacactgtaactctttttgttgccaagtactcttagaacttgtaccatgattctcccaggaatccttatggtatatactacaagccctgctatggcttgaatgtgtcttccaaagttggaatttaatctccaagttgttgtaaacttaatctccaatgcaacagtgttgggaggtgcagcctactaagaggtggttaggatatgaggtctctggcttcgtgaatagattgattttatcattgcagcagtgagtttgttatggtcccagtaggttgttgtgaaagtgagtccagcccctttttactttctcactctcttgcaagctcttaccatttcaccttccaccatgagataatgtaccaaaaaggccctcaccagatactggaccctcaaatatggacatcccagcctccagaaataggagaaataaatggattttctttataaaatatacagtctgtgatattctgttatagcaacaaaaactggactaagacaagtcccattccgcatataagaaaattgagacacaagagagtctcgagatcatacagctagtaaatggcagcatggaattaaaatcctgtctgcttaactcaaaattcatagtatttttttataataacatgctctagattgagttttcagttgtcaaattatctccttaagtgaaagttgttctttttttatgagaaaacacaaactgctatcttccaccctggctcttttatatttgtaggtcaacattttttatatttggcttccatgcagttttctctctagtcccacaggtgaaacactccaatccatagtcagtactctatatctagtttgatttagaatagctgatacttgtagcccgggtgtggtggctgatgcctgtaatcccagcaatttgggaggccaaggtgtgtggattacttgaagtcaggagttcgagaccagcctggccaatatagtaaaaccccatttctactaaaaacacaaaaaattagccaggtatggtggtgcacagctgcaatctcagctactcgggaggctgaggcactcgggaggctgaggcacaagaattgcttgaacctgggaggtggaggttgtagtgagcctagatcaggtcactgcacttcagcctgggtgacagagcaagactctgtctcaaaaagaaaaaaaaagaatagatgatacattagatgatacatgtatagcgaaaacaaaaatgtagcaatattattttaaaattagttcctttgttttaaaagttaaatgtagagaatttgtggcattttgtcttggttgttcaaattaaaacttgaaagagacggaggaggaattgtggaggtcctgttgattggattaaatgtccttactagagtgaagttctcatagagcattccccagctgtgactttccaaatgttacggccttattaatcaatgtcatcttccatatcaaaagtccaaatgcttccttcctgctttgtattaaaattttctccagggattggatctttccattatccttccttctgaagaatgtgtctatgtataactggcaagagaacatgggggagtctttctgaaactttgtggcttctgcctaaaataatttattcaaaatgttttgggaaattattctacagattcttttaaatggagaaataatacaaagtccaaaaattgccttggtttggggataccggcttttaaaaagatctcattattccttcttttggtgattagtatttcgtgcttggtgggttaagaataaatgagctggaaataccgttgttttagtccattttgtgctgctataacaaaatacctgagaaaggataatttataaagtaaaggaattcgtcataattctggaggctgggaagtccaagactgaggggctgcatctggtgagggccatcttattgcatcataacgtgatggaaagcatcacacagtgagtgaactcatgtaagagagaaagggaggtctgaactaacttttataacaaatccattttggtgataatgaacccacttccacaataacaacattaatcccttcatgaaggcagatccttcatgacctgatacctcttagaggtctcaccctgaaacactgttacatttgggctagtttccaacatgcgaattttataggacacattcaaaccatagcaaccattaatgggtatatattggtgaggtttctgatatgaatagcaaatatgatatgtgtattagtccattctcacattgctataaagaactacccgaaactgggtaatttataaaggagagaggtttaattgactcacagttctgcatggctggggaggcctcaggaaacttacaatcatggtggaaggagaagcaaacatgtccttcttcacgtaatggcaggaagaaatgctgagcaaaaggggaaaaatccccttataaaaccatcagatctaataagaagtcactcactatcatgagaaaagcagcatgggggtaaccacccctatgattcaattacctccccaccaggttcctcccacaacatgtagaaattatggaaactgcaattcaacatgagatttgggtgggtacacagccaaaccatatcaatatgatatagtagaaagaacatagggttggaattgcatataactttattcaatatctggatctctcacttatgaaatgtacaaaacagttacatagatgcttttgtttgcaaatgatatatagagtaagaaaaaataatttttccattagatttgctgttcaacacttcacatgcttttatttctcccttgaaggtcttccccttcttatatactcagataatgtttgcttagtcttttaagcttaattcaatatttatttcctctgtgatgacttcaactattcctctcccccaggaagaatgggtattctctctctgactcccagattacttcacactattgtaaatatcacactaaactggaataatttatcttcccagatgtatccctagttagactctgccaagattggtcttcatatccacaatgcccagcctagtgcctgatatcctgtaagtgttcaaaagtgtttgttttgatatactgggcctatataaatagagtcattttcagaataaatttactattgcctgaattttctggataattttgccaattagtcattggtgattgaatcacagagtcaaatgctagaatgccagatctgactcatccaactcatcatttctgttccatctttatagttatcatcatatccacctatcccctccattggtattaatattttcttatgttgagaaaataacataaaaacttaagaacaactgtaaaaactgaattactttacattcattctaagaacttatgtgacatcaagtgtatgagatgataattatcttctagtgcacattacaataatttataactgctgaaatgtttagaagtttgtccatgtagtacccataaacattttacatattgccagtgaaacacagagtgtttcccaaagaaacacttagctttgggtctttcttacttacaagtgaggactttacatgttcagagaaataaatgtctaacctgtggtctcacagctgcagatcctggacaaaaatcttcgtcttcttagctggccttcaatgacagttttatgaattaagccaaatatgtacatttccttggttcctcagcactttgaacagcctttgtcattgcttcaggcttttgagggtagggtgaaagcaagacactacacagctccctgcctgtgccctagcaaccaagcacaacacagatggccagcctggcaatctgcccagcagacactgattgcatacctggtggtaagacacaatggtgtttgcacagtgtggttggcatttatagtgataggcaatgaagactgcatcctgtgccttcaggccagtttgctggtttccagaccagaggcaataactttccactagtgtaatgacaacttgtctcttgcagctggatcatgttaggagagtaggaattttatttttgctcccttttcaatggtgccttgtaataatagggtagtattttcccaatatgtttcttgccagttgtacacatgtattggctcctgaagccctgaacattcattggcatcaaagaatgggaatggtccctatttataggagagcagtccccattctacaggtgaagagaatacaccttataccaatccaagaagcatttattatatgcctgttattatttgttaaattgagtgaatgactattgtgtataagccattctaccaggccttgggcatagaaagatacataacataagcatgactcaagaggcactcagaccagtagatgtgacagacatttaaactaataacatgatgagtggtctaatagaggggtgtacctagcactgtgggaacacaaaggagggggctgttaatccttcctagaggttaaaaatgaaagctaaattgatgctgaacactgcatccagggatatgcattatggcaagttggtgagagctcttgttctgctgcctcacgaatctgtgttcaagttcccactttgctaattactccttttgtagttttaggcaagtctcaaagctttccagatctcattgtatatataatggagacagagttcatgccttatatatgtatataaagtgagaacaaaatgaaatactcattataaagtgcttagcatttttttctggcatctagtatgtgtttaataaatattagctccagttgtcattcttatcattattgttattatgtgatgatgatgtgggttgccttgcaggcagacttatgatgtggtattatcattggcatcagaatatgctggctacagattcacccttgagtttgactacctatgtgtctttgagcagagtcttcactgttctgaagtgatttactttacatgaccaagatggataagtaggccacttatcatcatctcctaagattccttctaaaaacaaatcttttgaacaaggttgggcatttccagaattttggttcttttagaatgtctcattaagctttcagaggcattactcattaggtttcagatataacatgtttttggagaaataacacaatatgatgtggcacattgcattttctggcgtatgagccaaatttggactagttgcacaatctcaagatgcatgtaagactcggaacttgtgttctgatgaagcaggaaaaatggacagatgttgagctaatgtccaggaaatgacaaaagttatgtttgaagaaaatagcttcagacaggggaatgctcacggttaatgggaatccaatgtaatggatgttgtacaggagggagatgtggagtggtggtggtgcacagtgtgctgtggatgcgcagaagtgagttcttcatcctttctggggtgttggaaggtgagtttggcagagccataaaaagatgaatcagagtcaccaagtggagcagatgagaaaggatagcccaggcaaagggaagagaattgcagctacctggaagaattggcatatgtttggggaatggtgagatgcaactagtttggtgtatctggggaaaattgtgtcagaatagactggagaaattgactggagtcagattgcaggaagggatggaaaactactctcagttgagtcccctcatgtgcttctctactcccaccccatcactctctctacataactgaagtggtcagtaatgaatgccaagtatgtgctatgcatcatacaaagtggtttacatatttaatctcttaatcttcacaaaaatggaaaaatttgtgtcttaactagaagcaaatttggctgagagtaatattgtcatttccttgctttcaaataacgaggcataaacaagatataaatttgtttttctcttatgtacaactctggcattcagggttatcctgagggctctggtccaggagagtttttcaggtacataggtgcttctgttttgttgctcttctatcttaattccccaggccatgtcatagcccaaatttggcttctctggttctagatatcttgtttgtattcttgtcagcagcagggaggaagagaagagagtcatgggagcatactaggtgtgttctaagaaagctttctggaagcttcctcacagtgtttttgctagcatcttgtccagaagttagtcaaattgctgcaactagttgcagaagatactagaacatgtaatatttattatgggtagccatgtgctcagctagtaatgggagttctttcactgtggaaaaggggtgaaagaatagttgtatctactaaaggtggatttttatccaattttccagataaagaaattgaggattagagaagcaggataacttgtccttggtggcacagttgatgaatgcctaagatttccactgatgccagttctagtggttctaaccacaggacttgctcttcaacactactcatatgttctagtttggggttcctcccaaaagcagaaccaaagacaagtacctgggtgagaatatttgtaatggaatcataggattaccaacaattctggttttctgacagctgaaggtggtcctgggatgcaggactttcagttttaaaactgaaatgttctggaaaactgtcctgaggatgagatgattcagaaacaagggataagcaccaggccaaaaaaaaaaaaaaaaaaaaaagcatcatgaaggtgcattatgaggcaatgggactccatctcattggggcctctgtgaatcatgcaggatgccctttagaattgttctcctgaaatatgggtacctgaagcatgtacccagtagctcgtttcatcatgagttgagggttcatcccagaggctttgactccagaagcacttctgggtttcgtctgcctgcaccatgagccaacttgggatgagtgaagaaagttctggggcaaaacttagaaagacaaattgcagtcctagatgaggggtcttggccttatcaggtgagtgggaatggtctaccatagggagaactccaattacaggtgagttgagggaataaagtgagtatcagagaaatctgctgcatcttatttaagaactttaaaagctcagatattattttcacagggtagtgatttttaaaccatgcttctttaattctctgaaggttccaagagttttttctggaccaaactttcattctctctctctctctctctctctctctctctctctctctctctctgtgtgtgtgtgtgtgtgtgtgtgtgtgtatgtttatattgcaggagtgctcattgttttgactctttaacttaagccagagtggttctaattttatcttttacatcttatcacttgaataaaagtttccacagtttaaaaagtttgtaaagcactggattgagtaataggcagttattgtggcacttatgcaggggaataaattatcaagtaatgcttgaaacatcccattctggctacagcctggggaatgtgtaggaagatcatgcctgcaggcaaagaaaacagcttgaagctgcaatcactcagtcaatgaaggacattggaaaagccagggagagaatggagaacaaagtactaacagcaagacttactctccagcataactcatacatcttagtttgggttgcctccccaagcagagcccaagacaagaacttgggtgagaatatttggaagggaattatagagtaaccaactattcctgcttgctcacaactgaaggaagaatctatatgttagagttcctggactagacaagaaattggatttggatggtagagactgaggaggctcagtctgctgcagagttttgatttgtctagcttaggatcaaaatggtgctatttgttgaaaaattgatacacagtggaagaagctgatttggggagataatgattcatctgtctaatgagtaaatggccggcaactgaggtccttctttctataatatgtggaagcttttatttggggaggattgtgataatttagagaagaccccctggctcctacctcctcttgagaaccctccaagagagaattatccagccagagtgtttgtttttctcagggcgcaggtagaaagaaatcaattcttccttctccgaataaacagatcaaggtatgctgttggtgatgcctgagactcttacctttccattccttaaagaatcactgaacattgaattcattaatggcactttggatataatgtcacatgatgtgaaattggttgtcattaattcatttatacacgggacattcacaaagtaacttggttgacaaaactccctgaaaaagattgacaacttaagaatgatgtggtttcagccttgacgagctctttgtggatttctactcatttggccatttaagactcttcattgtccttcactcatggcaacacactgataaaattagtgaaaaaaataaaacagtaacaacaaacaccaaaaaacctcatcttactaaaatagaataacatccacaatctttaaagcttacttgaaaactatcacacatgaaaggaagaaagaatggatttctcaaaatctgaaccttaggcaggtgtatatggtgaccattttggcttcttaagatataatatgagacataaatgacctgcaatgatgacgggctgctttagaaataccccttcattccttttgctttttttttttttttgagaaagggtctcgctctgtcacccagactggagtgcagtggcacaatcatggctcactgcaggttcaggtgatcctcccacctcagcctcccaagtaactgaaactacgagtgcacgccaacacacccagttaattttttttgtattttttgtagagatggggtttcaccatgttgctcaggctgttgcttaatcctttaaagccatcagctgccccaggattcatccttattctctttttaaataaatgggtattttgggtggaaatttcaagaaatacggaagtatatgaaagcacttttaaattatgtgtgtgttaaaaaaagaatactacatatgaatattataaggatgatgtattataactcgtatcaactgcatacactagcaagtcctgccaaccaagcaactttggagtacaaattgtcttttccttgattagacttaggtctcctggatcttagctgcagggctgctgttcacaaacagagtgctgaaactctcaggttgtttagcacccagctgagggggtagagattttcatacatgagttattctaagatcccccaattgaaaagaatctccctcttaaataccaacataaatagggcaagatgtcatacaagttatatgaaaatgaacgtgatgcaagatatggtccttctccatccctgcaggattcccactttaccccaactgtgccagaatccatggctcagtcttccatccaatgaagcatgctgtatccagactgaggattactgaatgcttattggccctaaaagtactttattcaagtgagatattttgttacaattttatatataaaatgaataggagcagttctgctgaaatgggcatgaggaccctaggacccgtctttcttaggttattcctcaccatgtttggaggcttccagggatctacagaatataacttgcaaatacgtgatgtagataattccagcttttgagtgcctatgggaaagttgactgagttaatcctctgggatttgaatcctggctcaaattttcatgctttttatgtttttggaagacattatttaatttctctatgcctcaaccttctaaacttttaaggaaataacatcttgttcacaaccaaatagagtttctttgaggattacatgatgtaagacatgtaaaagaacttagaattataactgttacagattaagcaccccataaatattacacagtattgttttattaataaggctctaagttaaataattataacttagtttgagaagtcagtccatgtcagtgagcctatgttctcattttttttctggaataaaagtaataaataacaacaaaaacaaaaagaataacatcatcagtaacaaccaccatgaaactcaccaataatcactgctttctagtaattatctactctgtttagccactgttttataatttttctggacctcacagtagccctacagggtaaatgcctcttagacccattttacagatgagaaaatcaagattcataaaaggtaagccacttccccatagtcagacaggtaatccatggcagagccaaagatggttccaaggatgaaggcttcagatcccgatgtctacatacatgaatgatactcaaaagtaagagccaccttttttactgatgctctgtaaactcttttttcggcgaagtatccgtcacatcaatcatttatcgtttctttgtgttacaaatgatctaattatgctcatttagttatttaaaaatgtaaaataaattattgttgagtgtagtcaccctactgtgctatcatatgctagatcttactcactctatctatctaactatatttttgtacccatgaatcatccccactgcctcccaacccaactacctttcctagactctggtaaccagtggtctactctcttatctccataagtacaattgttttaatttttagctcccacaaataagcgagaacatgcagcttatctttctgtccctggtttatttcacttaacacaaagacctacagttccattcatgttgttgcaaagacagaatgtcattcttttttatggcttaagaatattactccactgtgtaaatgtaccctattgtttttatccgttcatctgctgatggacacataggttgtttccaaatagtagctattatgtataatgctgtaataaacatgtgagtgcagataactccttgatacactgattttctttcttttgggtgtatacccagcagtgggattgctaaatcatatggtagttttaactttagtttcctgaggaattttcaaactgttctctatagtggttgtactattttacattcccaccaagaatgtataagggtttctttttccctacatcctcaccagcatttaatattttctgtctttggataaaagcctttttaactgggtgagatgacacctcattgtagttttgatttgcatttctctgttgattaatgatgctgaacctcttttcatacacctgtttgccatttgtatgtcttcttttgagaaacgtctattcagaccttctgcccatttttaatgggcttattagtttttttcctattgagttgtttggggtctttatatattctggttattaattgctggtcagttggatagttgcaaatattttcttccattctatgggttgtctcttcactttgttgattgttttctttcctgtggaggttttttaatttgatgtgatcacatttgtccacttttgctttcgttgtctgtgcttgtagagtattacccaagaaatcttagtttcagatatttggtgcttacatacaaaaatgctactgatttttttacattgattttgtatcctgcaaccttactaaattttatcagttctaatagtttttcagtgaagtctttaggtcttttcaaatacaaggcaatatcatttgcaaccagagattaatttgacttcttccttttcaatttggttgttctttatttcttttgtcagattgctctagctaggacttccagtactatgtcaaataacagtgacaaaaataggcatccttgttatcttccagatctcagaggaaaggctttcagtcttttcccatttagtatgaaactagctgtgggtctgtaatatatggtttttattgtgctgaggtatgttccttctatacccagttttttgaaggtttttattatgaaggaatgttgaattttatcaaattcaaatgccttttcagcagcaatgtaaatgatcgtattttttcttgttaccccttattctgttgatatgatgtaccacattaattgatttgtgtatgttgaaccactcttgcatccttgggatgaatcccacttggtcatgataaatgatattttttaacatgttgttgaatttggttggctagtattttgttaaggatttttgcatcagtgttcaccagggatactggactgtagatttctttttttcatgtgtgtttggttttgatatcagagtaatattggctttgtagagttagtctggaaatatcccctcctctctatttttcagaatagtttgagtaggattggtattggttcttctttaaatctttgatgaaattcagcagtgaagcaattgggtcccaggcttttctttgctgggagaattttcattacagcttcaatctcattacttgttattggtttgttcatcttttgaatttcttcatggttcaatcttggtagcttgtatatgtctaagaatgtatcaatttttttctaggtttttgaatgtcttggcatatagttgctcattgtagcctctaatgatcttttgaatttctgtggtattggttgtaatgtctcctttttcatctctaattttatttatttgggtcttctttctctttttttttttgttagtctgacttaagatttgtcaattttatcttttcaaaaaaacctttttattttattgatcttttgtattgctctcttcatttcaattttatttatttgtgctctgatctttattattaatttttttctactaattgtgggattggtttgctcttacttttatactacttaaagatgcatctgccaaaaggggtggctcatgtctgtaatcccaacacctggggaggctgaggagggcagatcacaaggtcaggagatccagaccatcctggccaatatggtgaaacactctttctactgaaaatacaaaaattagctgggcgtgatgccacacgcctgtagtcccagctactcaggaggctgaggcaggagaatcacttgaacctgggaggcggaggttgcagtgagctgagatcatgccactgcactacagcctggtgacatagcgagactccatctcaaaaaaaaaaaatgcataattagtttgttcattgaaagtttttctgcctttttttttttttttttctgaggtggagtctcgtgctctcacccaggctggagtgcagtggtgcgatcttggctcactgcactgcaacctctgcctccgggttcaagtgattcctctgcctcagcctcccaagtagctgggactacaggcatgcaccaccatgcccggctaatttttatatttttagtacagatgcagtttcaccatgttggtcaggattgtctcgaactcctgacctcgtgatctgcctgcctcggcctcccaaagtgctgagattacaggcatgacccatggtgcctggcctatatttttgatgtagacaattatactataaacttttctctgagtattgctttgactgtactccataggttttggtatgttgtatttccgttatcatttgtttaaaaaatattttcaatttcttttctaatttcttcattcacccaccggtcattctggagcatattttttaatttccatgtgtttctataatttacaaattttctcttgttattcatttctaattttattccattatggtcagagaagatacttgatataatttctttttttaaattttttaaggcttgttttgtggcctgatgtatggcctactgttgagaataatccatgtgctgagaagaagaatgtgtattctgcagccattagaagaaatgttccgtaaatatgttttaggtctatttttggtctatagtgcagactaagtctaattttttttttttttttggggggggtggatggagtctcgctctgtcacccagggtggagtgcagtggtgcgatctcggctcactgcaagctccgcctcccaggttcacgccattctcctgcctcagcctcccgagtatctgggactacaggcgcctgccaccacgcccagctaattttttgtatttttaggagagacagggtttcaccacgttagccaggatggtctcgatctcctgaccttgtgatcggcccgcctcggcctccaaagtgctgggattataggcctgagccaccacacccgtccaagtctaatgtttttattgattttctgtctggctaatttgtccaatgctgaaactggggtgttgcagtctgcaattcttatggttctgggatctatctctctctttagctctaataacatttgttttataaatcaggatgctccagtgttgggtgcatatatgtttacaattgtcatatcctcttgcttaatcgacccctttatcattatataatgaccttctttttcccttttttatagttgttgtcctgaaatttattttgccttatgtaagtatagctactcctacactttttttggcttctgtttgcatggaatatcttttactattttttaatttttattctatttatgtatgtataggtaaagtgtgttttttgtaggcaatagatcagtaggccttttttttttaatccattcgccttctctttttcttttgattggagagtttagtgcatttacattcaatgttattattgataagtaaggacttaattctgccattttatcatttgttttctggttgttttgttgtcttatcatccttcttttcttcctccctgtcttttagtgaaggtgattttctctgatggtatgttttaatttcttcctttttattttttgtggatctgttgtatttttttatttgaaattaccataaggctagcaaataatatcttaaaacccattattttaaactgatgacaacttaatattgattgaataaacaaactaacaagcaaagagacaattaataaaaacgctacactttaactttgtccccccacttttgaactttttgctgtttctttttgtgccttactgtattgtctatgtcttgaaatgttgttttagttattaattttgatcaattcatctgttagtgtttctacacaagatatgagtagtttacacaacacaattacagtgttacacattttgtgtttttctgtgtatctattattaccagcaagtactgtaccttcagatgattttttgctgttcattaatagctttttctaggccaggcatggtggctcacacctgtaatcccagcactttgggaaattgaggcaggcggatcacgaggtcaggagttcaagatcagcctggccaacatggtgaaagcccatctctactaaaaatacaaaaattagctgggcatggtggcatgttcctgtaatcccagctactcgggaggctgaggcaggagaattgcttgaactgggacccaggaggctgaggttgcagtgagctgagatcacactactgcacaccagcctgggctacagagcaagactctgtctcaaagaaaaaaaaaaaaaggaagctttttcttttcgcctggagaattccctttagtatttcttgtaggtcaggtctggtgttgataaaatccctcagcttttgtttgtctcagaaagcctttatttttccttcatgtttgaagctattttcactggatgatattctggaatacaagtgtggtgctttttttccccacctttagcacttcaaatatgtcatgccactctctcctggcctataagatttccactgaaaaatctgctgccagatatattgcagtttcattgtatgttatttgtttcttttctcttgctgcttatagaatcttttctttatctttgatctttgggagtgtgattattaaatgtcttgaggtagtcttatttgggttaaatatgcttggtgttctatagccctcttgtatttgaatattgatattgttctctaggtctgggaagctttctgttattactcctttgaataaactttctacccctatctctctctctgtactgcctcgttaaggccaataactcttagatttgtcctttcaaggttattttctaaatattgtaggcatgcttcattcttttttattcttgtttcttttgtcttctctgactttatattttcaagtagcctgtcattaagctcacagattctctcttctgcttgatccattctgctgtaaaagactctgatgcattctctaatatgtgaatttcattttccaactgcagaatttctgtttgattcttttcagttatttcaatctctttgctaaatttgcctgatagtattctgaatactttttctgtattatcttgaatttcattgagtttcctcaacaaactattttgaattctctgtctgaaaggttaattatctctatctcttcatgattggtccctggtgttgtatttaatttgtttggtgaggtcatgtttttctggatagtcttcatgcttgtgggtattagtaggtgtctgagcattaaagagttaggtatttatcgtagtctttacagtctaggtttgcttgtacttgttctctctgggaaggttttccaggtattctaagggatttgggtattgtaatctaagcttttggtcactgcagctatgtctgtgttaggggggcaccccaagcccagtaactctgtggctcttacaaacttatagagataccgccttggtggtcttggtaaaggtccagaggaattccctggattaccaggtggaaactcttgttctcttcttgtactttctctcaaacaaatggagtctgtgtctctgtgctgggctgtgtgaagctgggggaagggggatacaagtgcccctgtggccaccaccactggaactgtcctggatcagacccgaagccagcagagcactgtgtctcaaccatggcctatggtaaacactttctggctactgtgtgtattagctcaaggccctagggctctaccatcagcctgtgacaaagccagccaggctgtgtccttcctttcagagcagcaagtttcccccacctctaggctggttcacagatgccatctgggagccacgacctacagtcagaagcattaggaatctacctggtattctattgtggtagagttggcacccagcccacaagacaaagtctttcccactcttccctccccgccacgacctacagtcagaagcattaggaatctacctggtactctattgtggtagagttggcacccagcccacaagacaaagtctttcccactcttccctcccctttctacaagcagaggagttgctcccagtggcaaccgccatcccaggcccgtggcaagtactgcctggccactgctgatgttcactcaagttccaggggctcttcagccagcttgtggtgaatgctggcatgcatgggactctgccttcagggaagtgggctgtcctctgacccagagcacatccagaaaggccatccacgagccaagtcctggaatcaggaaccccaagagccattttagtgctctacccctccgtggccaatttggtaccaaagtgtgggactaagttatcttttttttttttttttttttttcctaaagcagaaggaggctttccttgtagtcaccacagctaggaaatacgctgggtcacacctgaagccagcacatctctgagtcttacttgaggcccacagtgagtactgtctggctactgcagctgattattcagggtccaagagctctttagtaagcaggtgataaattttgctaggactgagtttttcccttcaagcagtgggtgcctttctggcccagggtgtgtctaaaaatttctaggagctatggcctggaatggggacctcaggactctgcctggtgctgtatcaaactgtggctgaactggtatccaagttccaagacaaagtcctttttactcatccctctcttctcctcaagtggaaggcaggggcttcccccagagctgtgagctgagttgcctggggttaggagaggactggagcaagccctcccttggctgccccagctagtgtctcactaggttgcatcccacccactgaccaaaaccacgggctccaagccaagaacagcaccaggacttgcccaggaattttagttgttgtggcttagactgcctttcaagcttatttaggaccccatacccctttagctcatgatagaaaggcttgctggaactcaggttctgatttctggagcgcttgattcctttctcactaggcctggtctaaatgctccctctgtgggtgctggtgctggctgagttctgcctggtattgctttctgctgtgacagggcaacaatgggttccagtgcaaagtcccacaatcactgcactctccctttcctaagcacataggttccctttccatgccacatggccgctgccagggtatgggtgaggggtggtgacagcaattcaagactgtctttcctaccctcttcagtgcctctttcagtgatatcaagttaaaaccaggtactgtgatcgctcaactgatttttgttcttatgaaagtgttttttgtgtgtgcagagttgtttagtttggtgttcctatggggaagatgattggtggagcttctatttggccattttgctctgccttctccctataaactcatacatgggaatggcagtagttatgtactcaagagctcaaggtccttccttttcactgataaaacgaagtaagctcgtggttgtgatatgtgaaattctaaatcaaggcagtactccttcactttctccatcctgcgtacaccttggcttctaattagcctagcagatctagagctccctttactcagaccctgaaagtgaaacagtgtaatgtgaactttggtgttagactggggttcaaataatgccttggccatgtcctaactgtgatattttcaagttttttcttttctttctttcttttttttttttttttttttgagacagggtctcactctgtggcccaggctggagtagagtggcatgatctcagctcactgccacctctgcatcctgggcttgggtgatccttccacctcagcctccagagtagctaggactacaggcgcacaccaccacacccagctaatttttctatttttagagaaagagtttctgcatgttgcctgggctggtctcaaactcgtgaactcaagggatctgctcgtcttggcctcccaaagtgctgagattacaggcattatccaccatgcccaacctttgcaagtttttcctattttctgatcttattatttttttcctttataaaggtagtgacatctacccacagggtggctatgaggttaaataagagagaaagcttttagcccagtgcctggagttctcaagatataggagctattactataattattaagttcattatccccatcagtcccaggaatctatttccagccacatttcacccaaatgtgagatcctttcccaggagtctgtgtgttctgcatggctgagaaggcaccaggctattctctgctcccttagaaaaggcattttcaccatcaaatggctctactgaatcaacctaacattttcccctcccctgccccctccgtgctaactacattttggcacttcttcaaggggctttctgtaatgagcaggttcccagagaaagctgtttcctgaaaggcttatagcatttaaaagaaaacaagtttagggtctcagcattcttgcttttgaagaaagaaagaaagaagcttaatctgtaggcctggcagctgtagcaggagcctcaggctttcctgatcacaaacctaaagaaccaccatctcatcatgcatgctatttctcagctcctttgcaacttcattctggcttgccgatttgcctggggagggtttggtgggaaacccaacctctcccctaattctttgttcttcaaattagagctgggtactgttgccatcccaatcaacacaaataaacccttttcttacagtagcatgaaatatagtggcatgagtgtgggcgttgtttctctgacaggtttagagacttgtggtgtagtgaggggatgtacatatatgggggctaaacagacttgggtgctggtctcccacaccacaacacagctgcggcactttgaacaaattatttattctctcttagctccattgtctttcttagttcaactgaaatcactgtgtctactctgattgtgctatgaatactacatatggcaatgaacattaagtgcctagcatagtgccttgaatagtctatgtacttaattaattttaatccatttatgagctatatattcattcatttgatgaaatgtctcctgagctctttgaatgtcacacagtgttaggcattgaaaataaagaaagtaagcaagttggacatggtgtcactgctttcatggtgggtacagtcagtgaatctatgttttatacattgggtaaggagagttgaagataaatgaccagaatgacatagttagtcataaaactgttaaagttgtatgggacctcggggactaaataatctctgtgcaaattagaatacattgtatagcaaaggggaatagtgatatatttaaaatcacatggaaagccaccgagaaaactggagcttaactcataattaagtacttttctgcattctctgctctcaggaaggttatagtttcactgacagatgaaataatttgtgaagagaatgcatcagtatgtattattttgcaaaacaaaacaaaaaaaccccaaaaccaaaaacaaaataacctagaaggatctctacttttagggagttattgaagggcaatttgtataaaaagggagacctagatctaggccttgatggatgatgagttgggattgaactttctgggcagagagaaatgcatgaaaaacactgccatttggggaattcttcctaagatgctagaatttttttaaaatacagttttagtgccacaggtattttctcttagaagaagctctgcttaacatagatatttgtctcaatgggtaataaattacaaagaaatggcactacatgcatagatctgtctttccatggctttctggattatgaaaacattaccccacaggaagattatattacatctctgatctttttctgaggggtattgtagattgagtttgctccagccccaacatgaatatctcatttaagagccattaaaattgttttctatctctaaaatctgtaaatttcaagtcagtcacacctttttttccaatgggacctcacacagacttttcacgagaagccttttcatgctttcagaaatcatcatttgccagaaagaatattagctactcagcctaaatctacaaagggaggcaaaagtcaatattcagtatgattcataggtatcagcctcataagaaaaattcataaatattaggaaggttaacttagatatgacacatgttgattcttattaagtttcccactgaccctaggactttcttggggcaaggaattctgtcaagtgtaatgatatccaaatagatttgtaggatggctttttccttacaaactggagtccaaattattttgaatatagtaaaagcaactgtaattttttccctgcttgccaaatggggaccattgcctctcttttggaaagctctgtgtccaggtggactgagccaagatgttttgggcatctgtaatgttttgcagggttggtttgtaagagcaactcaacagcctcagttgattctaccaactgctcgccaccaaatggtgaaagtggtgtgttggaactgacctaggttggagccctcacagctttctattcagatggaaaaataacttttgacaggttgttgagctgggtgagactggctgggaggccacttcttatgattgggtgggtatagattttctatagcccagagttaagaaaacagtttgcatagcttacaaaatttcttctcccttcctgccaaagaaacaatccagggaagtaattcatctaggtacagcggacgtgagattgtgtgttggctttgtctttttatcagcttagctcttagaaaacttacttgatctgttggctgcctcacctataaacagaggcactgatatctaatttgtaggtttgttgtaatgctcaaatgagaggtaacacataaaacacttggcaaacaaaaaaaaaatcttaataatagtagtaatttttttaaaaatcaaattttaaaagaatttcaggggaatttaatggaagaggttcctaaggagtgaacacactgaaattcagaaagaagcccattagaatgaaacaacagatttctggatcttatcccagcttttctatgcctgtttcattttgtcagggaacctggaagtgaccaacagaaagcactcacacttaaacaagtctgcatgtgacgaaagtctaaagcagaacagcacttgatgcatttatacctagagagaaccatgattaccccatgggcttcagtatgcctgattatctaattctttgctctctacaaagaaatgtcaacaaggagagttaaatctctactagggagagagttattagaaaatatagagtgaaaaatgagtcaactaaggactttattggctagtgtgaaaaaccatgaattcctggttggccttttccatggtaggaataaaattctaaaaaatccccaaaaccccaaacaaacaaacaaacaaacaaaaacatggtatgttcatgccaatgagacaatgtctatcctgaaacactttctctccctcccttcctttctccccgtttaagtatactgaatgagcagaataggtgggggtggggggatcagaaaaaggctatttttcattaaagctgctcctatggaccccatgtcaaatcctccattcctgccccctcagatgaaaatctttggcagcccaacagcagatctgctcactcttagagaaaatctgtcttccatccatttcaaaccgcaatgcaatttcatttcaataatcaaaatatccagtcccctttattaagtcaaaatgttaaacttcattacaatttaagtttccctccttcttagctcagaaagcctattgttggtaaggggtgtgggtgtaggtgtcctttgatcagttgcttttatcctttttctgcaatttatacttttaattcttcctctcagttgtagaaaattatgttcaagtcaagggtggggaggtgagctgggcagagaaaggtttagagactagcgttatcgcgagcaggcatcagtgctgtctggcctgggcagttttttaaggtggattctcttttggagttctctgtgcataggtggagactccgctttgcctttgtcttatttctgggggttttctgtattagtttgttctcacactgctataaagaactacttgagatggggttatgtataaagtagagaggtttaattgactcacagttcttcatgactggggaggctcaggaaacttacaatcatggcagaaggtgaaagggaaaaaaagacacatcttacatggtggcaggagagagatagagaggcggtggggggaaccaccacttttaaactatcagatctcgtgagaacccactcgctgtcatgagaacaacatgggggaaaccacctccatgacccaatcacctcctaccaggtccctccctcatcacatggggattacaattcaagataagatttggatggggacacagagcccaactatatcagctctcctgtatcatgtcagtgaatacatctcctatggctggttgcttaagaggctgcacaacctctgctgagttttcatcagccctcctggttcctctcttaaataaagcctgttcagacggctcctgcatggctagcttgctctgtcacttggatccattatcagtgacatgcagtgacttcccaatctgttctactcagctgctacaggctgcttcagtctaccatctcctctttaggttttataggcatgtcagtctggtcggtcatgagtctcctgagcatcctccaaactctaggaaatacatgtagcctcttttattcatctctttgaaactcatttagatcaaaatgaggggaaaataagtctgtcatgggatggaagtggaggtaggacttaaagcatgcttcagtgacaatccatctctaatgtccagcttaaattatgtattcctttaatgtattaggctaacacttgcaaaatcagttgtaagccatctcctttgtcatttctgcatagatggacaagcagcttactttgatatgttaattattgtttggggcatgtagctgaaaatgaggctgcatgccatcaaaacctcctgttactctttatttctttctaccttcctatgtttatcatttcaccagaaaatgttgcatgctctttagttatatactaggcactctgttagatgctggggatataaaagaaagtaacaatggatatgacaaacaaataaatgtactattataatacaaggtaataaatgccattatggaagaaagagaagagttctatacctaggaaggtagagaggatagatctaactctaatctgtaggattggataagctttctattctagtgggaggcattgtctaagctgaaacttgaaaaactaatagaagtgttaagaccaataatttggtttgaggggaagtatcaagtagaatggagaatatgtgtgcataagctagaagaaagtaagaatctggtacattccagacaataaaatccaatttgcatgaaatatttacagagagtgtgggtgctggagtatgggatgagattagaaaggaaattgcagtaaaataataaaagtttaagacttttatgatgagtacaaatgaaaacgcctatacttttgaggaagtgaatctgtttataaattgtgttcttttaggtatatttggttactttccatttcagaggatctatcctgtttgtagtgattagaattggaagctgtttaagtctccttaaccatatttgtcacataccatctcattcttccattaatttggcaagcatatacagagtcccactctagccaagtcctctataagaccctttgaactggtggctcaagcctgtaatcctagcactttgggacgccaaggcgggcagatccctgaggtcaggagttcaagaccagcctggccaacatggtggaacccccgtctctactaaagtgcaaaaattagccgagcatgatggcgggtgcctgtaatcccagctactcgggaggctgagacaggagaattgcttgaacccgggagacggtggttgcagtgagccaagattgcttcactgcattccagcctggatggctgagcaagactctgtctcaaaaaataaaataaaataaaataaaataaaaaaatgttctgtccatcaagtcttgcagaggagacagagaaagaaatcaatggtgaaagttttaaattctataatacagggtcagctagtctaaattttgtaatagatgttttccatgggatgatagaggaagaaaatgaaagaacatggaagaatcaagacgaagccaatttggaggtaggtgtgtgtggaataaaaaatacttccaagagtagatgatacacctgagccaagggctgaaaaggtacagatgttagccaagtgagtgatgggcagggagacccactctaggcagaggaacatctgtgaagagacaggaagcacgtgaaggcataacatattcaggaaaatatcagttgcccagattggctggaagacagaatgggtatatgtgggaattacaagagatgtatttggaaagataagtgtaggtatgtgagggagcagatcaggaaagccttgtgtgccttattaaaaagtgtaggttttcttactttaattttgggaaggtaatggagtctctgagtcataaaggcctctttctgtatcttttctatactgacaaagcttgttattactcttaatacttatatgaagtgtctagcttatggaaggtgggcagtgactctgggattcacaagagaactctaaacttaaaaccctttagcaatagcttgctggggttgttatgtagaggaatgcagcaggaaaacacagcttgtcaccaacaggagaagttcatagaacttgcagttaagtgccctgggaaggtgtggagctcataaaaacaggccaaaaccagtctgtctaaaatgatgctgagtggccaatgttcttctctatgtaagaatttggaagcccaggttaccttacaagaggctgatattctgagatgcaaacacgatgggtttattgtctttttgttttgttttgagacaggatctcgctctatcaccaaggctggatacaatggcgcaatctcagctcactgcaacctccatccactgggttcaagtgatcctcccacctcagtctctcaactagctgggaccacacgcatgcaccaaccaccaggcctggcaattttttgtattttcagttgagacggggtctcaccatgttgcctaggatggtctcaaactcctgtgctcaagcaatctgcctgcctcagcctcccaaagtgctaggattataggtgtgagccaccatgcccagacagccttattttctaaatctcagcgttctccaaacattctaatatggcttattgttgctgcggtggaagttttgtcactgggttttttcccccactctttttcttcccctctgccccaaaactctttggataccagagcattgcctgctgcccttaaagggaggaacctagctgatctgactctgatccttttagcagtatgtactttagcatatatatgtgtgtgtgtgtgtgtgtgtgtgtgtgtgtgtgtatgaatacatgcatataaatatatgtgtatattttttcatatgcatttatatagatacatagcagggaggtagatggatggatggatggatagatagatacatacatacatacatatatttgcatgatacctaaaagagggaaaataattacatttgtctcttttcaaatatgtacaggaagtgtagcccagtaaaggaatcacttgagtgtcatttttgtttgttaaatttaaattttattattccatcttttcaactatgattcataggttactaaaaatatctaaagtgaattaaattttggacattaggatctaaaattttcacaataccagatttatcctggaatgaaattaaatacagctgttattttagtggagggatgacagagttcttgtaatcttcctattcttatttcaattttctaatttagtgtagatcttcttatatttctttctttgtgtcttttctctcaagaggcttacagtaagcctccatattaggaggcaagaaaatgaaattgggtggatggttcattgtcacctctggtaatgatgacaagactgtccatgacaaccatccctgaaagtattctcctcttccatggagttggccaaacttacctgaccagtatgtgaaaaatttggttgaaaagtttggtcaattttggaggctcagttctgtccttaaaaacgtgtcaggactactaagatccatgttgccagaatctgacaagaacctcttttccaacctgatcacctctttttacctctatccaccttacacttagcttcccaacctgtgtctgaattccctggattcttctcttttgtacaagaagcctatgccccagagagcttatctatgcttttctctgattttcttctttagtgaaactccacactgttccaaggaataaatgagataatgcatgtaaatgtcttagcacaggccaagtgctcagtacccagaagaataaaagtattaataactgctgcaagccctatgatggattttaggaaaatatgagtctaccttaaaccatttatcactccacctaagaacatgtattactgtaaatctctattaactgggtttctaattggcaatctattttcttaacgcctccactcctggctcctccattctcagtgggtcactgtgttgcagaagacagttcgtcttttcccagcaagaaggtccatcacgatgtctgagttcgaatccaggttttgctacttaccagctgtgtgaccttggacaatttacctccatgggtcttagtttacacctctgtagagtggggataataatagtgcttgcctcataaggtaggggaaggattaatcgggttaaaatgtgcaaagtatttgcaaactatctggcccaagcgatgatcatatgaagatatatcactactatcatgaatctccctgcatttagtccatgactaacatgaagctccccaagaaaggaaaaacacacacatataaatggctttcttagaaaggaaactaatctacagagctgcacatctacccacaaggaggaccaatcgtatgctattatgcagagaatagtttatcttcacattatcttgaaataaaatataacagaatcttggaattttgtttttctctgagaaacaaagtttcattaaagttttggactttgctcccccacacaaaggcacaacaagccctgaaagatccatttgagtacccactcctacagaagctagaaaagtaatttgtttatcattaaaattaaaaatatcttgccaaaactactggaggacagtttcagctaggttctctgatgacatattaagtgcacgtgagattgtgtaaattttcagtagcaagctctcaaatcatatttgtaatggtaataataacttgcattactgttacataaatgttaaggattagaatatattacttttttttagacagagtctcactctgtcactcaggctgtagtgtagtggcattatcttggctcactgcaacctccaccacctgggttcaaatgactctcatgcctcagcctttcaagcagctgggactacaggtgcgtgccaccatgcttggctaattttttttaatttttatttttagtagagatgggattttaccatgttggccaggctagtctcaaactcttggcttcaagtgatcctcctgcctcagcctcccaaagtgctggaattacaggcatgagccaccacgcccggcctattactcttatgagttgaatttttgtgttgcctaaaattcatctgcaaaatgctaattccctgtgtaatggtgtttggaggtgaggcctttgggaggcaattaggattagattatgttatgaggacagggccttcctgatggaattaatgccctcctaaaaacagggagtcatgagatccatctctgccttccatgtgaggatacaagaagacagctgtttgcaaactaggaagagatccctcactggacaccagatctgctggcaccttgatgtactttccagcctccaatactgtgagaaataaatgtttgttgtttaagccacccagtctatggtattctgttatatcagctcaaactaagataattacattaagcctaatacaataactatatattttatactaatataactaccttcatcacttttatttgatagtgaaggaaagtcttctatgaaattttcacctggggatctcatttgcacttaaatgattccataattaagttataagagcagccttgccagctttctaaaaatctgcatttaaatttcacaggctgcttttacaacaggatggataatgtactttgctcctgtctcatctcaagtctctctctctcctctctgtccctttctttctgtctaacatccatctgtgctttgaaacctcctgaataggatgtgacagtatctggaaaagtgtgaggtctgtctgcattaagttgttggcacatttcaattttaggaaagtcataaagcccttataaactttcataataaaattatcaaacaaccgccgggcgcggtgggattacgcctgtaatcccagctctttgggaggccgagacaggtggatcatgaggtcaggagatcgagaccatcctggctaacacggtgaaacccgatctctactaaaaatacaaaaaaaaaatagccgggcgtggtggcgggcgcctgtagtcccagctactcaggagactgaggcaggagaatggcgtgaacccaggaggtggagcttgcagtgagccgagatggcgccgctgcactccagcctgggcgacagagcaagactccacatattaaaaaaaaaaaaaaaatcatacaaccaatctctacgtattttaagtcacattatttcaaggaaagaaaaattactttgtgagtatgtacactaaagaatctaattttatttttgtgacaaaattagtgtgagatggttgtgatactctgaggctagcagaaatggagactctctactgtgagaatcacattaagtttgtatttaaagcacaattattaaaccttctgaattatctgcagttaaaattatttacattatacaatgtatatgactatcaaccatatgagaataacatgtggaatctgcatgaatttatataatagaaatgtaatgatttatgatcattttgctccattagaagatataagaagaaaaaaaatcaatagatctcattcattcatcagctcacagtgattaaggatactattgcataacagatcaggtgctaagtgctgggacacaaagataaattagacgtgttcctctacattgtaaaggaccctaaagttcatctaatagtcagtgatggaacagactcagagagtggtctatttgctcaagatcccagaactagttcatagcagaactaggtaaaaattcaagtctcttgactcttaactttagcctgatattgaggccaaatgacagctttaattacgacagagaagtattaagaatgtcattttggaaaattcaaagtccactagaggaaaactcatttcagttagaggctgtttcttgcaatctatttctaattcttggtcttaggcctcccatgtgtactgacagctggtaatatatttgggtctttgaagaaagcaacaggacctgtttctttctacgcactaactgtggctaagcaacaagacctactctctactggcaacagaattggaacccttaacttcctgtcagccacagcccacactggatttccctagaattttctagaagcaaatggctaccacaggaagaaaaccatagaattcagctggaaaccatccaaatttcctcatcctaagcttcatctccagcaagcctcagtcaaggagacccacaccacaaggctatgacataattcttggttgcctgccaaaatagagaaaaaaggatgaaaaggaagagtttttattgcaaaaagacagcttagggaattttttcttaacttagtgagatggaatcctgagacaaagatttgttagagataacttgtgtaggggtattaaactcaacagagataaagggagatgggtgagtaataagaaaaataaattaacccttggtgttttcttcaggcaatgctgaaaacacacacacacacacacacacacacacacacacacacacacacacacaaaaaaaaaaaaaaaaaaaaaaaaaaaaaaaaaaaaccttatgcccaccacatcatcatttgtatcttaagtaaatgcttggggaaaggggttgagccaggaaggaagaacaggtgttgtacatcgaaccaagcctaaatatttggtatggaacagttgaagatttaagattgtaactccagaacttctgatcactttttttgtattgttaagggtagcaactgagattagataactcacttgctgaaggaagcacattcttggctctgtgcgacattcactgtgccatgagctgctagtgcttactgatacccatgtgctctttggcatttcccagtctcccttgcacttgagctgaccatgtgactatttctgaccaatggactgagagtagaagtaatgtggtcacttctgagggaggtagttaagtatcaagtgtgactcccctcaactcttcgactccttcctgcacccctgcagctggaagaggaggcttggagatggtagaaacataagatggaaggggtctagatggctggatgactgcttgaggagagttattcaagactgctacttagctgatgtcagactctgagtaagtaagaaacttttgtaagatacataaaagtttaactgtaggaagaaaagtcatttttatccatgaaaataaaagatgcctaagatgtatgttttcaaattatattgggatttatatatttcactttatataaactcaaaatcatcaacatatgcctttgttcacttgcttctctgaacttagaaagtctgtaaataaatgtaatgtcaaaagctgaaaacacccaaagctactgtgatttgtggattgttacaacagttaacgagaaatatacatacactaaatgtgttctcctcattttcttgtgtgtactgctccaatctttttcagatgtaactgcttccccaggttaaggggagagtaactctgctccctgttctgggataaaatcctctttggtctcttggccattccctttgccagtgactggtttaggagtagagatgggactcaatagttacactttctgggggcctctgaaaaagattttcttgttcttacagaaaagtcacagattgaaattgctcatttctgaatagaaatggagatttggagggagaggtaatgcggcaaaaaactctaaagtggttgcttaataaagtgaggtaattttcattgtctagtcaaaatgccaacataccaaatatggttgattggggccctgaaactgaggacgagaagcaaggggaaagagaaggtcccaagaacactgtggtaagcagggattgacagagaaatatctccctaaggagggcaatggcccctgacctattagaataataatacctgccccctaattttaaattgtttcatgtgtcataatgtccttttgttattgcagatccttgtgcatacaactgacttgtgtgggtgaggcttgcagaaaaaatcagctagaacagccttgggggtagtggcaaggtggccagagcaattgactgggagctgggaacaggaatgaagaggaagagctgataagaaacatgcccagagcaggtaagcacctctatccctccaatcttcaaaagcatgccgggcgggcggatcacacattaagttggaatgtaaacagaagtaaaggagtatgaagaacactatagcaaggaggaaaaaaagccacacattttgtgccagacagacttagtttgaaatcctatttatagattttgtttcattaggcaatttatttcattctctgagcttcaggggaatcttagtcattgcagttctattacttaacaaagtctttaacagttttccacttactatgtaacatatatatttataacatcttgtctaggatgcagaagagctgtatcttgtatttcctttgctacattcagatgttctcataggttgcttcatgtgtaaaatgaggacaatgccattgttatactctgaaccaagttattggaggaagcagtgtgacaagcacctcgtaaaccctgttaaatgtgcagataagctattaatagaaattattgcaccaatttgatctgaagactcttccagctttgcatgatagatgcattgtcatgtcttatgttttgtaaacagccacacttcaccactatttagataaaatgtgactaagtcaaccttagtttccagacaaccctggatagtttttactttatcttgtatttggactggcgttgggacctctttagctgagaattcccctcccctctgtgagccattagctgagaagcaccattgtcagaaattctgaggatgacctgtcacccccacagccttgccctttctgacttttcagccacccgcccaccatccccatctggttgaggccttggtcagtgtgggagaacaggaggaatctacttagctgagtcatgacccaggtctagcttatggtataaaaccaattaaagcccctttatctgtggcctgatccatcacatgggggtattgagggaggtgaaattccagcctcatttctcttggcagcttctgtgaaggggtagggttcctggtggtcatggaaaaataaagcacacagaaaagggggctgattgctttcacttcattcctgctgcctcccccagaaatgttctctggccaaaccaaatcccagggctcccagaagacccaatgtacccaaagccaagagcaactcctacctcgctgccgctacttactgtccccaaagggcctatctagaggatctggtcaggaagcttaaaaatagttgagtgtgtggtgacaagccttgtggatttcctttgtaaaaatattccaagcagggaaataaacctttcagcaacttatttttccattgctctgtggagcagctcccactctctgctgctataagtacttcaggtagcttgtgggtggtagtggtggtagggatgccagaggggaagtggaggggagatgtgtcttgctcagagaaccaggtttagggggccagcaactattaggatctagaggcaacataacatttctgcacattctgtatacagaaggaaatgtaattccaagctgctgagtttggcacatgaggcctttccagatctagctgtgtccactgccccagcatcataaagtgtcagtatcagcagttgccccatcacattatgatgcttgattcctatatggcttcccatcctctgttccttccactgggaacctggaccctcaccatcatccccagtcatcatccaacctgccagtcattaaaatccagcccagaagtctgccttctcagtgaagtcttctctggcctaagagttaatcactgttttctgaacaacaattctgtcatcattgcatttatcatatggtggggtgttccctcatggggtttgttttctatgcatcttcatgtttttgcagctgcgtacaggatctggcaatgatcactactgccgaacaggttaatcgagcaatttgaagatggcagtatttctgccaaagaagacaaaaagacagaacgaccagtttacaggcagcttagataaatgcaggtttccatgaggttaaaattttgtggaatgctcatgtccacttcacatttctgtcagtaaattactgtgttagaagttgtcccaaataacactgcgaagaactttgagaacttttgagttaacaaagaaccttatcatctttttcgttttcagcactcccttgagttaagatgttatgaccccatttttacaaatgtgaaaacaatttccacagaggaggtagaagaggagagatagagctgagactcaactctgattgcctgtatccagttttttctttccacaaatgaccaaaaagtaccaaaaaacaaagaaactatgagaaaaatgctttctaatagttgtttactattatgattataactactagaaaatataaagcccacataagattttatgtctccaaattcaagaaaatcaccaaagggcaaggcatagagtagcagacaataggctgcatcctcacctggatcccggaagggcttggccatcctcactgatgctatggcagcactgatacctgccaactactctcaagggacaggacagcatggtggttcagagatcaggctctggagccagattgtccaggcttcaatctcagcaccccacctatttctatggggtctggtacatgttaatctctctataccacagtttctccatctttaaactggtggtagtaattagacctgactcacagaattttgtaagttaatagtatgtaaaagattaaatggcccagatacagtggctcatgcctgtaacctcaacactttgggaggctaaggcaggaggactgcttgagtccaggagttcgagacctgcttgggcaacatggcgaaactctgtttctacaaaaaaagaaaaaaaattaaaaattatccaagtgtggtggcatgtgcctgtagttccagctccttgggaggctgaggtaggaggatcactttagcccaggaggttgaggctgcagtgagccatgatggagatattgcattgtagcttgagtgacagagaacctgtctcaaaaaaaaaaaaaaaaattaaaagatcaatcagtgttatctactatgtgccagttatttaccatgacaccatcagattctttatctttcattctcataagaactaatttaggtattattatctctattttatctatgaaatacctggggctacaaggttagatatttttcccagtgggagttctgggttttggatcacaattattgtgaatttaaaattctatatacgtcatctcttacaataacaaaatactcaattaattttcttttcatggatcctggaaacagccctcctttgggaccttactgaaggcttagatacatggcttagacaatctgtggaggtccaagcggcaagcttgataaactgggatttcctgagctcttgtcagcttctcaagtcagagttaatgctgaaagttctacatggggcatgggtgtagcttagataaatacccagaggcttgggaggtagagtgaaaatattttgagctggcaagtctgttcaattaatatgtacttgggagacattttcaaagctgacagatcttttgtaagtgccaagtgatattaattattagtataaaagcagatcccaccagtggagtcagagacacccaaatttatgtgtgttcgggtgtatcatcgggttgtgaggttgaggatgccaacgcttctagctgtgagggcaaaatttagcaaatgagtgtaccctaggaatgaggcaagaagagtctgaacctcttctttgtgtagtgcagaaatctggtcttgtaggaaagagttgctctcagtcttgccagagtcctgctcagaaggtaaaagtctagtgggctgcccaaagggaaggtgtgcaatatatagccttatagcctgggttgaatcaggcaaaacaagagaaatatggctaatgttttaccagaggataaagcagggccataaatgagagaaaaatgaaccctgagctcagaggtggaaacaatatacaacctgtcaggaagtcaagtccagtgtaggtctggaaagtgcttcagaagggagtaatgaatagtgtgaggtcctggcagctctgagagtgcaggctgcctgccgcttggtggaggatgacctggtctcttacagccttttcagagagtcaggtagttcccctccgtgaacctaacagcttctgtgtcttctccaggtgaatttcactttacatcttcaggcatgtttctgattttttgcgggggacagaggggaggagggaaagaagaatttattcttggaggtagatgatccattcttggatccatactctttgtggtagatgatccattcatgagctctctatgactgtgggtgaggtatttcttttcttttgtaatcagttcctgatccgaaaaattaggaatgggctcagaatgttccctgttttcttccattgccaactttccataatgtacagaactggcaattcctttcttttgctaattctgcaaaacctaagggtctttctgagatgtcccgtgggctagttgagtaaatctgggaatacctagtaactagggctgtgttaaaaaggacatttttggttttatctgttttagggttcattaaagtttaataagctatccttgggggaaaataatgcatacatatacaattatttatatatgtggtttatcccttttgtggaatacggttttgtgtgggcttaattatttaaaagaaatttatggcaggttataaagccaatttttgcaatgtaaacaactcccactcattgttttgaaattattgaattttattaacaataattataccttgtatctatgaagcacattcgattttattaaatctagttgtttgtgtaataacgggttcagaaaacacctgtgaactaggcttttttcttttgaaattgctttattgttttctttcagtcataaaatgaatacataacagcagggtgctatattaaatatttacttattttcttctagtgaagagagagccagacactacactaccatggtcattcttgggagaatgattcacttttgaggcaagaatgtggctctctttcccaaaacggatgtagaggtctatcaccagaggcaattggttctccttgttagggaaataagcttcacaattcttatgcctctgttgtagtgaaccacattctctcaaagagttcagggaagaagagaaaagtattcagggtggaggagaagattcattactggcaggaggtgattgagccactgcctctggcacagcactccttggtgggcttgccttttggctctggatggagctgagcaagctaagcttgtaggtctctggcctgaaaacctaggaacattgcagccacaagcttggcattgagggagtggaagccctatcctctgagaaagcacatggatggcccatgcaaggaacctgaatcagcagtagccaagtgacatttgcataactctttgtcatggataagcaaactttgtggaaagatgcagattaaataaacattttgggctttgtgggccacataatctctattgtaactacacagctttgccactgccatgtacattgagcaacagcatggatgttactatgtttcaaacaaaaactctgtttacaaaaagttagcgggctgcattcagtctgtgggccatggtttgctgacacctggcttgggatattcccagaagtagagttgccatgtcaaagtgtacactcttttctagatttttctagatgttttcaagtcaccctccagaagggtaactgaattgaatccttaccatctgcatgaacgtacttgtttctctctatcatcctcaatactaggtattttcatttttttaaaaaaggcttggccaggaggctcatgcctataattctagcactttgggaggccaaggcaggcaggtcacttgaggtcaggagtttgagaccagcctggccaacatggtgaaaccctgtctctactaaaaatacaaaaattagctggaaattgcttgaacctgggaagtggaggttgcagtgagtggagatcgtgccattgcactccagcctgggcgacagagtgagactccgtctcaaaaaaaaaaaaaaacaaaaaaaaaaaaacaaaaaaaaaaacaggaaagcatctgtactttaattttgcatatggaaaatggaaaacattaaccaaagtgttaattttctttttctcactgaagtccacaaagcaagaaattgacaaatttggggttactacatggaacttgtaaaatcaaatcatattaatatatttggtgtggagagtctctgcaacaggaggatggtgtgtgtgggggagagtacctacagtggagggagaggttggagagtgtgtcacaaggattgtggtggaaaagatcgtttggctgcttcatgattgaatgggcatgcggctgatcaaggtaatcccagcagatgagctgcttgggatccttcattaccaatggcccacctaaggtgaatcttctaggatgttatatgacctatgtaggataacccttgcaagagaaatatgttggcttaaatttatgtgtcccttccctctactgtatatcttcccaataggacccaggcatcagaaaaaagaaaactcattggagattttaggctgaactctttggactcttcaaggatgggagaactgttgactcacttgtcaagattctcttttgttttctgatttttttctatgaccagccatacactagccaaagaggtgaactaatagagtactctctttggagacacacatctgatttgaatcctagctcaaccctatagtggctgtgtagactcagacctagtctctctaagcccatttgttttaatgtaaaataggcacaataacgtctccctcttaaggtgtttgtaagaattcaatcatcacatgtctggagagtgtctaggcaaatgggaggtattatgtgtccaactccaggacattgctcataaacctgtgatttagctcatagagcactgggcacctaaggagatcaaaagatctggattgcactgactacatcaggtggccaaggattggttggattagtggggcctctcaaatcacatttcacagggaacaatcctatggagagtgattaggaattaggttcaccaatctattttgagaggatttggtttggtccagccaatattttgaagtactcacaatgccaggttctttgcttcgttcttgaaatgtagatatgaaccaggaattaattctggtgccaaggaacttcacactgtagagatggatatgagcaattaccaaaaaatattctaaatattatctgataaagtttttaatggaggaaatcataggatgttaccaaggcaaagaggaaaaaatccctaacttagatcattgggattagggatggtttctcctaggggacaaaagagcttaagtcttcttgatgaaggtgtggtatatatttgaatgtgaaggcattaaattgaatgatgcatataagagaatagaataagtattgtgttgtaggagacataagatgaaacttgggggatagcaagagatgtcagttatgaaaggctgatcaaagtcttcattctttgaaagccattgaaacgttttatacaacagagtgacaagatcagattcatgtttcacaaatatctttttggtttcagggtggaggatgaatagaatggtgaaaccagaggcagagatactagttaggaagctagttcagtaattcacatgagagatggtggtggctgaattagggaagtggcagtgcagaaggggaaagggatctatgcaatcaatattaattggtaaatttggcaagattgggcatgggttgcatatggaaaatgaaagagagtgagaataattcccaagagtctgatttgagcattgggtggttggggcgggaagtgagggtgggggcattccttgatacctgaacaatggagggggtagagatgatgagtttagaaagcagaagagagacttcaaccaggaacttctgggcttggaatcaggttccatggcttctgacaaactgtgctgactatgggcaaatcactctccctctttagctttagtttctcattttatcatgcaagtaaatattagactgaagagagactcccaaacatgtatctgtggtcacacaactgtagactctgatttactaagtctggtgtgcagtccaagaatcagtattttcaaaagtttcccaggtgatgctgttgtccaacaggtttcaagccctttggagcaggagatccttgaggattcttacagctcaagcatctcttaatgcagtttcctcctagctcttgctccttcctgctgactctgcagatatgagctggcatctaatatccagtgtggccttcacagacactaccatgcatgccagtatccacagtgtgtctcactttctctgtccctgcaccccttcctccactcatcacacggattgggcaggcagaaaaagccaagagtattacccttcacataattggcaccaaggcaactccctgccatgtttttccttcccaaagacatatggttgatttcccaccaggatattgtataataaaccacttctgtagctcattgggatggagggttagtgattttgttccaagtgtggtggtaaatgcattttttaaaaggccttccctaaacttaaagttttagtagacagaacacatccaagaattgagcatttatcttccacatgtgccgggaggacatgttacttatcttctctcttggtacttccactgatcccacttcctgctatggatgagctcagcagacatggcatgtagacacatggggaaaagtcatcaacacatctgaaaaattagtaatggcttggccatcaacagagaggcttaggtgttacttcttacaacctacaaacagcattaattacactgaaatctccaggctggaccaagaagaggatccccttacaccacacataagtgcatttgcctggagtgaaacagcacaggtcttcctctcactgcaaggctgtgatcaattcttggctcccaaacccaaaagggatgtggaaatctggtgggaactgtaaaggcctggaatataagacttatgtgcacagatgaaaggcagcaggcttgttcagctgggaggaactgtaggatggcttaattataacctcctggtctatagcgagttcttagatcactgatgaggtaaacccgctgctggatcccaagctgggagctacagcaaggactcaaacctatttatcttttatttttctatggtgtttgggatgcagctctgaataaagtggtggctgaggaaactgattcagcaactgcatttccagatccttttacagcagaaagagcttaactttggggtaattcaaacctgagtttgaattccaattacacaaattacaaactgtaactttggatatttcaactgcgtacattgtaattttcttaactataaaataaggttaaaatattgaccacatagggctattttggggaatgagagagagagagagagtaggagtagtctcttatctagtacagagcctggtaagttctttaagtattttcagagtgaaggattagataaagctatggagaacgtttagacagactatggtagacaagctagtagggtgatttgacgtctcaatttgccttggatggtgctagcttaaaaattcagcaggcatgcaaaagggtctcagattgaagggacaaagtgatttccctgtagcctctgaataacttaagctctgtggtttgcaggaacttagtgatgtggtcatgcatagtgtgcgtgtgtgtgtgtgcgtgcgcatgtgtgcatgtatgtaatatcttatgtctactactctgatgtcttttgagcttcttggaaacttggataatatctaatttatctcttcatttctctttatccctaaatcagcaaatgtgtgaggagaaccaatggtaattatatgccttgtataatatgagaacagatggaaaaataaacaaacaccaaatctcacttcctcctgttgcttaccttttagtggcagtgtcagatttttctcctggactccttctcctaactataatttaaaaaatgtatttcatcatgcaacttatttattttaaaaatctaaagtattacagataacatggaagctcttatccctaatatcattcccccttctctaaaggcaatcaccaatatgaattttattgtgtatcattgcagcccccattttctatgtttattatgagatatatccactaataatacatatggttgctatttcttacctatttacagaactatttcatactacagtttttaacaacttgtttcccctttgttactcaagattgcatttttgatatccattcatgtctttacacatagatctaattaattcattttgatttttgttattgtaaattccatgaatatattacaatttatttactcattctttctccactgaaggacataaagattgtttccaatttttcttcattgtaaacagacactgctataatgaacattctggtttatgtgcaggcatttctctgaagtagaatgagaagtcattgggcatgcacattttaacaatttcacgatctacagtcaaattgctctccaaagtgattgtactaatttagactcccaccagcagggtaggaaagttcagttttctcatgtctttaccaacagttgctattgacagactctttaatgcttgtcaaactatttggtgtaaaatgcttcactgttgttttaatttgcatttcctttatttctagtgaggataataatctattcatatgttcactggctcttctgaattgcctgttcccatcaattgccaacttctgtgttatattgttggttcgtttaaactgatacataatttctctacctattcaagataatctgtgtttgttttacacgtgtgtttgttttacacgttacagacatattttctaagcctgccatttttttaagtatgtttcatggtgtgcttcgtaatggggaaaatcttaattttgatgcacttggttttatcaatgctttcctataaattgctagtgtttgagagttttctaagaaatttgatttttatctcttagtcaaaaattgttatcctacattctcttctaattaaaaaatcccatttgcagttttatttagttatttttgtctataaagtgagttccgaatgggaaaccaggtcatttactgcacttttttccttcccactgatttataatgccacctctgtcatacaccaggctcatatgtgtttcagcttatttaagggcttcaaattttatttcattaacttgactttttctctgctccaatatcattcttttaattttatgactttaaactgttttcatggataggtagtcaagttctagctcattttttcccctcccctcagaattatctttgctgatctttgttgtttgcatattcaaatggagtttagaataagtgcgtagagttctgagagagaaatcttgttgagattttatctgaaacctcattaattaaatatattgatgatttggatcaagttaatagctttgtgattttaaatatctccactcatggaaatggcacaactctccatatattttgtttcccttatgctgcttatttcataattttgtatacaaatttttgcatatatgtatttttaaatttattcataaacacctttttttgcttttatgcctgtacttatattgcattattactgatatgtatatattcttccacccttgtgagatcttagagtgactttgctagtttagtcagtttttcttagatttattatattgaggaccttatatatgatctctaaatatatactgataagcttaaattcttaagtatcatttatttttcttgccttattacgtaattagggcatccagttgactagtaaaagtaattataaagactctactattttcttttcttgactttaatagaaatgcttttaaagcttcatcattcattattatatctatagtagtttttcgctagatgtttatttttaaagaaagtttcttgttactgatagattgctaagaattttgtcatggattcattttgaattttattccttaattttatgtatctattgataaatctattttttcttttagtttgctcatatattgaattagcctactttgatagattttttttcctagttaaccatacctgcctcttttttgatgaattttaataggccattatatttgtttgttagttttagtgaagggttaggtttattatgcttggattttacttaagatgtttaatgaattttaataggccattatatttgtttgtttgttttagtgaagggttaagtttattatgcttggattttacttaagatgtttaaaattaagatttttttgccatctgtaactttattttattgtacattttttggagtggggatcttatgttaatatctcttctgaccattctattaggttggtgcaaaagtaattgcagtttttaccaatttcaatctaataatctattagtctataataatttcaatctatagtctattagatgactactattatctactagattattccacctactatttttattgtacatgctagagcttaagaaaatttttcatcttagactatgctctaattatatcacctgtgtgcatttttcccattgtaaaacaaattgtttttctttttgatatatattggctggtgccaattgttctctcagagaagtaaatgggatctttaaggaaaaaaatatctaggtttcccacatttaacttactaatcttagcaatggctaatagggaaattcccagatgaatcaaggaaatatctcaccttccacaacaataatttattaattataattaatcagattggtagctaactgtgtgttgggcactgggctaagtactttatttatatacatgatgttatgtatttgcaaaaatcatatggtataagcagtgctagtctcagtttagagataataaaatttggattaatggggtttaagttacttgctcaagtgtgcataggtggtaaagtggtgatttttatccattcctttctgactccaaatcacatacccttgaccactttgctacattgtgtctacaccaatgtttggagaacctaaagccacctgtgttaactccattccagcacttaagggagtttaactcaacaatgtctcctggttagtatatcccttatatctcagttctctctgcttaacatatacagatttcttttcaagaaatgcaaattatatttctcttgttctgtcttatttatgttttattttttcttcttacactgcgtccaagaaacacctcctcatgctttggtgtcttctttcttctttttcctcttgtctgtgtttagtttcctcgttttctagttagtcctataattcttactgatccttctttacttttacattagaaaaaaggagggtttaaaaagcgttttttaaatgaaagaaaataaattgtccttcattggactattgttcctccaagctaggaagttgatgcttgattctctgataccctgggggcctgggtggtgttttaagctgggagaagatcggcactctcctgaactgccttagatgcttccttatcctgggcctctctgacaggcaacatgcctcaactttgtcaacaagttgtggtttgtttcactggccaagcataagacagagcatgaaggccgagctgcgtgcctggtgctgcatgtttcctgtttctgtaagctatttgttgtcaactctcttttttcctttatgatatttaattgaaatcacagcttaatgaggcctgaccagtatttttcctttggtcacagatttgatgctactgccaatgtacctgaataagaagacaactctttctggaaaaagggaaaacttgaagggctattgaaggccgctagaaaggtattgtttacatgatgcattttccccttatcttcaacaggtaaaattgttactaaactgatgtttcctttaacaatgataatttttatttggtagtcttgggatgtccctgggagctcaagttcagacaatgaatctagatttttgccagttgaagttcaggttttgtgacctcacctaaaatttgctcctggggcttggaaagtttaaaattgtgcttttttattttccccttcttttttttagcacagttcagatgccatgtccctaggaatttttccttaattcccaaattgcaataatatatccatcatctgcacatctacattacttgtatttaaactgtttcatggcattaaccatgttttaccctgatgcaatgagatacaatgcagttagatgagagaatatgagtactggagctggacaggaatggatgtgaagcccgtggcagttatttactgggtgatcttaacatctcaatattttcttcttcataaaatgataatattaaaaataatagactgttaatatgacctaccttatcttgttgttgggataatttaaggaaattacacattgtattagtctgttctcatactgctgatgaagacataccaaagactgggtaatttataaaggaaagaggtttaattgactcacagttccacatggctagggaggcctcacaatcacggtggaaggcaaaggagaagcaaggacatttcttacatggtgacaggcaagacagcttgtgcaggggaacaaactctgatttataaaactatcagatcttgtgagacttattcactaccacgagaacagtatgggggaaaccacccccatgattccattatcttcacctggacccacccttgacatgtggggattattgcaattcaaggtgagatttgggtggggacacagccaaaccgtatcacacatgtaataaccttggtgcacaggagaagcaatagatgactatgattttaccatcctttgagttaatacccactatcactggtgcctgtaaagggctgcacttgtagaaagtatgactctgtctttccataacactaaacatgaaacctaagagcttttcatcacggggatttgtctcatcatctggcatgctttctttgacacctagccaacccagtaggctttatctgagttaacctcataaagtatcatattgtttcacacaggggtttattcctgaaagttacttaatggtagtttttaagaaaattaaatcttattttataggcacctgggaaaatcattattaaagtgagtcatatggctaatcgttttgcgtaaaggatccctttggaaagtgaataatctcttgttagttaccatgcgtatgttcagataccagcgcttcttagagaggtgcttaatccatgtatataaagtactctatacaatcttatacttctgctaagaacatttgccatggaatccagggatagatatacacgaatgatgttgtgttactttgtaaaatttgtctctgcatttttaataaattggtacgtaaatggattggtatgtatttggattctctacaacacaaacttctaagatttttagttttaggaatcctccaaaagccaaggaaaaactagaaggaaaatgatatttattgagcatctttttgctaagcattatgtgaatcatcttcactaacatattatagttattcctcatcataatgctatgaaaagtattgcttaccttttattggagagaaaaaaaatgaggctcagataagtaaattacactatgccaggtaattcagctagaaaatagcaaagtacaggatttgaaatcagatcttctggatgccaaatcccttacttattccagtaaagtactctttcttgagaacaatatactgaatttcaacgggaaataaaatttaagatgtgggtggtatttatcttactattcgggtacttaaaaaatatcgtacattatcttcgggccttattttttaacctgcctatggaacgtggctctaaacctttgcactgaggctagcttcagtgaaattttgaaggagttaatgccttcctctttttgatacaagattaaacatggattgcaactagaaaccacaaagctgagtgtttattaaatatactaattttcctttcatccagttggccaatgttttcaaccataatctacttttctctaaatttttccatggagcaggatgatgattccaaatcctaaaattctgaaaaaaaaaaaatcacttaatgaccactggtgaactcctgtaaactcatcccagaatcagtaatgagtatttggaaaagattcatgggtaagctccaattctcaccaaaatggccctttgagtagcaatcaaggattctctgagggaactgggaagttccagatggcttttaagggaggctatttggtttagtttaatagaacttggtgctattaaggccaatggttggagtcctttgtcctattctagtatatatatacatatacatacgtacatacatatatactccttactctattaatgtatttagaaagtaaatagtataggttataaataggcagaaaaaaaaacagtgggaatggcttagtgtgaaccattaactctatatattcattcaacatgaatttgctaaaagcccattaggtactagtctctggagacacatggtcaacttgaacaagaattggctttgaggaaataatggactaagggggatatataaacagataattgtgatgtgtgttttttgtttttttttttttaattatactttaagttttagggtacatgtgcacatcgtgcaggttagttacatatgtatacatgtgccatgctggtgcactgcacccactaactcatcatctagcattaggtatatctcccgatgctatccctcccccttccccccaccccacaacagtccccagagtgtgatattccccttcctgtgtccatgtgacctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacacacttgtgcatgtgtctttatagcagcatgatttataggcctttgggtatatacccagtaatgggatggctgggtcaaatggtatttctagttctagatccctgaggaatcgccacactgacttccacaatggttgaattagtttacagtcccaccaacagtgtaaaagtgttcctatttctctctccacatcctctccagcacctgttgtttcctgactttttaatgattgccattctaactggtgtgagatggtatctcattgtggttttgatttgcatttctctgatggccagtgatgatgagcattttttcatgtgtgtgttttttggctgcataaatgtcttcttttgagaagtgtgtgttcatgtccttcgcccactttttgatggggttgtttttttcttgtaaatttgtttgaattcattgtagattctggatattagccctttgtcagatgagtaggttgcgaaaattttctcccattttgtaggttgcctgttcactctgatggtagtttcttttgctgtggagaagctctttagtttaattagatcccatttgtcaattttgtcttttgtttccattgcttttggtgttttaaacatgaagtccttgcccatgcctatgtcctgaatggtaatgcctaggttttcttctacagtttttatggttttaggtctaacatttaagtctttaatccatcttgaattgattttttgtataaggtgtaaggaagggatccagtttcagctttctccatatggctagccagttttcccagcaccatttattaaatagggaatcctttccccattgcttgtttttctcaggtttgtcaaagatcagatagttgtagatatgtggcgttatttctgagggctctgttctgttccattgatttatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattcagtgaagaaagtcattggtagcttgatggggatggcattgaatctgtaaattatcttgggcagtatggccattttcacgatattgattcttcctacccatgagcatgaaatgttcttccatttgtttgtatcctcttttatttccttgagcagtggtttgtagttctccttgaagaggtccttcacatcccttgtaagttggattcctaggtattttattccctttgaggcaattgtgaatgggagttcactcatgatttggctgtttgtctgttgttggtgtataagaatgcttgtgatttttgtacattgattttgtatgctgagactttgctgaagttacttatcagcttaaggagattttgggctgagacaatggggttttctagatatacaatcatgtcgtctgcaaacagggcttatgatgcgtatcatagtcttacagatttatatctacctttactaaaagaagaagaatgttgattagtaagtggcgtttattaagtttattaagtttagtagtaatgagaattattataatggtggttgcaattaccataattcattgatcttttaatgctaatcccagcactatggcctgtacgtgaattattctattcaatctaacaaacttgtgatattggtgatgatgattatgattatagtaacagaaataatggggaatataaggcacatgtattaaacgttattttcaagttactgtattgggtctttcaaggtattattttattaaatcatgccagcaactctctgcagttggtattattatcaccatgttgaagaacagtctgatgccaagagagtgtccacaaattttccaagaatgtacaatgattaggtttatgatttaaaatctgggctagatgaccccacagttcatacccctaagtacaggtctaccttgtttcattgtgcttcacttcacatatactgtattttttaaaaatattgaaggtttatggcaaccatgcattgagcaagtctataggtaccatttctccaacagcatgtgctcactctgtgtttctgtttcacattttggtaattctcacaatattccaaacattttttgttatcattatatccattttgatggttcatgatagtgagtttttgtttgtttgttttttgtttttttagagagagttggtgtctcagcctacggagtagctgggattacatgcatgcgccaccacacctgcctgatttttgtatttttagtagagatgaagttttgccatgttggccagactggtcttgaactcctggcctcaagtgatccgcccactttggcttcccaaagtgctgagattacaggcaagaaccaccacacccggcctgattagtaatttttgatgtcaatattgtaattgttttggggggccatgaatcaagctcatataagactgtaaacttaataaatattgcggtcagctccaatgactggccattttgcctctctcttttttggcctgcctattttctaggatacaacaataatgaaattaggccaattgataaccttacagtggcctgaaagtgcccaggtgaaaggaatagttgtacatctcacttcaaatcaaaagcaagaaatgattaaactcagtgaggaaggcatgttgaaagtcaagataggccaagagctaggcctcttgtgccaaagaatttggcaagttgtgaatgccaaggaaaagttcttgaagcaaattaaaagtactattccaatgaacacactaatgataagaaagcaaaacagccttattgctggtatgaagacagttttagtgctccacatagaaaatcaaatcagccacaatatttgcttaagctaaaacctaaccctgagcaacaccttacctctctttaattctaggaaggctgagagaggtggcaaagctgcagaagaaaagtttgaagctagcagagattggttcatgaggtttaaagaaagaagccatctttatatcacaaaagttcaaggtaaagcagaaaatattgatatagaagctgcaacaagttatccagaagatctagctaagataattgatgaaggtggctataataaacaatagatttagagtgtagacaaaacagctttatattggaagaagatgccatctaggactttcatagctacagagaagttaatgcctggcttcaaagcctcaaagaatatgctgactcttgttatgggctaatgcagctgttgactttaagttaaagccaatgttcatataccattcctaaaaatcctaagatttatgctaaatgactctgcctgtgctctataaatggaagaacaaagcctggatgactgcacgtctgtttacataatgcttcactgaagattttaagcccactgttgagacccactgctcagaaacaaagatttctttcacagtattactgcttatagaccattcacctggtcacccaagagttctgataatatacaagaagattaaccttacttttatgccctacgaacacaatattcattctgcagctcatggttcaagaagtaattttgactttcacatttcattactgaaaaaaatacattttgtaaggctgtaactgccatagaaagtgattcttctgatgaatctgagcaaagtaaataaaaaacctggaaagaattcaccattctagatgtcactaggagcatttgtgattcatgggaggatatcaaaatgacaacattagcagaactttggaagaagttgattccaactctcacatataaataactttgttcaagacgtcagtggtggaagtaactgcagaggtggcttaaataggaagaacactagaattagaagtggattctgaaggcatggctgaattgctgctgtctcatgataaaacttgaatgaaaaggagttgcttttatggatgagcaaagagtggttgcttgagagggaatctactctttgtgaggatgctgtgaacattgctgaaatggcaacaaatgatttaaaatattgcataaatttagttcatcaaacagcatcaggtttgaaagaattgtctccaattttgaaggaagttatactgtgagcaatatgctatcaaacagcatcacatgccaaagagaaatattttgtgaaaggaagagtcaatcaacatagcaaacttcattgttatcttaagtaatttccatagccaccaaaccttcagcaaccaccaccctcaccagtcagcagccatcaatactggggcagaatctccactggcaaaaagattaggacttgctgaaggcttagatgaccattagcatttttaaacaagaaagcatttttttagttaagctatgtgcatttttagatttgaaagacatttctcaaaagaagacatacaagtggcaagcaggcatatgaaaagatgctacacatcatccatcatcagataaatgcaaatcaaaactacaaggagatatcatctcacaccagttagaatggcttatatccaaaacacaggcaataacaaatgctgatgaggaagtggagaaaagaggacagtcaatgggaatgtaaattagcacaactatggagtacagtttagaggtttcacaaaaaactaaaaatgagctaccatatgatccagcaatcccactgatgagtatatattgaaaagaaggtatatcagtatattgaagagatatctgcactcttatgtttgttgcagcactgtttacagcaactaagatttggaagcaacctaagtgttcaacagatgaatggttaaagaaaatgcggtacatacagacaatggagtactactcagccataaaaaaaatgatatccagtcatttgcagcaacgtggatggaactggagaccattatgttaagtgaaataaaccaggcacagaaagacaaacatcgcatgttctcccttatttgtgggatccaaacaacaaaacaattgaactcatgctcatagagaggagaaggatggttaccagaggctgggaaaggtagtgggaaggtggaaagggaggtggggatcggtaatgtataaaaaaatactggaaagagtgaataagacctactatttgatagtacaatggatgattatagtcaataataacctaattgtatattttcaaataacataaagagtgtaattggattgtttgtaactcaaaggataaatgcttgaggggacagatacaccattctccatgatgtgtttatttcacatttcatgactgtattaaaacattttatgtaccccataaatatatatacctactacatacccacaaaaattaaacattaaaaaaagatatgtacatttttaagacacaatgctatgcacttaatagtccacagtatagtgtaaaagtaacttttatatttactgggagagcaaaaaaaattgtgtgacttgctttattggtatacttgctgtatttcagtggtgtgtaatcaaacccataatatttcagaggtttgcctgtacactaagccaagctgtcttctgagcagggtaaacactgaagggtgtcaggtagaaaaataaaaggaacacattctaagaaaaggaagttttttaaaaaatagttttgtaaaacagtatgttagagaggtcacttaatgagaatgtatagtgcatgaaggaaaacagtggtaaataaagcccaaaatataaattagtttcaaattataaaggaatgtgtatttgcattttatcctataagttgagaatcaaaggatagtcttccaagcaaggaagataaagattcacatctacattttttttttttgagacagagtctcgctctgtcgcccaggctggagtgcagtggcacgatctcggctcactgcaagctccgcctcccaggttcacgccattctcctgcctcagcctcccgagtagctgggaccacaggcgcacgccaccatgcctggctaatttttttgtatttttagtagagacggagtttcaccgtgttagccaggatggtctcaatctcctgacctcgtgatccacccacctcggcctcacatctacatttttaaagaaaacaccagatcaaacaaaaaataaaaatagttgacgtgagtgggtaacccaaagtatgctaaggttactcagaatttttgaaaatctggtttaagaattctcctgtatctgaatatcccaaatggttcataaatataagtaaatagcttctgtcacacagtattcttgaggttctttatctctctggtttggattggttcccatgttggttatgtattgagagataacatccagaggtgaaaacatactctactgagtagtgttgacataaaattaacgaaaattgttggagaaaatcagcttttggtgaatgtctgagcagaaaatctgggctttgagccctaggtaaacttactttcccacaccccacttccatagagtagacatattggaatagcctaaaatatctatctctaaaatggtacctttgaaacattctaaatttattatttcattctttcatcctcacccttaaaattttcattccaactctgcatcactggcttttaaaagttctccaatgccggccaggtgcggtggctcatgcctgtaatcccagcactctgggaggctaaagcgggttgatcacaaggtcaagagatcaagaccgtcctggccaacgtggtgaaaccctatctctactaaaaatacaaaaattagctgggcgtggtggtgcatgcctgtagtcccagctactcaggaggctgaggcaggagaatcgcttgaacctgggaggcagaggttgcagtgagatgagattccgccactgcactccagcctgggtgacagagtgagactctgtctcaaaaaaaaaaaaaaaaaaaaaaagttttccaatgcctcaagaaactcctaatggtattctcaacttataaagaaggaccaatctctagaactatagacttctgaaaaggaaaatgaaagaacaatctttcttccttctttcttctctcttttcctttttcttactcttctttctgtcctttcctttcttctctccctccttcccttcctttctggtatacttcctttctcccttccttcctcctttcttcttttattcatttttctttatttcctctctctttttgaacttttctactcatttcttttctacctttatgtagtgaaaatgcaaatttgctcacatcacaattcagacatgcaataaaaatgtagcctgcttatttcatcatcataatctcccctcctgttacttttcaaaaaagatttaaactaaacttaatctacaagtttgaaacttactttgatctaataatttaaaaaccttttgatttttttttaccctatgatatttacttttagattcctccattttctccagtctcttttctgatttaggtgcatgaggaaaaagctaatggctttggaaggaaattttctcctggcctcatagtgctttttggtagtgttctggctagtagccactgaagtacagttggtccgtcatgttttaggcactctactgggttttctgcttgctcctgaattactcctatgtccaattatcctctcctgactcagagtcacataaattcttcctgctgacccagccacccttagctctcactgggatgaatatctctctgaaattctctcatagtctccatttggactgaagcttctgctttgggagcatcttacctataccactggcataataacaggtctgttgactttcaattcagtgttcatgccacaaagaaaggaggggaattgggtactacataatctttcattctacagagcaaagacttggggatatatataagctacttcctctttcttactccttctctccttcttttactaacctttggcccaaaagaagcagattttgttttcctctctggtctagatgaaacatctccctaaatcattcatacttcatgaagtagcatctacgtaaatcatactgatacatcatgaagtagcaactaccttcccatttcctcctattgtctttatttagaatgtagtgctaggagaaataaaaatgtcttactatcaaggaacttaaatttagaagtagttagaaatatattatcacttctgtttctggctattagaaagtagtggtggctagaattattcccttatcataaatgctagaagactggacaaaagatagaaaacaaacatttttaatcattggctaatatgcagtaggactgtggttcctgtaaaaagggaaacaaatgaagtaagccctggaatcacgcaggctttctactgggaggcaatttctagaatgcttcatagggaagggcagctcaaggattaagagtaatcttgctgagtagctaagacagagattgcagtttatgaggccaaagtggttaaaatgtatatagttaagagagtacctgagaggagtgaacttaacaaagaacaagtaccagaaatctgcaaagggtttccttaaaattcttgactgatctaggcttagagtgaaaacttcaggcttatataaagaacttctggacaaagaagttactggggaatttcatgccagatgattcctgaacacatcattttagttcccaccagccatagtggaggggctttattgaatactggaggcattcactagagatcccagaattttcatatcttagaagttaggctaaattagctctgaagaaaatactactccagagtcaccctgaaaagcataaaaacaacttcaaagggaccaaacaaatctgcaaatagtctaacttcctgccacaagaaaaggtagcactcttcaaagaagtataaaaaatacactacttacaaatgtaacattctcaaaaaatactatatgtacaaagaagtagaaaatggggactcataactgggtgaatatcagccaatataaacagatccagagattaaaaagatgataaaattagcagacaaagacattaagtatacttttgtaaataagcttcataagttcaagtattgaaaataaagcataaatataatgaggagagaaatgaaatataagataaaaaagaaaagcaaatggaacttctagttgtaaaaacatatctgaaattaaatcccataggatgagaacaataatacttcagaaaaaatagtagtgaaaatgaagatataacaatagaaactatctaaaatgaagcagagaaagaaaaggagactgaaaaatatgaacagaactttattgaccttttggaaagcatcaaggagtttaaaattcatgtgactgaaatctaagaaagggatctgaagaggcaatggctgaaaaaattttaagtttgatgaaaaccatcaacccatcaatctaaaaagttcagtgagctcaaaagaagataaatataaagccacataaggaaatatcatgatcaaatttttaaaagcaaatattatagaaacagtgaaataaactaaacaacaacaacaacaaaaacttattattctatacccagataaactatctttcaaaattgagggtaaaataaaaccatctttagacaaaacaaaaagctgagaatatttgttactagcaaacctatgctataagtaatgtgacaggctggatacagtggttcgtgcctataatcccagtactttgggaggttgaggtgagaagatcacttgagcccaggagtttgagatcagactgggcaacatagtgagaccctgtttctaaaataaggaaagtaagaaagaatgaaaggaagaaaagaaagaaatgttataggaagttctttaggcctaaggaaaatgagccccaactactggtattcacatctttgtgtagtttcttcccacattgtatcatgtttggtctgtctaaccaaggaaatatggctgatgtgatggtatgtcacttccgagattaggttataaaagacaagtctttctatgcctctgtttctgcctgtctcttctcattaatcactctgcgagaagccaattgtgatgttataagaagactcaggcaacctacgaaaaggcccacattgtaagaaactgtggtttcagccaacaggcatgtgaatgagcttggaaatgaattctccagccacagatgacttcatccctaatgggctgatatggtttggctctgtgttctcacccaaatttcaccttgtagcttccataattcccacatgttgtagaagggacctgatgggagatgactgaatcatgagggtgggtcttttccatgctgttcttgtgatagtgaatgggtctcatgacatatgatggttttaaaaacaggagtttctctacacaagaactctttttgcctgctgccatccacataagatgtgactttctcctccttgcttcccaccataattgtgaggccttcccacccatgtggaactacaagtccaataaacctctttcttcagtaaattgtccagtctcgggtatgtctttatcagcagtgtgaaaacggactaataaatgggcagtatgactacaacctcttgagacaccctgaccagtacatccatctaagctctcttggatctctgactgaaaaaaaaaaacaaaactgtaagatagtaagtatttgttgctataagatgctatgttttgggggcatttgttatgcagctatagataactaacatactttcaaattaattctacaaggcaacattatccagaaataaaatacacccaatattcttataaaaaagattcaaaatatttaataaatactagcaaatcaaatagagcaatatataaaatgtattacagtatgactaagtgagttctaccccagaaatgtaatgtttatctattaatcaaaatgacacaacaaaatttactgtatttacagggtaaaaaacaaacaccaaaactaaaggattacctcaatagaggcagagtaagcatttgaataaaatcaatatgtattaagatacaaacctctcagagccctagaagtagagggagcttttaacctgataaaaagcaagcaagcaagtgacaataacaacaaaaacttttgttaactcatatttaattgtgaaggactgactgcattttccatgaaatcagagagaaggcaaggttctttacttcttcactttttttttttgaaatggagtttcactgttgttgcccaagctacagtgcaatggcatgatcttggctcactgcaacccctgcctcccaggttcaagcgattctcctgcctcagcctcctgagtagctgggattataggtgtgcaccagcatgcccggtcaattttttgtatttttagtagaaacagggtttcaccatgttagccaggctggtctagaactcctgacctcaggtgatccgcccgccttggcctcccaaagtgctgggattacaggcatgagccaccgcatccagccctggttctttgctttcataatttctattcagcattatactggaagtcctatgcaatgaaataacacaagaattcaaacttataaaaaaataaaaattgcctttattttcaggcaagatttagaagaaaccataggagtaaatatttgctattgggaatagtgaaaaaaagttcttaaataagacacaaaaaagtataaaccatgaaagtaaatattagtaaatatacttcatggaatttaaacatttctgctcttcacaatatattcttacaaatttgaagggcaagctatggactatgagaaaatattttcaataggtacgtctaacaaaggacttgtatctagaatatatatataagaacatttacagcttaaaaataagaagataaactgctcaataaatattggcaaaaaattttagcagacactttacaaaagaagacacaaatgaccaataagcttatggaaacatgttaagcatcattagacatcatgaaaatacaaattaaaaccatagtgagatgccactgcacaaccattacaacggctatgattttaaaaaatgattttaagttttggtgagaagtgcaacaactggaaactcaaatgttgctaatgggaatgcacaatattttggaaaagtttggcaatttcttataatgttcaacaaatgcttacaatatgatccagaaattccactcctacgtggttaccctagagaaatgtaaacgtctgtccacacaaagatttttacttgaatggtcccagcagctttattcataataactgataacataagtgaaatgacctaaatattcattaattggtgaatggataagaaaagtgtggcatattaatacaatagaatattattctgcaaataaaaatgaaccaactactgatatgcacaacataatgaatgcattattctaagtgaaagaagccagagtcagaagactacacactatgattaaaattttgtgaaattttagaaaaggcaaaactatagtgacagaaacagataaatcactgccaagagcctgagggagtggagaaggaatttattgcagagacaagggtattttttgcagtgatagaaatgctctatattattactattgtagttgtggttacatacatttgtctaaactcattgaaatatgcactcaatcttggtaggttttattgcatgtaaacatacctcagtgaagctgacttttaaacgttatacacttgttgagtgatacaattttgaacgtcactgtacaactaatagaaaacaaagttatggcctaaaatgggccattttttcaaccaatatagatttatcacttattatgtgccaaaggctagtctagttattcaagacaaagtgatgaactagacagtgagtgaaataggtgagtaaacaggaaatttaaaaaataaagaaacagtgtaactgatatgataatggtaatcacaatgctatggattcagagagaagaggtacccaactcagccttggggccaggaaaggtagtattagagtggaaaacagatggaagaatatgtaaaagggatgggggtgtgggaaatgatacaaggagtgggtaatgtataccttgaacttggagtgagagagcagagggtggcctgtgagtaaacctgaagttagacatgagtaggcttattcaacgtacagttgagaaacggaatttggagaatttaataattgttacatgtgaaaactgaggcaaagaaggaggacaaggatgttattacttttctaaattgattaactgggaaaattatggcactattcattgaaattgaaatacatgagcaaagaaatgggcttagtgaaaggctgggggagaagaagggagacgttataaatattgaatataaagtacctttgagatatcccagcgcagtctgtaaaagaccattgaaataaagcctggagcacagaaaactgacttgagatagagatacaggtttgggtaaatgaactcattgaaatcatcacaaaagagcatgagatcaaccggagagatggggaaacacgaaacaggaaggcccaagatggtcgaagtttgtgaccgtcaaacatcatggtgtagccataaaataagtacttagtaaaaagtattgttattaccattacaattctggctgtaggtgacgttaaagccccaaaacaaagcatcatgctacctctacatgctaatgggatgtagccactagagaagggatataagtggagtgacattcttctgaacatcaaaaaggatgagatccagagtatgggatccagtttttggtaagataaaggacattcctttcggtctatcaggagcgtggaaggaagtaatgagtgaagatgcaaatacgtgtgtaacttttatgacacaaagttgagggagctttgactgatggcttttgtttttttctgtggagtcaaggtcatacggagactaagcgagagaggtgggagtcataggtttgagagcaaagaagacagtttgaaatatgctgcctcagaaaaggggaaagtacttcccatagaaacataatagatccctgggcattattaaggacctagttaaggttgaggaccatgaattaagagcatttccaattgagagcgattttttttttctttccacaattactcagcaacccaactgcaaggttgagaaaatagcaagttgagtttattcaggtttgaagttttacagatgactcataataagataattacaacttaagaaattaaagattttgaagacagtaattaatgtgattatcaataaaatcttagctagataatgagagaagtggaaacaggggagtcctgagaagtaaggagaaagtaaaggagtcggtaaactggaagttcctagaaggcctataaaatagtatattgtggatcagtgaattgggataatgtggccaaagtgaagaaattgagaccataggggatgaagagggcaaggaatctgcaaagctaggttgttgaaaggatcacccaatgccgaaatcaccaataatagcaatgcctgtggtgggagaagatggaaaggcagaggccaatcttcagagaatttagaggattggccaggacataaagtcttttgatcaagtgctaggagtaccccaaggtggaatcacaggcaaacactttcagtaagtgggaactgtatggaaggagtgaggaaatctaatccagaagtggtgatacaagccgggagaacacggactcccaaccttcagtgacatgggaggtgggaggaggaacatcctccccatgagtggtctattgtgtggcttgaataagtggggtttatggagagtttcctggctcaatgttgctgatatgcataggaggaatagagtctttttggtgattggagacccttcaggatggatgagggagcagacagcctggtggtgaaggtgatgagctctgctgcattctccaccaatgtcagtggccattctctcagtctgagcagtagtgaagtaattaaagctctagcatcagtcaggcctgggtggagcccaggttctgctcatcactcactgcatgtgggaccttctttgaattccaggttcttcaactgcaaaatgaggataatattatttacctcaggattgttttaaaactccaataaagtgttcaaaaaaaaagtttatggctgggcgcagtggctcacgcctgtaatcccagcactttgggaagccaagacgggtggatcacgaggtcaggagatcgagaccatcctggctaacacggtgcaaacccatctctactaacaatacaaaaaattagctgggcatagtggtgggctcctgtaatcccagctactcaggaggctgaggcaggagaatggcgtgaacccgggaggcggaggctgcagtgaaccaagatcgcaccactgtactccagcctgggcgactgaccaagactccatctcaaaaaaaaaaaaaaaaaaaaaaaaaaagtttatgataggtcagacagcattgtgtagttataaaatgtttattaaggggtattgttgttactactatttcaactctgagtacagatgattttggagcccaaaaataaagtattatgcttaatgagataaactttcacttaatctggatgatgaaggtaaaagtatactagtttgccaaatgaaaaagatgaaattctttagataatgagacctttatttctcaagatagatctttaaacaatgtaaaatgtcaaagaacctaatcatcagagttatttttctaccttcttcaataatgggtctggaaatacagaatgatttaacttttcctgtgttgacaagagcaaagtgtttggaaaggggagctgggggagagaattgtaaggccctgaactctttacaatgccccagccctggttatgcagtctgccgaattttgatgagagagctgtattcctgtaagagacatcatcgtccagatgtagatgcactgccgtgatgtccaaataggaaacaaagaccacttggaagtggatactttcctgaacttactgctctgatgaggggcccttcttttgaagcaaaatgagtcttcatgtagctgagaactctcttctcctatcactttacaaactctatcttcccccaaaggcctttccaaaggaagcagccaggctcagtggccatgatgttttcctgaaggtatgggagatagattatccagttaaaaacacagttatttccctaaacctgacttaacctctgcatataactgcctggagcctattcaacgcagttgacaattgcctgccccggggcctccctctgtcctgaaattacccatttaaatcttcctattttttttaatccctaatagtctgtggcctactttttgttgtttacgttttgtatgtttttcaaaaccccaaagatttgcttcaaattctactcattcatttattttgtaaataaatgcattcattcaatgttgtcgtgagttgggagggagaaatgtctgactgttcatttttctgccaaatgattatatagaacttaatagtatgaattatgaatcagactgcttgggattgaatcacaggtctgccactatctatgtgaccttgagtaagttgtttaacctctctgcacctcagttcccatctgtgaaatggggatataataataacttcatggagttgttgtgaggattaaattaattcataaatacaaagtacttaaaacggtgcctggtgcagcttaagagctatagacaactttgctattatttatctagtgatcttagcatgccccattagaatggaaaggggtggagcttcataaatctttttgaagtgagatcttcaagacatggatgctgatagatgccagactatcatggatgcgagtctcagcatctgatgggataagaacatggtttatcatttttgatcctgaatttgaataggtaagagatgagtaatgagaaaaaagaagggaggaaaagaagtctgcaaaatagagactgagaccgggcaatataaagggtttgtaaagcatcttgatagtgagatgtctggaggagatttctaaacgggttctgttctgctctttgatagttgttttgttggtggctatagagatttttttttccccctgaagctcctctccccattattgtgtgaagttcactcttcttgcaaatgtgagtggagtttttagaaattcaaagcaatagttgaattttttctccagctaagtcttctagactaaaacagagatacccatctagaaacaaatattgagagacaagaggtgctgggttttctgaaaatttgccaaagtactggagaagatgtctacaggctgcacagttggggaggataagaagctaattttgctgagatctcaaaggtcagcgagaccctagataaaatataaaccaacatttactagaagcagctgtgtagtagtcatttcccagaggtctgagaattaagacctatcactagcccttctgtgttatgttagcgagtaaccatgttacgtgcctagtttagggtaggatgatattgatgggtggagaagtcagagaagggtctgctcctctccttgattcatccactcaccctcttgctttgaacttctccaaatggctgaggttttagactttacactggtggaatttcatatacaatcacataataggcacataaaatatatttcatctaatctttctaacagccccaagaggcagatcatactgtcttttcaaaaaaaaaataacagtaaggtgaggagattcatagttataggtgtgaacgggctttaggatctgataagccgaaactggattgattgatagctttgcctggtcctatctgtaggtccttgagcaaagtatctaacttctaggagcttatattttctctgaacaaggagatcttgaaggattgtgtaacagttacaacagagtgccagttgttggaaaatacctacaaaatggtggtgttactattttcttattcttttgcacttttttttatatccatagatagtaaatgctcaacaattcagtgatgaaattaagtgaaattatcttcctaaactaggctactatagtcctgttaactcctgcgtgtagtttacaatgaatccttgtgtcccttgtatggaaaaatctgcttaatttatcagctctgccaagttcttacaaaaacaaaagaaaaggtgaagaagcagaaaaacaaatggaagatatcctttctgtagtcttttactgttgacatagatttcctctgcagaagagaaaactatggctttaaaactgggatggttcatactcaaaaagaatcagagctggtctggtatgagttggttatggactgaaagggttaggttatgtcaaaacttttcatgagctagtacaagcaggattctcttgtttattgttatattttaaaagacattccaggcaataaagaaagaaactccctcagcatgttctggctttgggcccctgtctcggtcatgttggtgcggcaatggagtgggtgtctatctcccagatgtgtaagtgcagaatgggttgcaacctggattcttgattgagaaaccttctgttcctctatagatgaaggtctatttccttcctcctgaggcttaaatggggaggcatggaaagcctcacacaggactgacctggataaaagggtctttgtgaagagaaggcaatttatcaactgcagggccatttcagggaatgatttaactgtggtcactgtgctgttcacagcaactttacatccacacctatagccccaactttgccatcaatttgcaaacacatacctgatggacacctatgctgatctgatgttttggggggctttctcttgggttccaagtatttaattttattgcatttgaggaactaggaaggagggaggaaaacgtttaaaaagagagacatttttagggaatttagccaatgttccaaagagccatgttgatgaaatggagcagtttaagtgaaaacaaattgagtttggaaaaaaaaaaaaaatttcctccacccagtggcatttggagcttccattctgagttacttctaacttcctggagccacgtttactttgctgagcagactaaatcatttaagttgtcagcttctccctgtccttgccagacctcactcaaggaatgcttccagggccatgggagctcacaaaggcctcagtctgcctgagtcactctctggggaccacatatccacagggcaagtttctctgtcctaatttaaggcttctcaaagtcaggggagagcctttctgtttccatccacaaaataggtcagaaggatatgataatagcgataggtagaattttatttagcgttccttgtgtgtagcaagtaccatgttgagagctttatattcattaattaataaactcttcacaaccatctgatatgggaagctaataatcttctggttttatagacattcttttttctgagaatcagaacaaacaacttgatcaagattatgcagcagcattgggcttcaaaaccaggtggtttgtcttaaacttagctcctaatactcagctctatttctctggggacattggatgttattgcagttccccaccatgcagctcactcagcaccagggtatgtgctgtatggggtgaggagagggggaggagaagggacagctgtgattcaattagcacaggtctctgctaattgcagagaaggagcctaaattctagaggggagacaagtgtatgaacaaaatcatcagagcagagtgacagagtgtctagaagtactaaagagggcttagtacaaagtctagatgtactaaggaggaatgagcaattaggtctttctctgagtaaggaaggggctttgtaaaggaagacttgaagagaagatcatccttggacaagaacttcagcatagaagaagtttatctaaaacatgattgacaacgagaccagcaggggcaaaaacacagagagaggtggacgagaatggtgtggcagataaatagaaggagcctagaattgctctagtgtcaactgaaaggtaatagaatgctaatcagtatctattttttttgcctcctttgtaattaggtgaagcagtattctgatttcatttctggatgatagaataggacaggaaattatatgcccatctaccaagtctggctcatcaacccttcaataactgatccttttcctttctccccatattctggcagacaaagagaactcagaacccaaaggacccagaagaccaaagaaaacaaggtctctgaattattgccccaggcaatcacccctctctcagtggacacacttttattgtgttatgctgataaaatttggggattattcattctagtgcttagtctacctttactaatcatggtggttgggaaaggaaaatgatcactcagagccttatacatggaatgaagaggttaggatttatctttaaggagattgagagctattgcacagttttaagcaacagagtggttcagatctgtggctcaggatgtttgttctgaatgctgtgttgtctgaatgggttggcgctagatggtgggaatgggagacatgagtggctaatggtctatctgcgctgctctcaagggtatgcctaactcctactccatctgcgctgctctcaagggtatgcctaactccatcattttattcaatttttgtacactgtggacattgcatacagtggcataaatggataaatgacttcatcactaccaatgattttatgccagtcatggagcttggcattgacgtgcatcatctcctttaaaacttgccagaactcaggagataaatatcatgattctcctctaacaggtgaggaaacagaagcttggtcagtttgggcaacttcctcaaagacctgcagtctttaaattcttgagctgaggcttgtactcaggcttctgattccagagtttatactcttttcattaacctgcttgctgagtaacttttttgtttgtttgtttgtttgttttcagatggagtttcactcttgtcgcccaggatggagtacaatggcatgatcttggctcactgcaacctctgcttccagggttcaagtgattctcctgcctcagcctcctgagtaggtgggcttataggtgcccgccatgatgcccagctaatttttgtttcattagtacaaatagggtttcactatgtcggccaggcttgtctcgaattcctgacctcaggtgatctgcccgcctcggcctcccaaagtgctgggattacaggtgtgaaccaccgtgcccggtttgagtaacctttaagtaagaaagtgccttttgggttgagtttaacaatttccatggtagagagtctcttctgctatatgctgtttacttagcttctgcctagtatatgcagcagcagaaaatggtttcccttgttgtaggtctaatgagatttagaacactttgggtcctcagatatagtgagcaagattttcacttcatagatgaaggaactgcagcctaaagaattgggaagaaaaggtttatccaggcttgctgtgcattccttcctttctctgggaattcccttggagaagaaatctggctgatcaaatctccttgtaaacatgctgtgaagactctggggaaaaccactaatgatatttgttagtggcagtctttatctttgagagacttttagcagcatgaaccttacccccgtagtagaattgtatatggtaaacaaacctggaatctaaggattcatgggtaatggcttcttgaaaagtgtcaagtaagctatgtaactatggcaggagatggaactacttcagggttaaaaaagctggctttcatttcgtgcaagtaatgtacttgtgtacatcttttggagaaccatatgttaaatccgaatcagaccaagtcctaatgtggtaagaaaagggctgtggagtagtattggcagtcctgggcttttccctatgttccctgtaccttgtgattacttatagctttgacattattagtaaagtttgatacttggtaaaatattttattcttgtgggtctaatttgaaaatctagcccttgtgttatctccaacagatactgcctgatccaagatcacaaagttgggcagcaatgaaagatctaatctcagacctcttctctcctgtatcccaaaccagtgcaacaatgaggtttcctctgttcctacatatttatttctacatcttcttacgtggtttagaatgatgatgatgatgatgatgatgataatgataaaatcagcaactacctttaatttaccttactatgtgtcagacatagtgcttctcattatataaaaacagtataagcaacacatctatatgtaaaaactctcacgtcgtgaaacatatgtatagagaccctatcgggttaaaccttatgaaacttctaatatgtatttaacctacaaaacaggaatgtcatttggctcaatccaatataatatgccaggtagtttaaattaggtggacaagaaaggcctctgaagatctgagatcgaacaacgggaacttggcatataaaagttcagaaaagagaagaacctatgcaaagggaatcttctgcttcaaggactctgaggatgggaccaggtgcagtttgagcactgagagtcctgttatggctgaagtagagtgagtaagacagagtggtacaggttgagttgggatgggtagacagaaataagaccattgagctttggaagtaggagtaaagagtttgagttttatactaaatgggttttgactggggacagagaggaaaaaatgagatgtgattgattgattgataatttattatttttatagatttagggggtgcaagtgcaaatttgctacatggatgtactgcattgtggtgaagtctgggcttttcgtgtactcatcacccaaattgtgaacactgtaccatataggtaatttttcaaccctcatcctcctcttgccctcccacattctggagtctccaatgtctagtcttccacactgtacgtccatatttacccattgtttagctcccatgtactcatcacccaattagtgaacactgtaccatataggtaatttttcaacccttatccccttcttgccctcccaccttccggagtctccagtgtctagtcttccacactgtatgtccatgtgtacccattgtttagctcccacatactcatcgcccaattaatgaacactgtaccatataggtagtttttcaaccttcatccccctcttgccctcccaccttctggagtctccaatgtcttgtcttccacactgtatgtccatgggtacccattgtttagctcccacgtataagtgagaacatatagtacctgactttttgtttctgagtcatttcacttaggataatgacctctagctccataattttatttttaaagagtttctctagctgccaagtggagaatgggctatagggctataaaagcggcagcaaggagactatgtgggctgttactgtagtgggcaaggcaacagccagtgaaggcccagactagagtgatagcaattggatggagataactctgcagatgaggggtttatttttgttgcttgtgacaggcaagttcccatgctccctggtagccaccttatgaaaggtcttgttgatgtttcagagaacatttacaaacaacatctcagacaaggctgtggaaacaaggggtttcactcacttactttgatgtctgacttgtggatacaatactgtaagttaatcctctcctttgtctcagagaagggtttgctttgggtagcttagagcacttgacaggaggcattttgtagcagccctattacccaaggggtataggaaaagctacagaccagaactgatatgctcttctctagaaaatgaaactgcttccagatccagagataattagacaaatgtctcactgctgcagggagcaagaaagaagggctacgatgggcagattcttggcatagctcttcaggatgtacaaggacttgcccagtgaccaggagagtaggggccactgaggaaaacaggctaaattaattgaatgatggggagaaggatgaggaggagaggaaagggagattggaatctgggactgcgcccaggctgcctttgtatgcgagttccctaacaacgctttctgagggaagtcagggactgactgaagcttaattcagattctctgaatgtgccttaaggagacagactgaggaatggtctgatgaaatgcaggggaagcaaaacttggcaagggcacagtggcaaatgagctgagaatatggggggagatcctgccaagacccccttccccccaggaccacccttggtgtatccggagaaatcaatcaattggacgggactggatggctcccacagaacagcagtgggggacccctgtgagagctgggggtcttccatttacagacaggatttgggcctcaacagagcattaagatgggtcagtgcaggcataggggacgccctgaaagtcttgtcatatcctgtggatgactcaatggtgccaaaagctatgcccattcctggactgtgcccagggaattatagtcttgcctcccacttcgtgtgaaggccctggggcaggaagcgtgacatggttccaatatccctacactgggggcatttgtaagagccttgtagagagttcacaaaaatcattaagtctacaaaacatcccttcctgatgccacctctttcctctcttgggtatttgtagtattcttctctaaatatctagctggatacattcgtgcccccacttaggcagccaaatcttcattcactcccttctggggtcgtctgccagatttgttgaaattaaaagttggaaataacttgatatatgtaaacttcctcctgcacctcctatcaattttataaccaaatgtaagaaaagcttttataatatccaaagagctttacccaatatatctctgcatctcactcaaagtttgtgaagtagctattattatccccaactgacttgtgaaaaacaggctcagagaagcagaggcctgcccaaagtcacactgtaaatgtcctgaaacagaggggcctggaacccaggtctcctagtttctatccagcctactcacccctgtacaatgctaccttcattatcttactttttattccactatgtcaatgggtaaaacagaataaaataatattcccttgttcccatgtctacctaaatgtggatgcagtctctagtatgctttccttgaactcagtggagacaatctttcatctggaaaaaattcattttttaaggtttccagtctcattgactgccctctccaacctcatactttctgatccaacactactactcataatgatttaaataaaccccaaactgttatttcacactactgcatgtttctttgttaaggctcttttccctattccaattgtccttctctttgaatagaaaacttctatccttcctcaagccctagaaatctacccttgacctccaagtaagtcaaatgggttgtctgatcccatatcccctctctatatgtacctcatcatagcactcactgggctctcttagaattgtctctttaaatgcctggcctcttcctctggcccagaagccacttggggacagggactttctatctccagcatctaatgcagaatttgaccaataattgcaggtgcttgggaaacatttattgccttgatcagaaatcacaaactgacaaatagtttctagttattaaataatcatttatcactcccagaaataatgccattggaactttcttataatcttgcatacaataaaatatacagattctaagtattcagttagatgagttttcacatttatatgcatctggggaaccaccacctcaaagaagttatagacatgttttttttgttgttgtttgttttccttgcttccagcccacaagagcagtctgttaaacaccttggccaaggctaagaatgtcagttttaaattaatatctgaatatgagctgcctcctacaagtataaaccttggcccaagggcccacaagggccacagccaattggcagggtcatggtaaatgatgcaaaggatggcatcactcttttcaggagaaatagcatggttggcgatgtatcattaactgaatgacattttgtatctctttcattcgtggtcactgatctgtgcaaaaccctccttcccttgctctaagcagagaagccccaaagaatctaaatcagccagggacaggtaagtaagcccagggtcttaaatcacccataagtttgtggccaggtttgcatttggtcctgaaggatgtattttcctttcatgggttgtgggccaatgtttcttttcctgctgatttatagcctcctataaattaacaggagcctttcaactgggaacgccacatcccaaaggcatgaatcttccgtaggtaattcctccctgaggaagaaagagttagctctcaattacatacagcgatgggggtgcatggtggctgaaatgatacaaatgccacttatattcaagttggagccttttcacaaagtcacagaaagacacagtgagatttgagtcccagaagcataaaagtcccagagaaaggggccttgacatagctttacttgcattgaatacagatttgttcaacccccatgagaggagaaatactgaaacaccggaaaacattgtctcctctcataacattttcagctcatggtgaagacggacacatccataactatactaccagctaacatttcccactcatttggaaattatttttaccaatattttagtgactcaagcattcagggtcataataaaaggggaaaatgtactaaatcacaatttttactgagtctgatattcaatttctttgattcatttcttctttatttaatcaaatattcaccaagtattactaggtaccagacatcatgccagggactagaaataatgtgaaaaaaaaggatgttttctgctctcacggggttcacagctgtggtggctgaggaactgtggtctctgctccccaccaattatacatcagctggacataagtaagtgtgcagtaaaacagaaatttaaattttgaggtagaaaatttacttatgaattctatcactcttaaatatatatattttgtattgagggaggagaaagtggattacagtttcaaagaggcataactaggagtcaggaagcctggcgtctattcccaaatccttttctcattagctggtgatttataaaagtcatttaaactcagtcccagttctgtcatatgtacaattgtgtaaggcttaccctggaagttataaattctatgtgtttttgatcggaatccttcactgtacaatttatttgttctcttatacattcaccacttattcattcattctgctaaataaacattcatttgtcccatgtgttaattttaatggctactataacaaattacacaaatttggtggcctaaaacatgagaaatgtatcctttcccaattattggagaccaagagtccaaaatcagtattactgggctgaaatcaagttgtcagtaggatgtgttactttagggtgctctaggggatagtgtgttccttgcccctttgattttttagtggctgtctttattttttggctggtggctgcattactccaatctctgcccctgtaatcacattgcttcctcttctgagtgtgaaatctccctttgcctccttcttataaggatatatgtgattacatttagggtctacctagataatccaggataaacttttcatctgaaaaattttaattaatcattcctgcaaaatctcatttttgcaacatgagataatgaatagccacagaatccaagcatgaggatgtcttgtgcagggacattattcagcctaccacttcctttatttatgtgtatgccactttctcctccctcaacatgaaatatatatatatatatatatatatatatataatttaagaatgatataatttataagtaaattttctacctcaaaatttaattttctattttactccacattttgagaatgagtaaagtataccggttaataatacagactttggaatcaaaagagttttgtcctgagtactgtctctgccacttcttatctgtgatcttgggaaaagtacttgcattataataatatgtgtcacattaaattacatatgtaaattatttagtacagttagttcataatattaactaatcagtggatatcagaaaatatcaatattaggtatatatgtggtctagatttggaggaacttgtccacgcccctggcaaattcaagatatggttaagaaattgtgaaataaacagttccaatgaaattcagtaacttttttttttaagagatggaacctcgctctgtcactcaggctgaagtgtggtggattatcatatgtggcttactgcagcttcgaacttgcagactcaagcaatccttctgcctcagtctctggagtacctgggactacaggcatacacaaccacacctggctaatttttttttaatttttatttttgtagagacaggatcttgttattttgcctaggcaagtttcaaacacctggcctcaagcaaacctcccccacttggcatctcaaactgtgggaattatagatgtgagccaccatgcctagcctaagttcagtaacttctattagcaaggaaatgtcagggattttctttgttttctttctttttttaatttttattttattttttggagtggaggtttaaaaagcagaagaaagagaaagaaaaacagttctctattgagagagatgggatttctgagaggaaagacggctggtggcagatgcgccagatttacagtcaggtttgaggaggtggtgtctgatttacatagggctcacaggcttccctgaactataaaatttcctgcacattttatagaatgtgagggtagagagggtaggagatatgacggtcacggacaggaaaggaggaaattaggatagaaaagttgaagaccctgttgctgacacccatcgggtggtcaaaggctggggtcagtccagaagcctttggatagcaccagggggtagcctcagccagaaatcctcgtttgctacaggacctcttccagccccagatgatggctaagtactctgtgaaaggaagctggttcaaacatggccaatatgcccaggaacccatgggcaccgggggattctccatgttgtcctcagcaagcctgtcccccagatttgaagattctgtgggtagaaacagtggtaattggatgctgaatgtgaagaaaagagagaagttctagataatccctatcatttttcccaaatggtggagtgaaatgaggtcactcgttagacagagaacccaggcagaatggcaaaaattccataaagaataattatatttcctctttccttttaaagaaatccaaaagtcctcttccttctccccttccacatttcccttctcctttccttctcctcctctctctcctccttctctttcttcttttcttctgtgtagctggcagcattggtataagccaacaggaaaaagtgagacaaatctcagactcgacagaatgtgtcttttcctgtctcttccccaaacagctttctagatgccaagctctttcctacctggtggtcatcttgctgccaattgatctctttctgaaaggcttgtgtctaactacccccacccatgaacaccctctgcacacacaagacacagacatttaacctgctgatgtcctactcattatttaggctgtgtttaattgacatgttctaaggaaagtattcactatttttaagcattgactctccacctcactaccatgaaaatacacacacacacacacacacacacacacacacacagtttatgctctgttatatactgctctgattttctgtatctttcactttttgcactatcacaactataataaaatatttgaattactatctatataatgcccttctctcccattagtccataagcaccaagagacaaaatccatgtctgctttcctcactgtggtatcttttgaacttatcacagaacctggaaaataccaagttataaacatattctgaatgaaataatacaaacgaatcaatgaatgaatgatggataaatgcagtgtactataataatgatgtaaggaaccacttctaagcacacagaaagcataagacaaatgttcaagacacacatgcacctgtaaaatgagtctctgatcaggatagctgctccaatcatgggacattagacacttggtcttcctgagaattactcattggtaagcactttacagtttatgagcttctctcacttgcattatctcacatgatccacccagcagtattgaattggaagaattatcagttccaattgcaaatgaaaaaaaaaagaaaaaggcccatggagacattgtaatgacccaaggtgtcacagagactgagtgggagggttagcattttttttttttctttttgagatggagtctcgctctgtcacccaggctggagtgcagtggcacgatctcggctcactgcaagctgcgccttctgggttcacgccattctcctgcctcagcctcccgagtagttgggactccaggcgcccgccaccacgcctggctaatttttttgtatttttagtagggacagagtttcaccatgttagccaggagggtctcgatctcctgacctcatgatctgcccacctcagcctcccaaagtgctgggattacaggtgtgagccaccgcgcctggccagggttagcatttaaatccatgtttttaattctgaagacatttttctccataccttgatgtccttcagacagataggcatttactaagcaccgactctgctatgtgccagggatatgcagataaaattgattctctgtatggacgcaaatagataaatagacagaatgggtccatacctagtgtggaaggagttgcaaggagtgggcaacttagtcggttctaggactggctcgaagtctggaaccagaggacacagagccaggcaggggcagcacctcccttacagacagggctaatccctggcaagtcagggctgtggagtgcttggggaatgacctcagagacagacagggagggccctggtcttgcctgcttagctgccgacagtcccagatcctaaggtggcccagtaacagcagggggacagggggacctgccctcggtcctcaattttttcatggtccttgcctcccttccaagcccctctactatcctggcaccatttcttcctgggcacctaacgcagacctcatcctctgtcctctttagtttttattaaagagacagctgatgaggacttagagtgctacccctgcagaggaacagagaagggaggtgtgtggtgagaagaggtttggtcaatgtgtgatttttcttgcaatgcccctttatcaacctgaggtaagggcactttgggtactttggtttgggttgagaagataatttgggatatgttgggtgaatgatttgaaatgaagcagtcagaccatttaagaacacgggctttggaatcagagatctgagttcaaatatgagtttcactgcttcacttcctgattatgccacctcaggcaggttacttgacattgctgtgtctcacttttatcatttgcatctgcaaaataattgtcctaaaaaccaattcatagagttggctcaaggacacagctggtaccaagtgaatgatggtcatacatgtatgtgtgtgtgcatgtgtgtgtgtgtgtgtgtgagagagagagagacagagaaagggagggaggaagagagtgtgtgtttttgcatatgacttagcatttattgagtacttctttggtagaaactatgctaattgtcatgtgtatatgattatctgatacagattttattaaacccattttacagatgagaaaaatggaagctcagacaacttaagtaatttgactcaggtcaaatggctagaaagtgcagacccaggatttgagatttaaatcaggtttcttgatgccaaagcacctgcgtatgggtagtctttctaatacacagcaaagtggaagctgtctctcttgaccttgagccactccttgcggcaaagtttccagttaacatgaaacccaatcagattccccaaaatagcagcctgttcctctagggagaagaggagccccacccaaagcttgctccagagtcttggaggaaagaaaaaggagggagcagagagtcttgcttaaaaatgtgacacatattttccaggagctgcctccaggcctgggatggagattctgagcatcatgattttaaactttttacttaatttttcattcttgcttcaggcctgggcaagctggactctcgagtcttgaacaaaaatggaaaaataagggctgcagttgaaatcatttcactgtgcctatttcacatgatgctgcctgcaaaaaatatagcaaacaagattcctctgttcagtttatctccagaaagagggaacctgcatggagaaactgtaaggagtgagagagaggtttcggagaaagatgagctttagctttgcaaaggtgggatttgttttgcacagtaaatttctggaattatttcatttgatttcccattgtttgagtgtactgggtggtacaccttgtgctaggcactggaggagctcttagaggatttaaagagtcataatctctaagtgatatgagtagtggggtttgttcaaagaagagaactagcaaagagcagggcataatgaactaactataggtcaattttctcctctttcaagtcctagtttaaacacagaatacaaaatatgtctttcaaaatgatcatctttcactaaaggaagctgattaaatgtacaggtgcagcctctagaccttcctcacatgcttttctctagctggaagcagagcaatgcaatttacatgggcactgtgatcaattcttaacatggggattgtgaagcactcaaagagacttgattggattaaagactgataaatctttcctttaagttttctgaaaatgataaaaagaaaacaaacaaacaaaaaaaagaaataaaatctactccatcttccgtgaacgtggaaatagctataaccctgaaccacagactttgatatattcctacttagcaccacgaaatcttgttatggacctgaaactgggtgcagattttcctagaagtgccacaatcctcaaaagaccattcagtggtcctttgattaaagtagaagaatttaaaattgtggcaagccatggaagaagagagataatgctataaaaaaccactggtctggagatggacgctatatcatgatatttgtaactgattgtgatttagcccacctagatggtcactgcatctctggggaaaagaaaggtggaggatgacatgaaaatagcgttcaccgaatgacaagccagaaggcttgtgtatacagagatagcatggaagccaaactgatcttccaaatacctaaaccagaaagaattgacagctgcatgcaggaatggaagggttaaatttgataaaagtgttctggaaaacaaacttgcaataaaaatgaatactgcctttaaagaacttccctccatctttgacttctgcactcctcactctgcacaatattgtttagtaaatactttgtcatgttaaaaagaattatgagcaagaaataagaacagaagtttatgcatagacactgaataagcaaagcaatgaaaagcaaacaaaagaacacacatcactggaggaagagttctagcaaatagttttccagttcctgacagcttcaagaacattaggtcaccctgatatctcttttgcataaaaaagggagctctgagctaaaaagcaagagttctagtttaaaaaaaaggaaaaaaaaaaaaaaaaaaagaaggtgagaagagctcaagaaataatcaaagaagaaattttaagtaatattgaagtggaagacacatgaaaattccagaagtagaatgaactcaactgaaaacatagtcaaggacaaagctgtgcttgagaacaatcacattagaaaatgttttatgagatgaaaataatttaacagaaagaaacatcatcatattacatgccaagaaatttttatatagaatcaacagcacagatcccagtaaatttaatacatttcagatgtgataataataatgtaataataataataaagtaatttagaaggaaaaaattcagagttgccttatactcctccacagcaacatgtaatagcagaagacagtggcataatatccataatgtttaaagggaagaaaactagacccattatacccagcatagcttgtctttagaagatgaagacaaaggatctacaacctcagacatacagatattcatcctatggcatgcataaatcttccttagaattaaaaaaacagacacaagacaaagaaatgcacccaatgaagaaatgaaaaaggaaaaaaaaaaacttagagaagtctaggaaaaagattgattggtagtgaacattaaatccatttaagtatataactaagattactagctctgagtattactattacctagtagaataaaatattataaaacttgacaataaaaataatactgtaaataagaaaacagggaaatcaagaattcaagagatactatgtgcatggtgcgatcttggctcactgcaacctctgcctcctgggttcaagcgattctcctgcctcagcctcctgggtagctgggattacaggtgtgtgccaccatgcctggctaattttttttttttttttttttttgtatttttagtagagatggggtttcaccatgttggtcaggctggtctcgaactcctgacctcgtgatctgcccacctcagcctccaaaatgctgggattacaggcgtgagccaccatgcctggcctataatttttaaaaatatcttcaatctaattttttaaaataacattttctgccttgaactttagaggagattttcataagtgaaatctatttgtgtaaggaaacttaaataaatttttcagttactcctttagtttcatgttaggctctactttataatacattcaagacaagtgaaaataatcctttacattttaagtgggctgcattggacgactctgctttcattgaggggatatgtataggtaatgattagtttaaagaagacatatctgtgattttttttcttaatcaaatttgtatctgttttaagaagtgcacatgatggaatcaagtgggcaatctctcagaagccataggagatgtgttaataaaatagtagaatagggatcaaatagaattagattgaaattaaaatctatgaaggtgaagaagaaaaaagaataatgaataaaagatgaggaaatgaggaaagatgtactgtgccttaggactactgaataccataataagccatgctcagtagtaaaagagaatgtcataggaagtgtgtattacaactgtgagccctacacagctcaacacttatacttggtaggtttcttataacatctgatactaatacgccctttgcattaaaaataaaagttttttgtacaattaaccttctcaaatgtcatcaacaagtcatcaggactgatgtttaaccaaatctgcttctaccttttgaaattaagatcagctatattattctctcaagagttttatcattagactctggacttggatgtctatcccactcatggttatagactctgtgaagaatatatattgtgtaatttttgcatgtttatttactatccttcagaatctggcatagtacttggcatgtagtagtgcttaataagtgtttgtgaattgagttaacaagtatttgtgaatgatatgtgtatgaagattaagccctcttcccaaggtgcacctaggaaggggaacatcacacaccagggcctgtcatggggtgggggagcaggggagggataacattaggagatatacctaatgtaaatgatgagttaatgggtgcagcacaccaacatggcacatgtatacatatataacaaacctgcgcattgtgcacatgtaccctagaacttaaagtataataaaaaaaggaaaaaaaaataaaaaaatatatagtgccaactactgttatattctagagtgacccatgcagaatatgcagaggatgagcttaaagattatgtgaccaatagcccaatattcacctggaggatataaaatgaacgaaaagaagatttcactcacttcagtgagtgagtgaagctttaaggagactggaaactgtaggcagtggctgacgctggcttcctctctgttaaagcctaataagaaaaactgtgcctggtatttgctctggtaatagatgatgagggagagttctactgaaaaatacctgctcttccagagtgcattggagcataggatatatacttctaatgggtcagatggtggtcacttggaaagagctgcccaggagtcatccaaaagaggttgtaatttttcccaagagagatttctggatgggtgatgagaccccagtagaaagtatcaatgaggtcaccagaggccaaagggaaattgtagggagtccaccacaggatactggaagtgggacaccctgaggtgatggaggaatgtccatgaaggacttataaacacatcttcaaaaagcttcagatttgaacatccatggaacccagactcagattttagatcccattatgcccaatggaaaccaatactagatgattatattagcattgaaaaaggaacactgtgatggttaataatgagtgtcaacttgattgaattgaaggatgcaaagtattgttcctaagtgtgtctgtgagggtgttgccaaaggagattaatatttgagtcagtggactgggagaggcagacccaccctcaatctgagtggccatcatctaatcagctgcctgcgaggatagaataaagcaggcagaagaacgtggaaggatttgacttgctaagtcttccagctttcatctttctcctgtgctggatgcttcctgcccttgaacgttggcctcgatgttcttcagcttttggactcttagagttacaccagtggtttgccaggggctcctgggcctttggccacacattgaagggtgctctgttggctttcatactttgaggttttgggacttggactggcttcctttcccctcagcttgcagatggccctattgtgggacctcaccttgtgattgtgtgagaaaatactccttaataaactccccttcatatatactatctatcctattacttctgtacttctagagaaccctgactaatacagagacctttcctgccctttatttcccctcagtgttccagtgaaatcctgaggagccagaggcagcttcctgaatgggtgaagggataacagccctcacaaggaaaaagagagaaaggcagccatgtccctgtgtttctcccatttttaaaaccatcagatctcatgagactcactcactatcatgagaacagcacagaaaagacccgcccccatggtttaatcatctttcactgggtccctcccacaacacatgagaattatgtgagctacaagatgagatttgggtggggacatacagccaaaccatatcattctcccctgacacctcccaaatatcatgtcttcagatttcaaaaccaattatgccttcccaacagtccctcaaagtcttaactcatttcagcattaactcaaaagtccacagtccaaagtcttatctacgacaaggcaagtctctttggcctatgagcccgtaaaatcaaaagcaagttagttacttcctagatgcaatgggggtacaggcattgggtaaatacagccattccaaatggggaaaattggccaaaacaaagaggctactggccccatgcaagtttgaaaaccagcagggcaatcaaatctttttttttttttttttttttttttttttttttttttttttttttttttttgagacggagtcttgctctgtggcccaggtgggagtgcagtggcgcaatctcggctcactgcaagctccgcctcccgggttcacgccattctcctgcctcagcctcccgagtagctgggactacaggcgcccgccaccacgcccggctaatttttttgtatttttagtagagacggggtttcaccgtgttagccaggatggtctcgatctcctgacctcgtgatccgcccgcctcggcctcccaaagtgctgggattacaagcgtgagccaccgcgcccggccggcaatcaaatcttaaagctcccaaatgatctcttttagctccatgtctcacatccaggtcacactgatgcaacaggtaggctcccatggtcttgggcagctctgcccctgtggcttttcagggtacagcctccctcccagctgctttcatgggctggtgttgagtgtctgtggcttttccaggcaaacggtgcaagctgtcagtggatctgccattctggggtctggaggatggtgaccttctcctcaaggctccactaggtggtgccccagtagggactctgtgtgggggctccaaccccacacttcccttccgcactgccctagcagaggttctccatgagctccctgcttctgcagcaaacttctgcctggacatccaggcatttccatacatcctgaaatttagatggaggttcccaaacctcagttcttcacttctgtgcactgacaggctcagcaccacttggaagctgccaaggcttgaggcttacacactctgaagccatagcccaagctctacattggcccctttcagctgtggctggggtggctgggatgcagggcaccaagtcccaaggttgcacacagcactgggaccctgggtccagcccatgagaccatgtttttctcctaggcttccgggtctgtgatgggatgggctgccatgaagacctctgacatgccctggatgcattttacccatggtcttggggattaacattcagctcctcattacttatgcaaatttctgcagctggcttgaatttctccttagaaaaatgggattttcttttctatcgcattgtctggctgcaaaatttccaaacttttatgctctgtttcccttataaaactgaatgcctttaacagcacccaagtgacctcttgcatgcttttctgcttagagatttcttctgccagatactctaaatcatctctctcaagttcaaagttctacaaatctctagggtaggggcaaaatgccaccagtctctttgctaaaacatagcaagattcacctttgctccggttcccaacaagttccttatttccatctgagaccacctcagtgtggcccttattgttcacatcactatcagcatttttgtcaaagccattgaacaagtttctaggaggttccaacctttcccatatttccctgtcttcttctgagccttccaaactgttccaacctctgcctgttacctatttccaaagtcgcttccgcatttcaggtctcttttcagcagtgctccactctactggtaccaatttagtgtattagtccatttttgtgctgctgataaagacatacccaagactgggcaatttacataagaaagaggtttaactggacttacagtttcatgtggctggggaagtctctgaatcatggcagaaggcaagaaggagcaagtcccatcttatgtggatggcagcaagcaaaagataacttgcgcagggaaactcccatttttaaaaccatcagatctcctgagacccactcactatcatgagaacagcatgggaaagatccaacctcatgatttactcatcttccattgggtccctcccacaacacgtgggaattatgggagctacaagatgagatttgggtggggacacagagccaaaccatatcatcatctttaaggagacattattaagtttatgataaaggctctgataaaatgcccatgcttggagatgaagtagccttaaaaaattgattgcaacttaattcgctcactagcacaagagtgtcctttgtaaaactgagcagaaatcagctcctagaaataatgaatgtttatcaattaattggattgatgatttcttatcagacctttctctggttggattatttactctagacactccactgtttgtttatgtattgctaagattgctatgatcatattaaatcccaagtttattcctcaagggattttatatctgttttgtttgtctaagaactgtgacctcacttgagtcatttaaacaattcatatttctgcctttcctttaataatctttctcttagtcatccctgataaatttgggcttgtttgcttttcaacattctgcttttgatgcatcccatgacactcaagcagagcagttttctagaaatttagaacagagggctagacttcatgggcaatgttagtaatacagcaattttctgtatgttattaatttagagatagatatattttaagatagtaagtgaatagagaaggaaaaaggagcacggaaggaagactaaacttgaaaaagaggaatgaagcagctaaacagatgatcaataataatgattccagttaatggcaagtttcattaattaagtaattactaggttccaggccctgcaaattgttttatccacattatattatgtaattctcaatacaacagtaaggtatattcttttcctcatgttaccaaggaaactgaggcttggagatgttaaatcacttgctacaggtcatacagcttttaaatcacaaagaaaattaatcgcaaagaaacttagtttcttttcaacttcgcagtctattacatctttaaccactgtgctctgttgcctcttaagtatgagaataaaccagtagttcttcacttggagtgattttacccccagaagatatttggcaatgtctggagacattttggttgtcacagcttctgggtgggaggaaaaaggggtgctactggcgtctactgggtaaaggccaaggatgctgtgaaacatcctacaatgcacaagacagcccctacaacaaagacatacttggctcaaaatatcaataatgctgagatcaagaatggaatgaagttactgatctttttaaaaattatatttttatctcattaatattaacactagtatgtctagagggactgaaattatacaaggaaatgagtttgctgtgcagaaagaagaggaaaaggaatatactttggagtgggacttagagccttgggaggaatttgctgaccacaaacacgtcattgttaatagtaagttctgagttaccactgcatgccagccatcctttgcatgggtggtttggggcctacatagaaagaattggcctttgaatcaatactcaatgattgtaacagatttgcctgtctcctgtgtttttgctattctttctttatgaaaaaaattagtgtccattttaaaaggaggatctgttacctgctatatttagcgtcatgaaggaggagaactgcaatatttgctttccataaatttgcaaaaagaaagatattttccacccacccccacccatgcaatggttttccactgacagctgtatatatgggtatcctgccatatatctctggagtgaagaagacctgggaggcgtgggcaggccaatgaatggagccattgactcagatgttcctcgatgggcaggcgtgattatttcagggggccagttcttccactgtgaccgcatagctgagggcacagccaatgaatgagcttcacccaataatttctggttgattcacatttgggtcagtgatgtggtgggcaatgccagctgcagccccaggctccaagggcaactttccaagctgggactccttacaattctgccctgttaatggaggttggggcaaaatctagggtgggtccctccaggcatgagtgagtgaggcgagggaaaagaaggaaatggttttcataaattattgctagagtttttagagaaataaaagcatgggtttgagaaggaggtggaggactctcagcatcatgccactcctattgctcttcggataaagttcaaattgcctcatgtggcctactaggcctgtcatgagcaggttgccatgctatctttctctctagcctccccttaggctgccgttatcttcaatatctaccctccagtcaggctgaccacgttttagtatctctaacacggcattgttctctcctcaaagtctttgcaaatgctattactttatcctggaagggcttactcttcaacccccaacctgattaaatccttctcatcattaggatatagttgggatgtaactttcttgacctcccagactagatcagattgtggttacatgtttccatagtaacttgatcttcattgcagttatttcaatagctgtgttttccatctgtcttcctcatgagtctgtgagctataggagggccagaaaatatctaccttagtttatcttccatacctagtacctagtccagcgcctggcccgtagcaggttttactgaatatagtacttaataaaaaataataagggggagaaagaaggagagaagaaaagaagggagggaaggaaggaggacaggagcaaggaaggatacatggaagaaaggaagaggggaaagaagtagaagaaagaaagaagaaaggggataatttaatttgtaaaacaaaaacaatttccaatcatcagtttcaacctctggacttatctgtaaggtgatggcagaattgaagtctaaaatctaagtctcctgaatctcagttcaatagaacaaacaaataagtacaatagatccagatataattcagagagaggtcaattatccttgcaacttggaggaagtatacgagtttgctgtttctcagtgaaagccaattccctgtcgtggcctattgagcagccacatgttctatctgttgctattatttggagtatgattagaggcaccaggaaaataattagaaacatcaagagaaagattaggtgcatcagaagaatgagtaggggcattagcattgatcaagcaggaactctatgccaaggactatgcagggcacatgaaacacattttctcatggcatcctcacaaaccacacactgaggtgaggattgttccccgcagtgaggctaatgagaaaatcaagactcagagagtttcagggtatatgaggagaaagaataataccctggagacctggatgctttggtcacttattccctttccccaccccaggcctacctgatgacttttacttacacttcacatttgattcaaatgtcactttttcaggaggcattttctttttttcttttttttaattttactttatgttctggggtacatgtgcagaacgtgcagttttgttacataggtgtacatgtgccatggtggtttgctgcacccatcaacccatcacctgcattaagtatttctcctaatgctatccctcccctagctccccaccccccaacaggccccggtgtgtgttgttcccctccctgtgtccatgtattctcattgttcaactcccacttatgagtgagaacatgcagtgtttggttttctgttcttgtgatagtttgctgagaatgatggtttccagcttggaggggatttcttaccaccctcactaggtcaactcctctcttacagacctccatttcctctttgtacttgtcacttctaatcatgcatttttgagtgattagttgactagtatctgaatgcaaggcacatgtctgcattggtttgccgttgttttcccagctcctgaatagccctggcacataacaggttgccaataaccacttatgagcaaatgagttagatcattttgttgagcacatattctgtcctgggccctgtgctgattgatcttgctgtgtacagtggaaagtcatacatggtcactgctttcaaggagctcatagtcccatggggagattgtcttatttttttatgatattactatgttattttttaaagatactactttaaaaaataagagagttaaaatgttattggtaatagggggcccagggaagtccctgggtggagagaaggcagagatagttcattttacctaggaatgggtttctagaggagagggagcttggtgggagcccaggaaagtgaaaaggtgtttttcaggtggacaagggtgatatgtagttaggcagaaggaaatacagatgaagggagaaatatgagcagagggaaaagaaaaggagatgtgaaacaacatccatagcaaatggtttggtttacctggagcacctgctttgttcagaggcatgtccaagattgcagttgaagaggtgtctgtgggttagatcaggaagtggttttcatgcttgccttgggaaattgaactcttaatagtaaccacatgttgatggctaaacacagttaaaaggatattgaaccattcatccattatttgagtaaacatttattgggtacttacgtgctagcacgctgaaaaatgtgggtagaaataatacaaattccctcctccaagaagcctgcagtctatcaaatatgtaacagcagtcaggccctgacttctacgttaacttgtaagacacaaaaacaaaaatgaagcaaactgaaagcaatcggtcatcttctactcagcatacccagagtgggctgatagtgacagagtaggcaatgatgagggatgtgaggaaaggaggaattactgtgaagggaggatacataactccaggagctcttcctggagaaagtggctcagaggataaattctgcaatgcaaagagaagaatatgttttcaatgcacacatttttatgttcttaaatatctgttgcatttcccccccacgactcaggtctaaaaaagcttcccatctctgacattaagtgaccactccaactttatagtcctcccacatcctccacctaactaacctttcttgaacacctacattttgccaggcacttttataagcatttagttatagtattccatttacccactaacttgtaagatctgtttcataaacaccatcttgcagatgagacaactgaaaccagaaagtgttaggttgctgcaaaagtaattgtggttttgcattattggaatttgccatttgatattgaaatacattcttaaataaatgtggttatgttatacatcattttaatgggcatttcttgcttttattttttgctaatgacattacttgctgtttattttatgtttattttagactgtagaaatgatgttagacaaaaagcaaattcgagcaatttttttatacaagtttaaaatggtcataaagcagcacagacggttcacaacatcaacagcacatttggcccaggaactgctaacaaacgtacagtgcaatgatggttcaagaagttttgcaaaggagacaagagctttgatgatgaggagcatagtggctggccattggaagttggcaatggccagttgagagcaatcattgaagctgatcctcttacaactacatgagaatttgccaaagaactcaatattgaccattctacagtcactcagcatttgaagtaaattggaaaggttaaaaaacttgctaagtgggccgggcgtggtggctcacgcctgtaatcccagcacgttgggaggccgaggcgggcggatcacgaggtcaggagatcgagaccattctggctaacaggatgaaaccccatctctactaaaaatacaaaaaattagccgggcgcggtggtgggcgcctgtagtcccagctacttgggaggctgaggcaggagaatggcgtgaacccgggaggcggagcttgcagtgagccgagatcgcgccaccgcactccagcctgggcgacagagcgagactccggctcaaaaacaaacaaacaaacaaacaaacaaacaaaaaaaaaacaaaaattgctaagtgggtgcctcatgagctgagtgaaaattaaaaaatagtcatttttgaagtgccgtcttctcttattctacgcaacaaaccatttctcaattagattgtgacatgtgatgaaacgtggattttataccacaaccagtgaagactagctcagtggtttgactgagaagaagctccaaagcacttctcaaagccaaacttgcaccaaaaaaaaaatcatggtcaccagttggtggccggctgccagtctgatccactacagctttcttaatctgggtgaaagtattacatctgagaagtatgctcagcaaatcgatgagatgcaccaaaaactgcaacacctgcagccggcattggtcaacagaaagggtccaattctctacaacacctgactgcatgtcgaataaccagtacttcaaaatttgaacaaattggcccatgaagattcgcctcatccaccatattcacctgacctctcaccaaccgattaccacttcttcaagcagctcaacaacttttgcagggaaaacgcttccacaaccagcaagatgcagaaaaatgctttccaagagtttattgaatcccaaagcatagatttctactctacaggaataagcaaacttattcctcattggcaaaaatatgtctattgtaatggttcctattttgattaataaagatgtgtttgaccctagctataatgatttaaaattcgtggtccaaaaccacagttctttttgtaccaaccaatacagcaaaaatgtgttttcataaatgttctacaacaaaatctaagaactttccagtatattgtatggtataacacactttctagttcagatgtctgcaaactaaaaaaaaatgtgatgatcaaaaccattgaatgctagcaaagggattacccaatacttgtcatctcacagctattcattattgccaggaagttctcagacttcatgcaaaccttaccccctcatctttcacattaggaaactgaggcccagggaaattcagcactggctcagtgtgatggagagtgtttgtagccaggccagaagtgagatccaggtttatagttcctcttcttatgatcttctcactaacgtttatagttctaatgctagattctgattcttctcattttatgttctccttgcagtttgtaaggtgtgttgggaagggtataggttttgaagccatttggatctcggtccaggttagagatctaccactgatttactctgtggccaagaacgagcttcctcctgggtttcaatgtcctgtcaaatggggtaaaacaatctctctctagtaggtttgtgataagtgttaaaaaaagtcacgtatagagtaactaggacagagttcaacatataatccgacctaatacatgttcgtttttcaacttcccttgctaggagatggaaggaaggtgaaatctgccacgatcgctactttcaaagaatgtgaactctctttgctccctgcaccccaacaaagatttctctcttatcactgtgactgtgttatcagagggggataacatagtggttggaaacacttcctcagactggagagactggctaggatttgaagaatgcctccctagggtctctatgtcagtaacactttatgttcaccagtggagcacaccagttactttctggatagataaaacaattccattacttacctgtgcacaaaatgatttccgtctttgtcagggctgaggtgctagttttatgacataagggaggactctgattcgagactgctctttagtctcttatttcaaagatagtttttttctgagaaatggcaggattggagtgcgccttttcatggaagttcttttctctgaaataatggaaatttgtaagtccctataggaatggagtggctgaacttccagatctgaatttcactgaagatgtttctgacagacgtgtcccttcaatggtaatcttgccttcactagagatttgagaaaagaatgaagcatgttttgcattttgaaaatagaaaccatggcaccccatctctctctctctctctctctctctctctctctctctccctctgtgtgtgtgtgtgtgtgtgtgtgtcttttaccttgcctgcatctcctttttttattttttaaaaataaatatttttgttttattttgttttataaataaaagttttatttataaaaagtttactttataaaactttttataagttttatttataaaaataaaatgttataatttctatgtgtgcaaaaaaatgtatgcacctgtattctttatttccagtggaaaatggcaagattcagacagtttcccagatgtctccaaacctacttgttctagaatcatgtaacacaatatatatagacacaagtaatatctattttttttcttttcatgtacttctaacagtccacttttaagtgctcccatgaggcttttcttgatttgctttatttttcttttaaataaaatcttaagctgcccactccagtgatgaggtactacctagtcctagtaagagattgcagtgggatcgaatgggacaaaaacaaagaccatgaagcagtaagtacttcctaattattcaaagaaggcatgtggagcacttgccatgtggcagacacagtgctgggagctgaaattagaacagggggaaaaaagaaaagacatactacttgcccatacagtgctagcttcttagaaatttttggctgaatttatgaatgagagtattttttcatttataaaatgtaaataaaagcaaccatgtactagggcagttgtgagagttaaattacatgtatgcatgaatatgagtaaatatggcaaactggttaggaggtcaggctctgaagtcagaatgcctgagtttgaatcccagatctaagcactgaactctttttgcctcaagtttctcttcagtgaagtgagtgatatggtttggctttgtgtcctcacccaaatctcatctctaattgtaatctccatgtgttgagggagggacctgtaatcctcatgtgttgagggagggaggtgattggatcatgggggcagtttcccccatgctgttcttatgatagtgagtgagttctcgtgagatctggtggttttataagtgtttgacatttcctcctacacacattatctctttcacctgccaccatgtaagatgtgcctgcttctccgtctgtcatggttgtaagtttcctgagacctccccatgtggaactgtgactcaattaaacctctttcctttataaattacccagtctctagtagtacctttatagcggtgtgagaacgaactaatacagtgaggaaaatgctattagttgctgtaaggaaaaaatgagataatttatgaaaagcacttagtgctaagcacagagtaaatgctcaataatggtagttcttgggtacatagtagatgctcagttagattttgttactaattcactgaagccagaagacagaattttgcaatgtaagtagaactgaacgtgtttttatatgtgtagcttttctaagataattatgtttgagaggtgttgtttccagtagaactctttaaatattattacacagctcttgggaacttgggaaaattttactcattattccaatacatctccctgaagactgatttccaccccccacaagtttccatgttcttcatgggtctggaatttagtcagagagacaggctacttttctctaacccaagccttctccttgggtgattaagcacgtagtttcatgggaagtttaagaccaaagaattatggcattgtcatgtcaggcactcaagtgtcagggatttggcttaagtgaattgattactggaaacccttgaaacttgttatctttaagttgcttccagcccctgtgaccagaaatgcatggcgactcccaataacatctgcctttcttacaatcccgcccataccagttcaaagatcacatagctgattcttttattaataaaatatttattgagctcacacagcaccctaagcactctgctaagtgctcaagatttagacaggaataaagtattatctctgctatcatgactgttatcttgcagtgaagggttagataaggagacaggaaatgtcaatagattataacaaatgggacagtggcacagggacatgtctgggacacataagcaaggttcctgcctcctctttggggccagattacatttagtgatgactgtgagaaaaatgtgtcagctgaactgaggtctgaaggcagggtaaatgtaagccaggcaaagtggacatgggatattaggatatatttctgccgaagtaacaacatataaagacctaggaattagcaaaagcgtagcacatacaggaaactgtaaagaatgcacaaagtcttgtatacaaagttggacatagtgagagttgagggtggaaaagcaaaccaaaggcaaatcttgtccaaggaatttgaactagctgagtgcttggaacattggtacatctttgttgaaagactaaatggatcaataaactgtattctgagggaaatgaagagccattaattcatttaaattagcatctgacttgtgttatatgatcatagaatctaggttaaataattcacctggtgcctcatatgagagcttgacataggaggaacaatcttcctctgtgttgcaatcaccatagcatgaacaaaatgggaatatgggggaaacaggagaaggagacaaatagaagagcagtcatcccagggaacagactaaatacggaaggcctatgcccagcccaaagaaatgcagagatggacaagtcatctcgcatggataagcaagcattcatcccagggaacagactaaataaggaaggcctatgcccagcccaaagaaatgcagagatggacaagtcatctcgcatggataggcaatagaatggaatatgtgtatttaagccccagagacaatggcgttccaaccttgcctttgtccctaccacctatggactttcatctttttgagactaagtttctttatagggaagatgtgatttttaacatccctgcgtggagttgttgtgaatatataatagctttatgtataatgcatttatatataaaattctcagcacagggctatatacttcttctgggatactcagaaaagatcatttaagataagaagccatcctaaatttggatgttttctaatataccactgagaataactatatttattgaatgcttatattgtgttatgtgctgttctaagatttatagtgaccgtggatttaatcctgccaaagaccctataagatagtgaattctgttattctcactttacaaagaagaaaacagaagcctggtggaaatatgtatgaatttgcatgaagatgtatggccagaggtggtggagttgggactcaaacccaggctgtctgggattgaaatgctttcctatattgctgaaaaaaaaaaaatggctgtacagtaaataaaatatcacagtgtcatgtatgaagtcagtggttctggcaaccctgatctaatgctgcatgtggtcataaactgaactcagggaagttggaagttgagttttgaaacaactttaaatcatcttatttagccccttaatactcacatcagaaataatcttattttgtgtacattgttagacaattaccaataacctaactacggttttgtctaagacactgatttgacttagttgtctggaagatttagttgtctggaaatacattgtgatattgcataaacttttaaaaaatctagttaagtatcgccttttacacacaaagaaaaacagttttgtttaaggtgaagagacttgctgaaatgtttgtaatcagtccatgaaactgatttcctaacaaagatatttggtgccatggagtttgaaaaacagggaagaattttcaggtatgatgcagtcttcatcactgaactcattgtactgtttagttatatgtaacagaaagaagtcaaacttgcttagaaaatgaaggggaatttatttatggttgtatccaaaatttcagaggtaggaggaactttatgtacagctcacatcagtgactcaagattattaccaaaagactattttgtctttttcttctttgttttctatccttttgttatcatattagaatataaggtggctatactagccagatactccaggtcaacatgcttattcacaggcagtgatcgaaagaacatcgctggggatcagtcaaaactgcctgaaatgggtatccaagaatggtagcaggtcatttctcctaaggaaatttgtggaactattatccttaagaaagggaaatggaggtaaacagtaaaccaaggtgtacactgaaatctctttctaggagaaaagagtccacattcaaaagtcccaagcattgtctgagcaatgttatgtgacttcaataaacatttgcaactttgtatttattggattcatcggtggtcacttagcatgactgaatgacctgtccataaatatctgaaggtcattctcagatcttagaggaatattaaagtgtgaatgttttatttctaagattgggaaactgatgctccaggagagaaagtaacttgtctaaattctccagacctgtaaacacaaagccggcatgagaacccactctttcttactgtctctctgaagtacatagagataaacaaaagaaatttcaactaatcatgacaagtaccaaattattcaagagattacccaaacaacttagctaattctgatggttttaaacactaaatcacaaatgaggcaagacaggagaatgtcagaggtgcacacataacatgttaggcatgcatgggagcagtagcacgtttgcgttattatttgtttacatggcttagtatctaagggacatgaagtattgtcatttatcagagactaggtctcaagtttgactctggtttaagttttccataatctgctcagtacatttcttcatttaggcagctctttcaccatggtaaaagcatcaggtgacaacttccatctggctggtcccaagttacttttcatgtaattcatccttttaataagctatctcctgacatattgggtccatcttgacaagccatgtttttttttgtgagacatcattctaattatcttaatatcttagaaggaagaactccataattatcttttatgggaaggctcgagacacacatttgaaattgtatgcccaggactttatgtgcagaagaatcaaggtatagtattatccagtgtctctggcaagtttttgggactaaatttcaggctacaagatgtttgttgttcattgcaaaggtcaggtttgactgcgtttattaaattacaaacttgcttgtcttgtatcatcggaagatggtatgaattaaggctttctcattccagtcacagtacagattgcagctgaaaaacatctaaagggattcaagtgaccaagaacattgaacagaaaaaccataacaaacagtccctgcccttggggagtccctatgctatttgatacaacagaaaatgtaccatatgttaaaatttaagacagaccaaatatcaatcccttcctccaaataaatcaagctgtcagtagataagacctcctgcctctaaacttgactcctccagttcccaccacaatgatcccgatctcttactacttttgcaatcaaacaacttcaatagattttcattgctttaatgatcaagttcaaatgccttaaaacagtggtccccaacctttttggcaccagggaccatgtttgtggaaaacaatttttccatggactgaggggggcaggatggtttcagaatgattcaagtgcattacacttctcatgtactttatttctattattattacattgttcattaatatataattaatatataatgaaataattatacaactctccacaatgtagaatcagtgggagccttgagcttgttttcctgcaactaggtggtcccatgtggaggtgatgggagacagtgacagattctcatacagagcactctacctagatccctcacatacacagtccacaatagcgttcgtgctcctatgagaatctaatgctcaggctgtaatgcagcaagggggagtggctgtaaatacagatgaagcttcactctcttgcccactgctcacctcctgttttatggcccagttccacatggaccactatcagtctgtgggccaggggtgggggatccttcaaagatacacagtgcctcccctaccctcatctcttaatgttctttaaggcccctttttaccatcatacaaaaaatgacttaattttctgttacatgctaaacttattcacatagctaaacttttgaaaatactatttcttcagtctggaatgttctactctagtagtccaagtaataaaatcaccctttatgatgtagcttaattattgaaatctttgagaagggtgaattttatggcatatgaaatatatcttaataacgatgctattaaaaacaacaaaacattgatgactcttttataagaaacttccctctcttaactcattctaccatacagtcaggtacctgaaagcagatattaacacatatacatgtacatgcacacgatactaggttagggaccaatttttttctcccttaaaaccctgcatacctacctattaactgtgtttataggtttacttgtttattttccatctagacttggagcctttaatgtggtagccattaatagcacgtggctgttgagctcttgaaagatggctagtccaaaatgagatatgctggaaatgtaaaattcacacacaacatttcaaagtcttgttatgaaacaatgtagactgtctcattagtagttttatagtgattacctattgaaattaatatatacattgggctaagtgaaaatgttattaaaattaatttcattttttctctttattttttaaaatgtgtctacatgaaaatttaaatttatgtatagggctcattttatttcatttggacaacactgatctagaccgtgagatacttaaaggtagggacagtgttttattcatctctgcatatagagtcaggcctgtggtaggtgctcaaggacttctctgcatgagataagtgactgaatattaagtcccaaatgaacagtgcagacactgagaacaatgggactacaagggagaggaaatgaacactatttccatacaagtccaggaaaatctgtacaagggatgcagaaggcctcgaagctggaaacgaaggccttgaagctaaattcttgagtagctaaagaagagattgtgccgtgccaggtgcggtggctcacctctgtaatcccagcactttgggaggcaaaggtgggcagatcatgaggtcaggagttggagaccagcctgaccaacatggtgaatccccgtctctactaaaaatacaaaaattagctgggtgtggtggcatgcgcctatagtcccagctaatctagaggctgaggcaggagaatcacttggacccgggaggcagaggttgcagtgagccgagatcgtgccactgcactctagcctggcaacagagcgagacttcgtctcaaaaaaaaataaaaaaaaaaagaagagattgtatgatttctccaagtcactgttggcattcacgtttctcctatgaaaataaaaggccagcataaaatgggctttgatatgacttcataaagctgatctcatcatgaccactccaatgggaatatttattttacccttgatttggggttgctgattagcttccaaagtatgtagagggtcctgccatgcctggggtttctcttaagatattttatatacatgtggttggttcagtcgaggagaggcacaaagttaatctaaggccttctctattcaaaactgtcaggtccacagtttttattcatggaagcttctgtaggctattctataggttggtgcaaaagtaactgcagcttttgtcagtaaaagtaatgccaaaaaactgcaatttctttcgcaccaacctaatatgtacatctgaatgggctgtaagcagacatctgcccctggcaacaaccaactgatgatttttttttttttttttttgagacggagtctcgctctgtcgcccaggctggagtgcagtggtgctatctccgctcactgcaagctccgcctcccaggttcacgccattctcctgcctcagcctcccgagtagctggaactgcaggcacctgccactgtacccggctaattttttttttttttttgtatttttagtagagacgaggtttcacggtgttagccaggatggtctcgatctcttgacgtcgtgatcttcccgcctcgacctcccaaagtgctgggattacaggcgtgagccaccgtgcctggctgatgatattttataattaaattaatccattcagacagactttctgatattcagattttaaaatgcaaaagaggatagggcagttatttgcaagataaatctctctcaatagtaagtatagttttgtataatattgtataaaaacaatgctaataacaaaatgtattgaaaattcactatattggacattgaatgttatttacattacctcattcaaactccacaagaataaagtttggattgccattctacatttacagttgagttaagtggctcagaaagtggaaacaactgggccaaagtggaggaggaattagaactcaagtctgttttgctcatttttgctaccatgtgaagctatctttagggtgtcagccataagttttgatcaggttgtcctgccactgacttgataaatcagcccctcaggaaataatctacatgcagaacttccaactgattggagaaaacagaagctcagaaccctgcatttctgtcgcataccattcttagtgtagaattggaactttaaatactggaaccctgctctgagactctgcaggcctaatcatcaacgcctcctctaggtgccagccatagaaggaccacgttgggtctggcccttatttcagggaaaaggagactttctgcccagtctccaggctgctgaatcagcctctttcttcctttggctttcagaatttactttcaaccctttatttttcagtttgatggcctcacacagactgacttttgtgaattgacagagataaaagaaaataaaaacctggttatgaaccactgagtctataaactggatactttcctagatgtgtggaaaatataacagtgctagttttttttttttgttgttcctcttggactgtgagtacaaggctccttctttgagaatgagcaggaatgcctataaggagttttctttttattttccctgactccactttttgtttctggattatgatttatatcagaaaacatttcctatggtttggagatatttttagaagtctgagggtggtctcaggaaaaatggaaaatactctgttatttgtttctttatcttccaacttctctctttaggttccaatccggaccttgccctcagtcttactcctttcactgtccgagccaatcttttgtcccttgtttatttctgtagggaaacacccaatgcaggaggtgatagctctggaatttgtcattgataagccacctccttccagaaatcacaaattcattctgactgaacccttttttgctttaaatcagaggagcggtaatttctagtttgaaagtgacagacacatgtggatggtatccttgggaagaggaggaagagcagcactacagtgttattttacagacagcgtcctacctcatctatgggcacagaaaggcaagggagatccttattttatacctctatgagaaggtagtcttttagcattgcagagatcctgaaccgatactttaggtgatatgaaatgtcaatcatacagcacccctgatgaaaaaccactgggcctagaaactttgaatacttatggtgctgaataactcattactttggaaagtttgctgttattatcttgtgcttcttatcatcaaatatgttctcagggcccattgagtgctaggaagatcttgaatcatttggagaaaatgcagcactgtgtattggtctccagacaggttatattcctggctgaggtcacaacgtctggtgcaaaactgaataatgcgagggtgatatgggattcgtaagcatttttacactcctgctaggacaagagagggttttggagatacagattcaaagacaattatacgtgaaacagcaaagtctgatagttgaggacatggcctcaggattcagagttcactacttattatctacataaagttgaccagcttacttaatctccatgagccttggtttctccatttgtaacatggggctcacagaagtatttgcttcataggggtgttgagaaaatgaaatcacttaatacatgcaaaatattgagaatactgcctggcatatagtaaaaaagagctcagtaaacttaagccattattgttatgaccctgactcaagcatgtgttgagaaatcctgaatcaagtgtagtatcatcatagaggaatggaacacttgtttgttaaatctttgcacttgcaagatttttagtggacactaagttctttacttttacagtctcatttgctcttttctaaaatcctgttgtctgggcacatcttaatgtttcccatattacagatgggagacttgtagctcaaagaggtcagacattttttcccaaggcctcagcttaaatgtcacaccttcagagatagatgccttctcaaagcactcaatataaaacagtcacccactcccgttttacatttactctaagattatcatctgcatgttattcactattagctggcatttttgtcatattcctgtgtgcgactgtgcttattttatgccttttcccagctagaacacaagctttctgaggataggaacctttcttgtcttggcacagaaccaatctccagcatttaatatgttgcaaatctttggtaaacatttgctgaaggagtaaatgaaggacactagaaggagaacagaatagaacaattattctgtaagaaaaacagaaggagctgtctttgctttccaatgctatccccaacttcatgaccttgggcaactgatttcctgtctctaaattagggaaatgagaatagtaacctctacttccttacagctatgatgaggaaaaataaaataaaatttaaaaatcacttagcatagtgcctgcgcataccaagggcaaaataaatgctggcttttgtcattggaggaggcaggatttgtgaggtttgtttgagagtctttcctgctatgttctatgcttatataggaaattatgaataataactttgatgagaacagaaaagttcaataaaaccatcatctctttgttccatttggttacttcaaatttgacaattatcttttaatggagaactgaactaaatgttctcattattttctttccagactaaatgctccttcttaaactaagtctcccaatcccacctcatatgtaactattttatttcttcccacaagctcaaggaatgtaaaaaaaaaaaaacgaatcttaagatgttaagcttagtggaaatgcaggaagggcttacaggttggttgcctggtgcaattttctgtcatgcagggaaaccaagactgagagagggaaatggattcacctcctgacacagtggacaagccaggacttgaacccaggtctctttaatacagtttctgccatgtttccctgacactcacacagagaaaacaaatctacaacagttatgtctccacttcgtaaaccttccattctccatcaccacttccaaataaagaataacggttgttacaggaatatgtcattacttgcccatttcgaattgccaaccagggactcccatttccaacatgtttatgtaaaagattaggagactctttgctctaattggtcatttttccactgagtaatagagttgcatcattgttgaattggctcagcctgacacaggcagacacactgatatatgtatgctttaatctgttaggaccaatgaggaaagaaaaccgttatttactttttgtcctgacctcaccatttagccatggctctttgagagcatacttcatttactgaacaaactgctcagtagcatcaataacttgttttagattcttttaaagaggacttcatatggcattcaatccttgattccccaataaaacaacacagctgttcccttgcagctcgtctctcagcaggagctgcaaaatcatatttaatcaactttgctttaaaagccatccagtttcctttagggctttggcgaacttccctggccaggatggcccctgctgacatgtcagcagctacagcttttccaagccctggcggagggagttgccatttgctgagcactttctcatgtgccagtccctctattgggcactttaaattcaaggttttatttaatccacatggcagtctcatgagatggggattgatctctgattttaagataaggaaactgaggcttagaagtgtaaaaacatttttcccaaatcaaagagcaacaagtgaaagaattgggattcagccaagttctctctaattccaaaatctgtgcattttctacttttcagtttggctttctacataaagaggtaccaaggaattatacaggggtgagtgagacacaatttagtcagtatgtcaaatttggcaacagagtcccattgctatagctcctaagtctttttaagacttacagctttttcttaccatgatgaaatttgctattagaatataaataatcttgatggcatcttgtattcaataaagattaacaattattatgtacaatttactcttcaaagtgaggtgaagggatgcagagatcaaataggtatatatcttgctctcaagaagctctaagtctagaaatagagatacaacagcaacatcaaacatgctaatgaaaaatagaaagtgataagtgttatgagtgggttaaattatgatggaaatttgaaaaaggagaagtctattctagctaaggcataagtcttatccaaaactttgaatgtaaagactataagtattttccataaggctttatggaagattgcaatagtcaggatgattaacactagctcctgtgacacccccaaagtatcagtggctttaacacaacaagaatttcttcttcactctttgttggggtgaggcagtgctctcatctatgatgtcactcaggatataggcttcttgtatcatgtggctctaccctttgagagtcctatgtttctagccacctggttagagaagagagagagagagagagagacagagagggagggaatggaggatcaagtggaaagtagaggagccaggcctggaagtggtttacttcatttcatttacatctcagtggacagacaagtcacatggccccaacacaactgaaagaaggatgggaaatgtcttcttcctgtaggcccagggagaaaacagagcttaattgagcacatagcattgtttctgccacaaggaatatgaacataggtgttgcagaatcatttaatttaagaagttgagggacatgcaggatgaaggtagtgtagagggtattcatggaacactttgattcaaaagagattggtttggggtcgggcatggtggctcacgcctgtaatcccagcactttgggaggctgaggctggtggatcaccttaggtcaggagttagaggccagcctggccaacatggcaaaaccccatctctactaaaaatacaaaaattagctgggcatggtgatgtgtgcctgtaatcccagctacttgggaggctgaggcaggagaatcacttgaacccgggaggcagaggttgcagtgagccctgattgtgccactgcactccagcctcggcgacacaccgagactctgtctcaaacaaaacataaacaaacaagaaacaaaagagattggtttggaaagatagttgataccagatctggaaaggcctttagtgacaagcattttccaaaatgtatttttcagaatgttagtgagtaaaatatgaagaatgatttgagtagtcaagtagattttggaaaaactgcgttatcaaattttaattgcctcggttccacaggatttcgatttttagagggaggcacgatgtatcaattataataaaccttttcgatcacagaatctctttttggtagactatcttgtaagactaatattttgtgacatggaatcttaggcaatgaggaaccattaagcaagaaagacaaatgattagacttacttttagaagtacaagccagagatgagttccaacccacatcccagatttgaccaattaataatggctggcattagtgctatcatgaaagaaattatgaaacttcatctgaacttatctaggaaaaggtagtgattgattaataatgtctgctgtagagtaaaggatatagaggtgtgtcttagttagtttggacttctataacaaagtaccatagatgggtggcttaaagaacccacacttatttatcatatatcttccagcctcctatctggaggctggaagtctaagatgaagatccttgcaggtttgcatctggcaaaaacctgcttcctggttcatagatggccatcttctctctctgtatgctcacatagtggagaacagagagaggaaaagcaagctctctcatctctttttttttttttaaaggcactaaccttgttcaaggggattccacccttatgacctaattacctcccataggtctcacctcttaatgccaccatattggggatgagaatttcaacatatgaatttggggggaaggcaaaccttccacagcagggtgtgatggttaattttgtgtatcaatttagctaaactatggtgcccagttgtttggtgaaacagtagtttagatgttgctgtgaaagtattttgtagacacgatgaacatttacaatcagttgacttaaaataaacgatattattcttgacaatgtgtctcatccaatcagttgaaggcctgaaaaataaaactgaagtttttcagagaggaaattctgcctcaagagtaacgaggaaatcctacttgagttttcagtctgctgacctgctctgctctgtagattttgaatttctagcttactggcttgccatccaaattttagacttatcagtccctacaatcatgtaagaaaattccttaaagataagtgtgtgtgtgtgtgtgtgtgtgtgtgtgtgtgtgtgtgtatgtgtgtgtgtgtgagtgtgagtgtaggttcggtctctggagaaccctgactgatacaaggggtgacaacagcatgatggcatttgattttgttgctttaggtgaaggttgcaagttgggttacaaagagagcttgggtgcctgaaagtggtgtcaacaccaaaatggaaaagatttcaggagaagaaagttcagatttggaactttgtcctttagatgtcacctggacaaacaaatagacatccttcagaagaacgttcattcagagctaagcagaagtcagcattatttccagtgtgcaaagatattttgaagagaatgtatatctcctttaggatccttcaacagatacgccacctgtttgcctgcagcagtttcctgaggctgcaatttggaacaaatgcctctagtgacagggaacaaaaagagttgctttgtcctgaaaggaggttaagagtcatttgaggctgactattcaagacacacctgaatggggtgtgaattaagagaaaggagggccaggtgtggtggctcactcctgtaataccagcactttgggaggcctagatgggaggattgcttaagcctaggagtttgagacaagcctgggcaatatggtgagaccccatctctaaaaataaaagaaaaaggaaagaaaataaaacagaaaggaggaaaacggttatagaaaaaggagaggaacatcactaagcgaaaagctgaatggaggtgagtcactgggcatgactaagccatgactaagacctccagggtgatagatgaaggtctcaccaccaggagagtggagtaattattaatgcatgtttgcctggtgagttatttagttacaaaagccacagcagaggctcttcattgtaacagctcaacaatcatatatagagttcccgcaatgcagacactcactaaacactggggtcacacgggggaaagacacaagtccagcctcattttgaatcagtctttttgtgtgttttagtagcttcccaaacataactttgtcttatcactcatagatgtaatgaggtagcttgattctatttattcaacaaagacttattgatttcctacaacaaaccatgcactgttcttgctatggggaatatagtagtgaagaaaattggctaaacttactccttgccttcatggagctgacattctcatgtgggtgacaggaaataccatgataaataagtaaactacacagtaggatctgtggtgatatgttagagaaaaaaaataaagcagctttatcaatcaagagaggttaggcagccaacatgcaataattaacaaactggaatctcagtgacttttccactcgcctaattttcatcgtgggccagaaggggcctctgctcccacaacttcactgtcttccttgctctaggactctgactatagagcaacgaatatctgtgctattataggggaaaaaataaaaagagatttctgctgggtctcaccttggggaagcaatgctcagcctgaaattgatgcacattatttccacacatcattcattggaatgaactgattagttggattgacctaaaatatggaagcaggaagtacagttctatcatgtgttcagactgggggaaatcctgtaaatatggcaaacaaaaatagggtcatttaggtcacagtgaggactttggcttctcccatgagtaaaatgggaagccattggagactgtgaacagtcgagtgagtgcagaatgagacagacttttgttgagatcttggctctgtgacccagaacatgtgatctataaattggggcaacaaaacctaccttattagattggtagtaagattcactgagatatttgtgtaatgcctggcataaaataaattttggcaaaatgacaatgatatattgaatttcctataaacctatttgtttcatcaaatgaggatgaatttcccccaaagcaaaaaccatgtctaattcatcattgaattctcaattcctaatacaagattggacccacttcattcccctaatatgtgtacttcattctccacaggatggctgagaggagggaaaagatgcagagagcatctgtgtatccttgctgctaagaattcaccttttttaaaaaagggagctgtcaccttgaataaaaaaggctgaagcagcaattcataagccacagttaatgatcaaactcatggcaagtcagctttagaatccagtggaggcatgttctctgtggccttatggcttgggggactgtttggaatatggttagctgtcaccttatatttctgatataagctatgacatgcctgtagctgacacatttgtccgcagactctttgttcaaagagaaaggtataccacagttgtgctagtaatggttgcaatgcctagggatagaattacgaagaacttgaaaaatcttgctcttagcatgtgtcaccataatgaatagatcgacggtacaaggtcaaacttaatgcacaatgggaaaggtggaaattttttttattatctttctttatatgtgtctcctttcactgcatagctttttctccacactcctttcatattgatctggcaataatgctaactttggtgcattcaagaggcccctttccccaccttcattttgtcttttctctaacagcacttgtttttcatattcttgaacacattcagctagtggctgtgaatttggagagataagcatataataactatgatgatcatacttcttagtttgcccagaacagtcatggcttttgcccaatgtctaggtgtaaatattaatgataataccttttattctcaaatttttctcagttagaaaaatatatggtcctatttattatagaaatttatccttttctgaagggccacacaatgccagaaactattatgcctttccaccagcgtgatcctagagttaactcaaagtttcacgtgttgttagaaatatgaggggtttcaaagtcaaccaaaatagctggaagggaaggacattgtcatagtccatccagggagttagcagcccactctgctgccaatctcaaccagaatttgacctccccatcaagttctgctgtcacattatcctcctctaggagaggaaagatggtggtgacaaagcactcaactttggtctcgatggacctgggtttaaactttgggtcaattaatctatgacagttactgtattagtctgttctcacactgctataaagaactgcttgagactgggtaatttagaaaggaaagaggtttaattgactggtagtacagcatggctgcagaggcctcaggaaacttagaaatcatggtagaaggcaaaggggaagcaaggcaccttcttcacaaggtggcagaagggagaatgaatgcaggaggaactaccaaacatttataaaaccatcagatcttggaagaactcactcattattacaagaacagcgtgggggaaactgcccccaagatccaattacttctacctgatttgtcccttgacatgtggggattatggggattataattcaagatgagatttgggtggggacacaaagtcaaccacatcagttacctcttaatttaaaatttttagcaggaatactaacatatgattcacccagattgttataaaatttaatcacataatgtcatataatgtgaaaaaaattatataatgtaaaaattgtttaacatagtttattgacactattgagtgacagcttttattagtattattaataaaataaaaattgaattttcatattactgcaattaccacagggtctgaaacctagtagttactatacactttttattttgaatcttgatatatacatacagcagacattgtttttcaaaacaatttctttctcattagtacagaaggaactttggatgtgggagagaaagacaaggagaaacctgaaagcagcccagttatgacaatgaatggtaagatattctcctgacctgagatctgcttttacggagtaaataaatgaatgttacatgagcccagtgcaaaacaagcagggtgtgattatgcaggcagtcttggagaagttagcaccattgtcagctctgagggatcataggagtagaacagctaccactgaaagtaaaaaggaatctgaatccagttgttgacaatgacaagtcaagttttaaaaaacctgagtagaatctgctgctattttaataatggttggatacactgagcagagcctctgacagaggtaggatgtgttaagccctggggttccctgcacagtgttgcagcagagtagtggtccctcagctgtgagctaggttaagacctgagactgaaatggatacatttaactcatgcccaccccaatcccaggcaaagcttttcaagtcttgattggtcctgcctctctgagggttttttttttttccactttaagtatatttttgaggttcagagccgtaagaacatatcatggaatttgcccacaagtgataaagtatcatctcaaatttgggcttaacttgtgttggggactcatatttgccttagggagttaaaatttttactatgtaagatagggagagagatatcaaattatggtgtatagaacatctgctttaaaatcatttggaaaactttaaaatgctgacttctgtaccttatctttgacctactgaatcagactatttgagaaatgaatatgaaggttgattagctcacagagttttactatcctcatgattattgagaaaccattaggctagtggctctatgaataggttagcataataaaagagaattatcttcatcaagatccaataatggtagttgctaccatctttatctgaccattgagaaaactgatgtaggaggagttgcaatctgccaaagacccaaaaggatatagttacaaaagaaggagattatttgtttttgtttttttgttttttttgagacagagtctcgcgctgtcgcccaggctggagtgcagtggcacgatctcggctcactgcaagctccgcctcccggggtcaggccattctcctgcctcagcctccctagtagctgggactacaggcgcctgccaccacgcccaactaatttttttgtatttttagtcgagacggggtttcactatgttagccaggatggtctcgatctcctgacctcgtgatccacccacctcggcctcccaaagtgctgggattacaggcgtgagccaccacgccctgccaaaagaaggagattatttgtctttgccatgttctaatggaagtagaggtaagatgcttactcagattcttttctccctgaatcagtgggggacatttccatggaccaaggaagagggatgatttaggccaaaaccctaattttgattatttgatgataatttatattaaaaatatgaaaaaatagtaaccaagcacaaaataattatagtaccttgaatgagtcctggtagcctctgctgtctctgatgatgtcaagaaagtcaggggcattttccaggggcaacagtaactattgccttaagtttgtattttttattcatgttaatggaattggaaaaagcttagattttcgggaaatagtaactcacaagttaccaagcagatggcaatttcctctctgcctcttgcctaaaaacacactttggatgcgtcataagcaaagcccaggcccagttaaagctctgttattcagtccggaagcagttgcttctgtatttatcatggtgctcagggtatagatatagatcttagacatttttagtgagatagtttgaggagcctgtagaggcagagaaatcagtatgaaatctgggagaaaaaaagggcattcatttttgaaacaggtataatttataggaatggacacttcaatccttttctttagaacacagttttcatctgaccagtttgcttcttgcattgcccagaaagcaatcgatcatctactcctttttttcaatgtgatcaatagagaagagtgtgctgacttagagaagagattctcaaacttcaatgcacccacaaatcacctatcttgttaaaatgcagatcatgcttcatcaggcctgagaatctgcatttctaaccagctgtcatggctgctggtctgtggaccacactgcaagaccaggacttagagcatggtcagttgcccaagttcacttgagaccatgagaacattactgagcttctgagccttcatttcctcattttaaacatttgcatataatacagataatgaaagtgcctaacatataggactattttaagtacagaatatagtccacataaagtgctaaaataattaattgtcacatcatattctatcagtaaatgtttgctatcattattaggcatttgctatgtgccttctatatgctagggttctaggaaaagaattagaagatgtgctttttgtttcttaaatctaacaacctagaagcggtcagtaaaataggttacatataggcacataaatctaccatgagttagcagatagatgggtacacgcttcaatggcaggaatactggtcatggagtaaggaagctggtttccctattcccttgtcgtaaggaattttgtgaaaacctctttcattttctggattgttgtctcatcctttataacagaggaattttacccagctgcatagttctgatggcagtgtctgctgccatcatgcctgctgcagcaggagcaagtgggagccctgccccttctgaattgggatgggagattcccgtgccactgtagctgcccaaactgcagctgcagactcaggcctccctgctctagggagcaggcaggagccccactctcctgggtggggctacagccacccaaactgcaaatgtggatctggccaccctcccaagcacaggatcggagtgtctctgcagcctgcaccctcaggtgcaccaggaaggattccccctccatccctacaggctcaggggtgtctgctcccactgcccagcctctctctgctcctgacacctccaatgtcagagcagggttggagccaagcccaggggccatgaatggcagcaggaggcagacagagtcctaggcggaagtgggtggagtccccagtaaggtcccattctcaggccagggagggcccaaaggctgggggctgggctgccagtttctccaaccagagtggcaactcatagtgcctcttctggcccacccatggccgcccatggacccattcacatgtacttcccctctctgaggtccataaaagccctggcctcagctgggtgcagtggctcgcacttgtaaccccagcactttgggaggccaagccaggtggatcagctgaggtcaggactttgagatcagcctggccaacatggtgaaactccgtctctactaaaaatacaaaaattagctgcacatggtggtgggcacctgtaatctcagctactctggaggcggaggcaggagaatcgcttgattctctgtgtgggggttctgatcccacatttcccttctgcactgccctagcagaagttctccatgagagtcctgccactgcaacaaacttctgcctgggcatccaggcatttccatacatcttttgaaatctaagcagaggttcccaaaccttacttcttgacttctgtgcactggcaggctcaacaccacatggaagctaccaagacttgaggtttacaccctctgaagccacagcctgagctgtacattggcctctttcagccatggctagagtggctgggacacagggcaccaaatctctaggctgcacacagcacgcagaccctggtcccaacccaagaaaccactctttcctcctggacctctgggcctgtgatgggaggggctgccatgaaggtctctgacatggccaggagacattttcccccatggtcttggggattaacattaggctccttgctacttatgcaaatttctaaagcttgcttgaatttcttctcaaaaaatgggttttccttttctactgcatcatcaggctgcaattactccaaacacttatgctctgtttcccttttaagagaatgcttttaacagtacacaacttacttcttgaatgcttttctgcttagacatttcttttctgccagataccctaaatcatctctctcaatttcaaagttccacagatctctaggacaggggcaaaatgctgccagtctctttgctaacatataacaagagtcacctttgccccagtttccaacaagttcctcatctccatctgagaccacctcagcctagaccttattgttcatatcactatcagaatttctgtcaaagccattcagcaaatctctaggaggttcaaactttcatacatttttctgtcttctgtgagccctccaaattgttccaatctctggctgttacccagttccaaagttgctttcacatttttgggtatcttttcagcagtgctcctctctactgataccaacttactgtattagccagttttcatgctgctgataaagacacacctaagactgggaagaaaaagaggtttaattggacttatagttccacatgtctggggaggcctcaggatcatggagggaggcaaaaggcacttcttacatggtgacggcaagagaaaaatgagaaaaaagcaaaagtggaaacccctgataaacccattagattttgtgagatttattcactattatgagaacagcatagaaaagaccagcccccatgattcaattacctccccctgtgtccttcccacaacatgtgggaattctgggagatacaattcaagttgagatttgaatggggacacagccaaaccatatcagggatcttcgcaaattatcagatgaccctgataggtatatagaggccttccagaacttaacccaagtattaatatgtgaactctcctggaaggatgtagtgttactttggaatcaaaccctggccaacgctgaaaagcaggccattctcagcaagtggcaaataattttgaggaatgagctttatatcttgtatagcacgagggaaggggaggaactttatccagttggaagaatagcagtaccattggagtaccctaaatgggaccccaatgatgaaatgggagagttgaagaggaaacactttaaaatgtgtgtatattagagggctttgtaagggactgagactagacctctcaatctcactgggctacctgtggtagaccagggatttgacaggagtcccactgccttcctggaaaggctaagaggggtcttggcaaaacacacccttctctcccctcattcaatagagggatagctggtcctaggggatgagtttgttactcaggcagcctctggtatcaggaggaagctgcagaaacaggacataggaccagtagtactttagaggacctcctgaaagtggccaccttggtcttttataatagagatcaggaggccagagagagggaaaggagacagaaaaaaaagcagagagtctcatagccaccttacaggctcagaaaccccagagttcctaagatgtacttgttgacttctgcaaatgtaaaccactggaggtcagactgttcctgagacacaggtaaccaggtccagggctggtctttcaaatggtacagcaaggcttatgggtcccagggttcttttccctggctttggtgattcagactgccattatcatccaggagccttgggtgattatgggtatcaagggaaagaggatggatctcctggactcaagtgcgcctttcattctctccaacctaggtccccctctcttagcatgactgtgaggagctcaggagaagccaaaactcttagttgtcacctctttacgtcaggaccccaattcctgggactgctattcctgggacttcctttatctcccttgtttgaggaggacctggccccacagctttgcctgcttgtgatagggaggcaacagaggagtgggccctgccagttgctagatgcaatgtggcaagggtcatttgggactaatttaaagggttcatataccctcctgaggcaccttttatcccaaactttggtttgaagccctgtaatggaacactagacctaaggcagatgacagtgggagttgagggtcacagcacaggtgagcatgactaattcctgccaattaggccctcccacttcacggatggaggttatgctcatggtatagataaggtctaaggaactcacagattaccgagagtgggaggcttaggctccactcagatgagtgtgaatattcctgtcagctatgcttcccacttcatgggtgaaggttgcacttgcacccatagttggcacctgcacaagtcactgggactcagggatataaggtcaggagaagaaagagggatgccttttcttctcttcatcatgtaacctgggtggttgctgggatggtgaaaggaacaaagggatgcctttttcccctctttccagatgggtaaccaaccaatcattttcaacctgccctcctcaagtgcatcctaaatcactggacaggacttcagagctcatggctcagggaaaggaaacccagaagcctgaaatgctggcaaaagtggaaaggttcttgccattcagactgtggcttctctctttctgtgcaaactagttgcaggaatgatataaatcacttctttacttaatttatgagcaccgttttacttataagccattttggttgacacaatatacatcaataaacacaactagacatatatacccacacacaaactaagatccaatagcttggaaccctggccatgagatagcaacatgagctcactggttttactttgtttgtcccaataggtaatccaatgaaggctgtaaaccaaaatttcaggtaaaacagtttccatatcaatttgatttaaaggtcaaatctccccagaattcgaagaacactgaggccaaacagcaccaaaggagagtatcacacattaagtaaagaagtccttcagaattgttaggatacatttttgtctggattatgtttgtctactataacatctaatggagactcctgaaaatagatttacatacaagatgtaaggaaagtaaaatgtgtctttagtaaaagaatatgagaaagcatgggaatgtaaatttttgcctagttcagagggttcaaagattgttttaaatgagataagagaaaactaaaggttcaaacaagttatggaaggtttgtaaaaattttgtaaaataagtgtgtaaatatattgactaaattcaaaagggtatttggtttttccataaattgaacattggaataaatgcacaacaaggttttcttgaggatttgtctgtaaggttttattttttaaaaattggggtgaaatttggctttctcttgaacacgacttttgtacaatgaaatgtttttgtttgcaaactatcaacaaaagaagggaaggacaaaagacagattatttggaaaactaggtcttctgtcttaatgagtaaacatttttgctttttaaaataaatttgagtcatcattgtagctaaacggatgacttatggcaatctgaaattctattaagtgtttgagtctttacagcttcaaaattgcctttcctaactcccaacttttggaagctacagagggaccctggagtgtccaaagtagaggtaaacaggattatttgacatgtttagttatataggattattgaaataaggtggtgcttgatcttcaggttatattttagtgaaaaatgttaatatgtgttccaaaatagtatgagatttctggagtactgatgtctgagtctgtgttattaatcataattagggtcattgtgttaggttatcgtaaatcacagaggtgaccaaatttctttgtcaattatgtttttgactgtaactaacctaggacattttaacattcatagacaattgttgtcttgttttgatcctcttcaaagaatggattataaccctcaagtgcaggtttcttataactttgaagattgtgaacaggagttgagtaggtaaactgaactattggaagaccaatcttttttgactttttgcttttttcttggaacagtgctgatccttatgtcctgtttttcagaatcaagggtttttttgagctatttgtggctttaaacaattgtagggtgaaccaaccagtgatctctgaccacagctcagaagaaacaaaagggatgggccatcaaactccaaatggtcacaaagatggagccctggatgatggctcccttgtactggggacctttagataggacccaccgagagagagacttgactgtaggtttcccagaacaatgctccttgtcagcatgaagcagttaagagctgtcatcgtctccatcctaacagcagttaggtgtacctcttcagaggggggatggatggcattggctgccgccatcatgccagctgcagcagggaagtgcagctggggctgcacactccatggagcaattgggagacccttctgagttgggatgggagctccctgtgccactgcagctgcccaaaccacagctgcagacccaggcctcctgctctacggagctctgcccaggagggtggagcagagctccgctgcctaaactgcagctgtggatccaagcctccctgtgctcttgggggagctgggaataggcaagatctgccctctcaggtacagctgcagccgcggcataagcggctgcagacctgggcttttggctccgggaagcaggcaggaactagggacaagcgggagccttgctccttttgagttgggggcggaggtgtggtggggtggtgggagatcctgggcgcagctgcggccaccctcctaggcacaggacccaggtgtctctgcagcctgcaccctcgcacgcctcttgaaggagccctcccccacccccatccttgcaggctcaggggtgtctgctcccgctgcctaacctctttctgctcttggcacttgatacaatcttggagccgggttagagccaacctctggggccatgaatggcagtaggaggcagacagagtcgtgggtggaagggggtggggtccccagtaaggcgccaccctcaggccagagcgggcctgaaggtggggggctgggctgccagtttctcctgcctgagtggggactagtggtgcctcttccaggcccgcccatgactgcccatggaccaatcagcaggcacttcctcccctctgaggtccataaaaggcctgggctcggtcagagcagggtaggggactgccagaggaggaagagagcggaggtttgagagatgaggagatgaccagctgcagagaggagcaccctctctgctgatagctggagaagatgggatgagagacctgcaaagatattccaatgacttgcctgtggagaggaaccaccctcttcagagcctcctctctgttcagagctgacgacctgcctacagagaggagctacccactcttctgagctgttctaacactaaataaaactttttttcttcacctttcagttgtctgtgtacctcattcttcctagatgcaggataaaaacttgggcaaaggtgccacagccacagagctttccagccagaaaaatggacaccccagagatcccgtaactgttccattccccaagtcatgacttattagctttgatgaccttagtcaagtttcttgaactcccaggctttattgtcctgatttacaaagttgagataataagatgacagttgcgaggattaaacatcttagcagaaaacatttggattatcatcttgcttctttaagcactcaataaatgcaatcatcattgtcctcctcctcctcctcctttactagtcctttttccttactattttttacaaactctgtgaccttagtcacctcacattagccacgactcatcgctttctaaaatgttcaactattaatatatattggagctatttttacttttttttttgagtggtttctgaaacaatcaaaagattaaaccagaagtcaacaaactgttttctgtactagaccaaatagtaaacattttaggctttactatagacaatatagtacaatacacaaatgggcatggctgtattccaatcaaatcttatttacaaaataaaataaaataaaataaaataaaataaaataaaataaaataaaataaaataaaataaaataaaataaaataaaggtaggtcgacaggacttagtttgctcacccctcctttaaagtaaagaagctgtaaatgttctgtgatttataaggaagtaagtttcacccaacacaaacctgtgatccatgaaatgcaacataatattgtaggaaagtcagtggctctgtgttctccagtagtcctgccttcaccttaagaaccccatagccttagaaccagtcttaccttggagaaggatcaaatctctcttttttaacagctatattaaactgtggcccagataggggaatttatttattcaaagtcagcagctccagggatagagccagcaccagaatcttgatctcctggctccaaatcagggactacgtattttctctttagcttgaaaagagaaagaaatcattttcctcaggaaaaaaataacttatttccactagagttttaatatagaaatatgttttttaaaccttcttgttaatggttatgccacagtcagacatgaaaacactgctatatctgcttaatgggaataccagtcccctgtccttgtcacttggatctcatattaaagatctcctttcatttctattgagacagaaaaacaccctctccttctactcacatctagtcagattccagaatcatttctttggcagtaaatcagtagtgaatgaaaaggctactcacatctatccatatcctattcccaaagaagaaatgggaacagaaagccctggaatgaatacaagcttccttctgctaggatctgaatggaaatacttctctccttttaatatgccatctgtgtagattttcatggagttccttttcttattttcctatcctggccttgctgaactctgataggataataataataacaacaataataacagttatgatttaatgagaatgtactgtttaccagcattatgccaaatatcttagtcatgtgtgagaatattctgaatcccattttatggatgaagaaattaggcacaaggagggtaagtcagacatgcaaaaagaggattatgacttcagagcagatgatttaaccctgcttagattcttcctgcaaatagcaaagaggtaaaccattttgatataaacttaacgatgtgtacctatacaattccatttatatgaaatgtccagagaaggtaaatggtcagagataaaaagtagattagtttttgcctgaagctgggagtgggaatggggagtgactgcaagggccatgaaggatattcctggagtgatgggaaagttttaaaattgggttaatattattattattctgagacagaatctcactctgttgcccaggctagagtgcagtggcatgatcacaactcactgcagcctccatctgctgggctcaggtgattctcccacctcagcctcctcagagctgggactataggcatgcatcaccatgcccagctaagtttttgtagagatggggtttcaccatatttcccaggctggtctcgaactcctgggctcaagcaacctgcccaccttggcctcccaaaagaataattgtgtgattatagacatgagtcactacacctggctttaaaatggattataataaggctgggtgtggtggctcacgcctgtaatcccagcactttgggaggccgaggtgggtggatcatgaggtcaggagatcaagaccatcctggctaacatggtgaaaccctatctctactaaaaatacaaaaaaaaaaaaaaaaaaaaaattagctgggtgtggtggcaggcacctgtaatcccatctactcgggaggctgaggcaggagaatggcatgaacctgggaggcagagcgtgcagtgagccgagattgcaccactgcactccagcctgggcaacagagcgagactccatctcaaaaaaaaaaaaaaaaaaattggattataataatggttgcacaactccacaaatttgctaaagatcattgatttttctttttgcacatgagatgaatgaaacttatggtatgtaaattaagcctcaacaaagctcttaaaagattaaacacatggaacagaaattgtgaaggcttttcttagtcttcatggctgctcctcttgtgtgggcatcttcatttctctttacagccacaatcagatttgaccatagaaaggtcccttctctcccaggattgttaactaccaattctttgatgatagaatatggacagatgaggattaactgcttcctcaatgctaatttattgccaaagcaagaatcctggaatttgagtgggtgcaaatagaggaagagggtgcttcttcactttaatagaaatgagacttttattacaaatggcatatgataagaacaagggactgtttttcccattaaacaaacacaagcatattttaatatatcttaaaaaggtctctatttcaataagcgcatttatgtatttgtttatttacttgacatgcattcaccaaatccttcttatgtgccaggcacctttcctgactctggggataaaacaatgagcaacctagtcattacccttgtcttcctaaagctttcagcccagcaggaaatcttaccttcttctttccatcttcatgaaaattctacctattctcccaggctctaactctattgggaggtaacccctcccatataatccaccacatcattttttctacctctctcttatgactccagtcatgtctacattgcagtggagttatatttgtttactactaattgccagaattatctcctctacaagtctataaaatccttcctagtagatgctgtgattaattcacctgtttgtctgctgagtactcatcataatattttacacctaggagataatccataagcctctgttatatgaatttgctaatttatccatgagccacatattttagataattttcaagcaacaggtactgttctgggcactaggagatttggtggtgaacaggactagcaagatccatgtcctccaggatcttactttagctttgaggagacagtcaatgaacaaatgattagaaagacacagtgaatttggataaataaaggatattatgaaggaactaaacagagagtaacttattaggggtggactgcagggaactacttcagcaaggatagtcacagatgctctctttggggacacagtatttgatcttagacatgaaaaatgaaaaagaaccagccttatgaatagttaggtacaataatagtctaggtagagagaaaagcaagtaaaaagacccagaggcaggaaagaatttggtgttttttttaaggaaaacaggaaatcaggccagtgttgctaaagcctagtgagagagaaaaagaaaaggaataggaagataggaagaatcaaatcatgaaaggccttgcaggccacaggaaggagtgcaaatttcattctatgagcaatggatgaaggacctttaagagcaaagtgacgtatatgttatttgtagtttagtgaaatgattttgtatgatttgtagcaaacgtataatattttggggctaaagcagtgaaatcatgaataaatactttttttttttttttgagacagggtctcgctctgtcacccaggctggagtgcaatggcgtgatctcggctcactgtgccctccacctcccgtgttcaagcgattctcctcatgataaatactttgaatgtaaagttccttaggcaggagtctggagacctgggtctggattatagagtgatctcagtgttatcagacatgtacatcagtttactgttttcaaacccaactcactgagctttctagtatcaaatgttctttgttaatttcacgcatctccttgtggaccaccatgcccagctaatttttgtatattttgtagagatggggtttcaccatattgcccaggctggtctcaaactcctgggctcaagcgacctgcccgccttggcctcccaaggatcagattatggaaggccttgcaggccacaagaaagagtgcaaggccttccatgatctgatccgtatctacatctcaaattataaacatgtgttacaatgaagaatcatcagaaagatcactcaaataatcagggaggtaacttggagttctgggcatctcctgatgttgtatcatatttttggtggtggtggggtttctgcatcttacttctttcctcgggaattagatgcacttcctattacccagtctaactttaactgcagctctcattattgccttttattggttcgactttgctggatttggtactccgcacacttcctctcattaaaagaaatccatttcaaccccagtttcctcattagaaccaatattttatgtgggcagcatcccattctgtgcatcttaagatgaagaaaagatagcgaacagtgggctgggagccaagagatcttgttctattctccactgagctataaatcattgtctggctactccccttctctgtgcctgggtttccttatttgtaatttaagagggttgaacttgatgagcttgtatgtgcttctcttgtttcctaacttgtctcaattggtgttgtgttttcctctctgtagtttttagggctctcaagggttatggcttagttcattgcctaagctttagcatttgcaacaactcattgcagcagttctccagttttgttcctttgcccactccattcagccatccagccagcgagtcatgcactcactcattgatgttggaaatatccttagaattctgctaggtatcagatactatgttgagtagtagggattcaatagtgtatataatatagtctctgctttcaaggacttcaaagtctgggaggagagagatagacatagccaaccttatgcacagtgtgtagtgcactgacttccatgggggagagaaactcaggatgtggaggaaattaacacaggaggcatctatgacaagaagtaacccagcaaagattcccagatgaggcaattcacaggccgaatcttgaaagtatagaaggagtgagctgcgtgaatgagcagggagaggtgcttgagtaagagagagcctatgacagtgaaccaaaggtgagaaatctgtaagaagtccagcttgactggataactaaatggaagcgttgggtggataggcaccaaggctggagatctaggcaaagaacacatcaaacagggccttatatatcatgctaaagagttagagtgagtgactgaatgaacagctgaggaagaaaaggaagccccatgatatgttaagtactgcagcactctacacaatgcagtgtgaagtgtgtaccacattgtttggcacctacaagacattatagcattgtggtaatgtgcagattctctgggcaaacaactctggatctgaatcctatctctaccacttactagtcatctgacctagagaaatttcttaacctcacaagggatcatcttttctcatttacatcagcgttactggagggattaaatgagattacatacatagagctcttactgcggggtttgcacttttgaaagatttaataaatgttaactactattaaaataaatgtcactgtaccctccccctctctttcctgccttccttctctctctccctcccttccttcttttctttttatttccttccttctttctgtccttccttctttctgttcatagactcctagcttaatagacaaggacgagattaaaaaatcatgcagcccaagtgcttgcatttttctaatctgtataatgatgccacctcatttatttggttcaaacagtgtctggatattggtgcatttagccaggactgttcactgcaaaataattcagctgtgtatcagtgaagatggaggtagatagtcaaacccagtagaactggtggctacagatgtaacacaaatctttctttatgccagttctttcatcaagacagaggaccaaattccacctttttcacatggatgatttacctgacacctagatgagaagatgaagacagtaattaaaggcatgacttgcccagtcaggcctgagtgtttatcttgaccctggcctttattagctgtatgatgtaggcaagttatttaaccttttggaaccttaatttatttatgtacaaaatgaagattacatggtccactcgcagcaacctagaggtagtgcaagaaaaatgcatgtcagagtgtttgacgcagagtaagttttcagtatatggtagatataatattcttaccagttttgttagtgttattattagtgtgtgtacgagagttagtagttgtgtaaatttattattagtgtttaaagtattttattttacattaagtgcctttgttagtattcttattatttgtgtctatattattaagtaacatggaagataaaaatactcatagctagagcatatacataggctgttgttcccttggtaaggaccaaaaactggccaagctgagagcatcttttgaaaagatggatcaggacacagtttcatcttttccagaaggtcagtcctcaggaaaccagacttgagtttgctattgctccagaggtcagctgggatgggtctgggggcctagaaacaagaccagcaaatatgctggctgggagcgagggtggcagcaggtggatgatgccaatcctggtcgactcagagtcacagcacctgcccaagtcaggaactacaattcttcataaagaacaaagaagctacattttactgggaggaaagagccactgggcttgtaaaggagaaatgaagggctgggcttagctctctgggtcaggaaggatttgtcagagaacaaaaatggtaacttgcgagacattagagaaaattatctctgagagaaagacaggctcggcctaacgtgtctttccttgtggttacattatttggtgcttgctgggtgacaaatcatccatttttatcttttatgtaactttagttttgatgttaggagctaagaataactaatacccaagagggtatgaccctggagcaaggcatgctgggaaagcacatttctgggtgcatgttgcctctgtgcctagagacatggattcaaataaaagtcacagctactgtcccaccgggggccattgctttggaaagtttaactgagcttttgaatacatctttgtttgccattcttattcaaggttatccaaagacaaatctgcttcaagagaggagaaagtagtaaatttaaatggacctttcaaacaacgttcagtctaaaaatggagaagctcaagatcaaatacgtatttgaaatcactggctaagaaacaaaattagtgttttcaatgggcatcgtttccttggtcttgctggctcagaagagcaagtgcaagggttgagaaattctgttcttgctcaattccattaatggtcaggcagttgggggaagaaagccaatcacctcccatccttttctgactatttttgttgtctagagttatgtccataagaggtcaactcgctgtggctgaaaagaagggagcgtattggatatttagttgtgaacttttgcatgcataggctgagatgggctagtcagagattaatcatacctgtggggccaatttgttcctttcaaccatcatgggagggaaccatgattattagcgtctctactttatagatgggaaaacagattcccaagaattttggtgactcacccaagaccatacaataacctagtgacagagtcagaatgtgaactggaatctccccaatgcttgactatactacaattattggaggacctaatgatcttttttatcttaccaaaaatcagaagaatgtttagtgaccaaactctgcatctggtcttatttctcttgacctctagactgaaatgttcccaatttctcctctttctgagccatatagcattgccagctggtaacttctcagtaggcttagtgagatcaaatatgtgagagttttcaaattggggtgtttcagcttcaacgaccatcatgtgcatccctggaatcccaggacactggggcatagacaaagcttaaccccatcatattatttgacataaggggaaacagattcagagagaaagaaggagttgctcatagtcacacaactgctgtgacattgcatgtccatcggtgttttccaagaactgatgaaatagatgttcaaggaagctcaaagagaagagataaggaggaaaaacattcattattaacaatctctgtcacttccttgctgtgcaatctctgataggtctcttaaactttttaattctcagctacctcctgtgttaaatagtaatcatattggaaaataccccaaaggtatatgaggattaattgattctgtgtatgtaagtctccaagcacagggcctgaccttagtagaaatcaatgcataggagctataataaggtcttatcaggtcagaagcacagagagaaggagtgggtttgtgagcttgagcgggacattgctagagggagctgagagagtgatctgaggggatgtctgtgagttcccacagagcagttcagtttgggaaaacagaggggtgaagataacaggaaaaaaaagggcatgtcctttggtaaattgcttattgttgcccagatatcactgtggtaacaaggaaagcccctgaaatcagtttgtccacagctcaagatataactccccagggttttcagtggcaagttaaggggttccaaggaggagccaggaatgaggcagtcacagatgggaacatttatttctttgagagtcttccgtttaagatgttctcagagttttggatgagctaaagggctcttcaggctagaacttggtcttggagggcagcttcccttccacctggccatgtttatcttacttccattagaaggcaagatgccaactttcctattcaatgaagtgtttagattccatgaggtttgtaaatagcctctgggaactcctttctgaaacttcccataggacttctaaactctccttaatcagagcagattgcaagagcaaatgcttcttattatgggttttaaaaaggtgagtagaccatagataaaaatcatagtaaaagtgggaatttgaggaaggtctgtttgctcaggaaaattttctaaatttcaaggttataaatgaaactgtagatgatcactcaggcaggatgtggtttagtttcttcatgaccatgataatgtttttcacataaaaagataagtagtactcatagaatgatgtagagaaaatcattttgtttgaaagaataaattgttcaagcatttgtaggcagtcattcagttttaagtagctacagacaacccttatctgttcagttacagacaatccttatctgttcatggcaagtagccacatacttttcaccaatatccttttctgtagctccccagtgaagagttgacattaaagttccagggtggagttggagtaattttgttttcctccaggggacacaagtgcagagaatggataaaacacaaacactaacagagaatagataaagcttcactctttaatgccacctcctggagcccatatgaaacccaagagtgaagaaagcaaagggttcttaggcataatagggcattaaggataaccatctcttatttcttttcattccagacagggtttggcctggcagttcaacctgattgcatgaagggttgtggtaggcagagatgtctgattgcctttgaattctttgttttctaaccagaggggagatagttctttcaacagaaagtcccagcaagtgcaacaacaaccgcggcctggtgtgcctctacttgccttggctgcctcagaaagagccctgaacactcctcctagggcctgtctatgaaaccaactggatgtagtcttattatttatcagaagttgccaagcaagcagtggtagacagcaggctttcagggaattatcccagggattccttaccagtcttcaaccagatatcacaccagagcaatacatattccccatgcaagaagcagagtaagcaatccatacccttagatacataacactgattagtgcctctgttgttaaagttatttccctttgtataagatgtattcaatgtttcaatgtttacagtgaatttaagaggtagatataatagttatggtgaaaaccctcattttgcagaagagaaaacagaacattgcctatgcaaaatgaatctaccaaggtccgcagctattaagtgcaaagtacaggatttaaacctgttttgaaaaaattgacaaagtctcagggccttgtcctgggtccattcattccattcagtcacatatattctaactcattcattcattcctttagcaaggatgaatagagcacctgctacgttacaagccctactctaggtactcaggttacgtcacagaacaagaaagacacaaacatttgcctctgcagtaagatatagaataaaatatgtataatgtctccctttccattgtcagccatcaccttgcgcagcacggctttctacttaaagagtgtttattgtgtaggcgaagtgggcacagacaacggacgataatcacaataccagtttaaatactagataaaaggtgctaagtgatctggaagaaagagaggagggcaaaggagatcagaagtgttaggtagaaggacaattacagttttaagtaggatgactatggtagtcctcattgaaaaggtaaatttgagtttgaataagctccagagaggaatctgggaaagagctttccaggcagaggacaaagcaagagaagagattctaaggtgccaggcatggctagagccttgcctgtgagtgacgggagagtagtggaagctgaggtttgcaagataatggggccaaatcatgggggcccatacaggtcattgtgatgacttaggcttttactctgtaaaaactgtaaagtcactgctgagttttgagcactgaagtggcataatcaaattatattttttcaatgattccattggctgctgggttaatattagtttgaagggggccagggtagaagcaaaaaattcaaagaaggcatacaacagagacagtaaaatatgtgcatgaaagccttccagtttgtcctgggtatttatgaagacacctcacattctctttttgcagtgaagtgagcatgatatgactcggttttgcctagaagcgacatcaccatttccaggcctggccctaaaacctgacatgtgttctaaactctgctccttctgcagcaaccattgagaccctgtgttgtggatgaaagcattgtagggtggaaggagctgaggtcctcaatgacagcgtggagcacaaccaccccttcccatgccaaccacactgggctgtgacttgagtagttttggaaactataaaaaagaacattttgtaaaaattccttgtccctctctatttctttcaaccttgttgccagagattgttgagattaacttcctgtttttatttttcaaagcaagaagagcagggcacgggtcaaatgcacctcttctccacatctccccaacagctgcttaaaatcatgcctctgtcctatcacacttttcaacatcacagcctgcctcggggacctaagacacttattatggagaatctctaagtcactctgtgccgaatgtggaaaaagaaaacactataaccacaacaatcattaaaattaaaataaatttgttttccctttcttcctaaaaatatatcaaattattggcaaggtttccttgaacatttcagcatgtttactatttgtttgaattcttttctaagcagattgtcattcactataccagttgttgaaaattatttaaactccccacaccaccaaatatatatatagagaaagacaaatagagagatagatatagatattcttttaccttccttcaatttgatgttttatcagatacctatgtttagaaaatttcaaaggtagaaacccaattagccttaatgatagacaggaagtaaacttttcccaaagaaattaccataattctccctaaacagcctcttggacatagaaaaggggaaatgaggattaatatgcttactacgtgctgggactacactgggaacattatttagaatatttcataaatatcttcagcattactcttagccagcttgtggttaagatggaaggagccagtgctagtattatcttctctgacaaatgataagcaggcacaaagaggtgacatgactgtcaccatcccacactgccaggaagagcatatctggatgtgtggggcacatcactgcagatgctattactttcttttcctggaacagtcagaggtagagaaacactgcaaaactgatacagaacaactgggggatgcatagcagcacagcagtttaggaaaccaccattggatttggccaggactgggtgtggatcttggttttgtccctttctggatgtggtctttgacaatgttgctcagtctttccgtgtgtccttaaacatcagtaatggctatagtatatttaacatggtctctggcgtattatgagtactcaaattgtagccactgtgtttattctagtaccactaaaatgtctcctgattttgaaaggagcatccccagagcattgtgtggctcatttacagatttgtaaaatgtaacatttacctacaccctcaatatctgctgaacactttcaataggcagtgaccatgggtcctccttgaaggtcataactagttaagtcaggaggattcttcaggggtttaggagagaatgagagagctgactcccggaagtgggaagggaatcaccctgactatttcctgtctttgctgctttcctttctcataagggagggctctgggaatgggaggcagcagcatccttgtccatactacacatcctttgttccctcccaccatgggcaaggagggatggattgtagcatagccatgtgagaaccatggagcaaaggtggaaggctagagggcagcagggaatctaattagcactagtcaattatctgttctatgcaacctgatgagtttgctgtcagagggaatgcaaaaacaacaacaaagaatttgtttttcatcttcatctctatgagctcctgtggtgcaactgtcagaaagcacttgccccaaatattttatttattgtcaacttttgcagagaatggagtaattcccatgggatctgctaggtaggttaatggactgagaagattaataaattatagacatggtactttgtgcaatgtactaatgtgtattgaacattatttcattagatcattacaaaagattgccatctgatgatgttttctgttgctataacagaatacctaagactgggtaagttataaagaaaataagtttatttcttccagttctggaggctgggaagtggaagagcattgtgccagcacctggtgagggccttcttgccgtgttacacatgatggtaggtgaaagctcagtaagagaggaagtatgaggggcagaactagctttataaaacccactctgaggataactagcccactcctggcataaaggctttaatccattcatgaaggtggagtccccatgacctaatcacttcttaaagaccacacctcttaatactgatacaatggcacttacatttcaacatgagtttcggaggggacaaacactcaaactacagcagtagctatcccctttttagagataagaaaaatgcatttagcaaagttacatagccagaaagtgtcagagtcagaaatctacccaggattgtctactctagcctcttaagcacccatatctctctattacatctccacatttaaaacaaaagccatggcatatgattctacactgttgaggggactttagggtgcttgctgtttgagcccctgagacaggcctcacatccagtggagctggtgtctggcctcagactgcaagaggagaaagtgcacatctgttagtctttaacatgcatcattgaaattcttgcaaggagtctggatggagctggtgttcttccctgtgcgtgaccttaggccagccagtggccagcaagagagaaacacaccaaggttcccagggaggctctgaacaactctttcccggaattgcttttcctgcccaacctagtgtgaaaggaatgtggtgagtggtacatccagggagatggcctacacggataccttctttgtgtctcttattatctttaggtttttactgatgccctgcacagagagaggtctgtaaagtggcaagcaggagtctgctacaatggaggaaaggattttgctgtatctcttgccaggcccaaggctgcagagggaattggtaatatacttcatttaataatagtgttttaagggacattatcatttcatcctatgtggtagatgtgatcatcttcatctcacagatgaaaagagacaaacctgggattcagaggtacttgcctatgagtttcttacagatttcctcttacaatccagaactgctgattcctgggtcagtgtcctttccaatatggcatcttaggcatggcaataagtgagatctaaaagctagttatttgatgcttggacaaaggcttagggcatgggctttgacctaatgaatcagtagattctagtctaatattttaaaggatttgaaatgattccagtttataagcccctttaactgtcttctaagatgtggctaaacattccaaccttccttagctcaaaagtggacaaaacaagagattacacatgttgatactttgggagtcatagaaaattcacatatacataggcagagtggttctgtaattaaccaaatctttagaggtccaaggttaacagtattgaccattcataattagccataaactcagacattttaaaagcctcatgaaaatagaagtatagttttcaaatgttacagaccccaaacaccagtgttttattgcctacagcaagcatagctcacagatcatcacaaggccttgcacaaaggaagcccagtgaatatttgtagatccgatttaattaatgaaggcacaaaccccctggctttcttgctgggtttcatgacatcttattaaacacactttatttagcaagcttggttatttgcttttttttttttgtctcccagcagattgaatgtaagtgacttggaaaaggaagaggagttgccagaaacagctaaaatgtcagtagaagacttgacagcttgagaatagaggaaaaaataaaagcgaagcagacaaaaagaaccttacctcccccacaatacaacattgggctgctgaacccacaaaaatctaaatccgtttagaatcatctatttaactcctcagagacatgcacaaactattctagagaggcttgtgcctacgaagattacttaagaatgtgttgacacatttggagggggttaatttaccagttatcatttactagaaaggctttttctataagaatatatgaaagagtttcctcggagcattcaaccgggcttctttgtagggtatgtgtactgcttggagctacggaagaccacgtcctagaagtgctgtgtccctgaggcacacctatgtgtgttatctctctggcatactttccaacaaggattcttttctagtctatacattctgattaatttgcagtcagaggcaatgcaaaaagcattccttttcatcctaatctctgtaagctccaatatggtacagctgtcagaaagcacttgccctgaagatttcctttatcatcaacttttagagtaaatggtatagatctgccactgcctattctggtttcaagatttggtcttacatcgtttttttcctttttgtggcaaacaaaatacaaaaacaaatcagcaaacaaaaaatgaaaacaaaggaacagacatttatatatatgtatgtatgtatatatatacatacatatatgtatacatatatgtatgtatatatatacatacatatatatatagacagagagagagagagagagagagatatgtttgcatgtatagttagtgatatggtttggctctgtgtcccctcccaaatctcatctcaaattgtacactcataattcccatgtgttgtgggagggaccctgtgggagataatttgaatcatgagggcagtttcccccatactgttctcgtagtatgtgtgagtaagtctcacaagatctgatggttttatcaggggtttccgcttttgcatcctcttcattttctcttgccaccgccatgtaagaagtgcctttcgccacctgccgtaattctaaggcctccctagtcatgtggaaatataagtccaattaaacctctttttcttcccagtctcaggtatgtctttacaagcagcatgaaaatggactaatacagtcagatagatgatagatatagatatagaagtagatatataggtatggatttaatgtaattgttgttagcaatgaattatgagcaaattgtctgtagaatgcaagacagaaagaagccttctttctatgctgagtttatccatattcctatgacactgataattaacactgtaccaattaattaattagtacaattaacatgtattgattagtcactgtccataagcaaagccccgagtttgactgaggtgtaaattcagtgtgtggctctagtatgaatgaatgaataaatcatattgatgtgcgtcatgggggcaaggcatagatttactgtgctaatccacgaagatttcttaaagagttaatcactagacataatgtataatgtcaataatggacataatgatggattaaaaatgtcaatggtagaaataatgatggcaatacagaaaagagttacattttattggatatctggtgtttgtctaaaataattcttactactttatctatactctcacaataaatcctcataagaacacattgagacagaagtcattagctgctcattattgaacaggaaactgagaatcaaggaggttaactcaaaaccccaattcactcagctagtaagtgacagaactgggatttcaccctaggtctgcttgtctttaaaatccctccctcctccacccttctttctatttttcaccctcccccactttttcttctcccctcttctttttcttctcctttttcttcttcttcgtccactccttaatgctagctaagctcatagatgtcttctttgatgtattatccctgatatccttttcaagagtaaaatgattaaaaatataagcataaacatttattgacacctactttttacaaagcactgtggcattaaaacttgcaatttataaaagaatggggcaatagagcacatgtttgctaaatgcttatgatgaatcaggtactatatattttacattaccactttttaatcttctcaataacaatatctattttattctcattttacaagtgaagggactgcagccaagaaagtgtaaggaagaaactggtatagaattacatgtcctgtagaaactctgacttgcctaaatagtaaccaattcaggcaatgtctttttagctgggccaagacacacagaaaggagtgatgctctgaacctctaggactgaagggcttgcacagcccctgtgctcaagcacacacagagcctcaaatggaatgttttggagacattcttatacagaatatgggaggtataaattccagagggccatttgatggtaagttatcaagtaggtaaaagagtttattggctgaccgaacagttacattcctataaatgatatgatgaatgctaaaaaaaaatgcatgtatacagtgaagctctttgtgcatgctcttaaaagaaatagtaaacaaaaatggtataaagtaaaagttaaactcaaataatatagacacttcataaaataatagcattgtcatacaatggaacaaaacgcagctgttaagatgacttacacccatattcaatgacatgaaaacatgtctaatgtatagcccaggtaagaagcatttcaaaactatgtattagggctgggcatggtggtttacacctataatcctagcacattagtagagcaaggtgggaggaacacatgagcccaggagtttgagaccaacctgggcaacatagtgagatcctatctctttaaaaaacagaacaaaacaaaacaaaatctatgtattagatactgaataaatccatatttctagaattaacacacacatatacacctgaaaaaaatgtgtatgaacccacaactttatttttgattggcttttgattgtgggatgaagaataatctatacttctttcttaaaattttcccaaattttttgttttctaataatataaactaatatttattgaatgcttacagtgtgaaaaataacttatttatacttctttcattatcacaataatccctattttaatattatgcaacctgaggcacagagaggctgataggctacccaagagagtggcagagctcaaatttaagtagattttctgcttctgcaagctcacggtcctatctactactttatactacaattgctacttaacaattttgacattaaaaagtacaattgaacaacactaataaaaataacttaaaatttttgcttccagaaaatgcacaattatctgttaattttacacaacataataagtggagtttccactatttcatcatttaaaggctaagccattcttcattttcaggtgtctccatttctttatttttgacaacatgtctttcagaagatacttaaaatagatattgtctaatgttttcttaactcctgggaaagattgccgcacggaattatttagcatccaaggtgtcatgggatgttttaagaggtagagtatgtggttttagtggtggtatggttgtttctttttgtagaggaatttatggattgccaagtgtcaaactcaagaggtttaattgcaatttaacttccaagccacagccttcaaacgtatttgggactttataagacatagtacagctcccctgagaccccaccaccctgtgggctgctctatcatggtacttatcatggttcctaaagcagtttgactttttgtctagatgtttcattagactgaaagctggatccgtcttgtcaactgctgcatcctcggaatttaaacattcagcttattctgaagtctgctagttcgtagggccaggaagttctcaaaatgctagtattgaatgcagggtgcatctcctctcctatcccccttaaagctattttaaaaagtgtgcgacatttctgcattctgtaaatcaagatggaatctatctcttggaggagacttttagatgtgcctttgttaccttagagatataggtaatttatcacttattgttctaaggaaagtttagaaccaaagtaataatgtagagggtttgtcctcagtctagaatgtaaggttctcaaacaaaggatgttcattttaagcagaaggcatctctcagtgatgatgatgatgctgattttaatttcttcaatgttctggtggggttaagagacagcaggggttaaggcgacctgagaaaagcaacttttctcctgtgacacctcaaatgctgagaaaaatgaccatgggggtgtcctgtaaagagaataaagagaaatggtgtgtgtactcaagggggagatattttgtatccagctctgggtttttatttatgcattttcactctcttgtatcatgctcaagccttagcaaagtttgataaagttgagtgttttgtctcagctgatggaaaagaagttgggggcattgacctggaatgagagatgagaagcccaactaagatagatttgtggaacatacaatcacttcctagggattctcagaattatatgggaaacaggcaaggcttcctgcatactcagtattgggacctggatcatattatttggatgtgaaagggaaagctgccccaaggaggatagagagcctggggtcacttggcttacatttggtttagaaaatttaagtttcctataggataaagagcacagggaagatatctgtcaaacatttcatagcccaattaactgaatcagttatttattcccaaatcactatagctttacaaccataatttgatttcatattcccaaagatacacttatctggtaaatattttatagagttaaaatatctttgagaaaacataggtttttctgaatcctgatattgtggcaattttatcaaagcacagtgaagctccagcttagaaaaattaaaaccatgatcagaaaactgtcctcatgaaccaatctctgtctttgcatctccagcataactgaacaattttcatgcatttctaagaacaaattgcaaacagacatcccaagaggatgttttaacacatcaccaatttggaaacgatggctggaaatgtcagctaggagaaacttttagacacatatgatgggatggaccagccataggcacatatctcttagactgagagtggtaaacctaagaactggagaagcagggttaaaagaacaagcccactagtcttctcctccatgaatatatgtgattactacagtgtctccttatcctctcaaaggattgctgtctttggcaaagctaaggatctgaacggcaaaaggaggtgattgatggtccatgattggatttccagagcagaagctgaaacctctgagtactgactccacctccttgacttctcccctgccacctcctccttaactgatggccagtggccaactgagagtcccaaccagggaaagccatttcctctccccagcatgtctggagggcatcatcatcttctgtgcccatttctcaggtgtattgccacatcagtatatgatctgagatggtatctccagcttcctaaacaactaagggagatcacagatcaaaggctttgggaggaaaggcaaggccagtagcaaggggaattctttccagaagaaaaaggtaatcacttctcaagacataatctgacccaagccagttaatatcatttgcatcttgcatgacttttgttaatggggctcagtcaacttgacatttttaaatgtttcattgttttagttcttctagataaaatcatgactgttcattgaactgttgtatagactatagactaaataaaagtggcttttaatgtgtataatgactaatctactccatttttaaccacaactgaaagctatgaatgaatgttaaaattttgtatcaaagatactcaaacttttggagtttttctttatttggaaagacagaaatgtttactttttattgttaccactctcattttacatagaataaaatgaagattaaattagctaaagacttgaaatgggacaaagctgggagtattccaggttggatgagacggaagcagtgtcctatcatgaaaaaagtattgataacaagtatcagacaactttgcccactgtcttgggcttggagatacagtggctagaaaattatgccctctgcctccagggacatcagtctcacacgggaggtctctcagaagcagaaaattgcagtagagaaatgcaatctggtaagtgctacaaggggagaagaagacaaactgggaggccaccctttctaatggggggggaaatgtgatatgccaaggaaaactctgaatggactgaggagacagaaagagttgtgtactcactctaaatagttatttaaatgtggctgggacacagtgtatgtggatgtaagcaagtcatgatgaggtggctgttgagaaataaagctcaaccaagattcaaggatgagattctggaggaccttgtgttctagcatttttaacatgattccagggcaatggagagccaacaatcattaggtgacagttatttatttgtacatttacttgtcaggtatttgtcatgcatctcgtactttttatttaacaaacatttattgaacacataaaggcactggagacaaagcagaaaaataaataaacacaaaaacaaacaaacaaaagacagacaaatccttcttcctcgaaggagcagatggcagttttagatgtagtagtcagggaaaacctcactgagaaggtggcattcgggcaaagatatgaaggaggtgaagggtaagccatgtgggtatccatgagaaaaacatcctaggcaaaggggaaaaccagggcaaaggtctacaggaaagagggtattgggtgtgtttgaggaacaccaagaaagctcatggggctggagaggagatgaatctagagagatgacagaccatgtggaacattgtgcaggctttggcgcttaccctggatcagaagggaagccactggaatgttctgagtagaagcttgaagtactaacgcttccagtccagaacaattccttggagttgagatgaaacaaggacagaaacaaagaaaccagttaggaggctggtacattaacccaagaataaaaaatggtggtaacttggattgtagtcgaagcagtgcgtatggtcaaaagttgtagtgacacccaacaagatgtgttgatccattggaagtggtgtgcaaggacagatggaaagtccagaatgacttcatgttatcagcttgagcacctgacaggatggggttgtccttagctgtgtcccatggggaagacggtgggaaagaagctgggaacatgttgtgggagaagataagaagtttagtttttgatcaaaatattgattgcatatgcaagtacaaagacaattattaaaatcaaagttttggggacaggtgtggtatagacatataaatttggagttctttggtctatggaaggtatttagatgtagaagaataaatgaaaacactgagagtcagacatcgtcagacactgggacattcagcagagagaaaaataaaccaaatgcttgtccttgaagacctcacaataaataaaaataaataaatagaacaaagtacaaaaagtaacgagtaaaacaatattatactgatttctggatgcagagtagagaacaacgtgggagggaagacagacctgagaagttgcttttgcaattctcagaggacatcttgtcttgaatttggtgtcggcagtgggaatagaaaaaagatttgggagacactaacaagatttgatctgtaaaactgggtaattttttttaagtccaccaaaatattttgctcaaaagacacaaaaacagtttttggtacttaaaaaaaaaaaaggcagcaaagtgaggttgcaactcatagaattgaccttagttgtaatccccactccgtttgcttaacccttttattacaattggtgccactttaacttttctatgttttagttaccttttctgtgaatgggataaataacactttacaatgtttctacgagtattaaagaaaaacttacagagtagctcctagcaggaagggttagtgtggaatagttagcaggtgtaggagaggaaaaaaatcactttttcctctacccagctttggttcaatggctggacccctgcaaattagactaacaaatgacagattaacaagataagaacaaagagaaattgactaatatgtgcactgcattattcaaaggaatattcagtgatgagtaatttaaagggatgggtataccttgggcatatatgtcatcttagaaaagaataataaatttgtagacaattgataagacaaaagaaaatgactttgagttctagtggtggcaaattgtaggaaggaaaatatatgagaaaactaacggaagaatagagctaattagtgaggtttgttatgtagattctcctggtacagtcttcagtctcaaggataataagggtttagaattgtttcaggtgattaaattatgtcctttctggtagagaacgtggggtggggggggtgcatccttataaatttatgtcccacttttaggcaaataagagtaggacagagagcttttattttatctgcttcctctcaattgtcttcagctccaaataatcaatatgccaaagtggcatattctgctacccttcacaggtattcagaagttattacttctctttttatctaattaagaagctcaaaaacttcataaaatgaaataaaaacagaactcattaactcaactaaaaaaatgactttaggcatggttggatccaagcttatcaaagctcagcttcttttcctctctcactctgctttcagatctatcagttttatcatcagacaggctttaaccagataatgcaagagactgaggctgtaaaagctggctattccaagtgtcaggctacaaaatgttatttgttttgtcatcaaggctccttttgtcctacctcaagcggagctatctgttaactattccaccatctatgtccttatgatattgaattggtgctgtgactacaggcaacctcagtggaaagaatgtctcttttccaatatcttcagcaaactttccagatatgactcttggcccatcctagaatatgctacattcttgactatggacaagaggttggaattctctcatttacctagggctggaatcagcctcacccaaacctcatagagtaaggttaagggaggatcaaggaggaaaaaatttcagtccgctattttacttttgctatttgattatactttcaaatacttcaaatgtttctggccaccaggcttctcattttgttatgtagtagccatgatggatttcatgactcaaagactatgacaacctataaactctttgtaagaagaaaccttcacttgagcctgggaagtctaggctacagtgagctgagatcatgccactgcacttcagcctgggagacagagagagattctgtcaaaaaaacacaagaacaaaaacaaacaaacaaacaaaaaacagaatacagaaaagcaaccttgtgcttgggaggaaagccaggcatatgcccctacccctccaactactttccattcctgcctcctcttcatatccttccatagatagctgtcaaaaccatattgctttgaaaaaacaaaatagcatttcagttccactcagccttttaacaactgaagatagtagttaactgtaagacaaataaagggattcctaaaggcacaagcacagcatgacaaattagcaggctcatggccctaggataggagagagcttcccactcagtctgaatcaccagctcactggtgggaataatttatttgatgcaaataaaaaaattgaacatttataaaccagctaaacaagaagcttaaggggagagcttctggtgcttggaaaaaagaatttattctccatgggaattagatgattggacatctatcaggacttcggacatgcacacatctggtacaaattgctaggatacttagtcacttagtaaagtcctcaccagcacgtagcttttgattatagaccttgctcttccactggaaagcctttcctctaatgtgagaaggacatattggaactgtcaatcatacccccaaaataaacctctaacttactgctctctatttcaatgtcctcactagagtctactctcttgtctagaaaactggtggcagtagttaacaggtttttctgcttattctttttttaaaataatctttttatttgagaataattttaaatttacagaacggttccaaaaat

SEQ ID NO: 505 - DNA, 47251 bp, Homo sapiens
gacacaattcaatatgacgcagttcctgggctcaagcagttttttaggtgggaatgcgttgggaggacagaatgtataacagatgaatcagggcggtggctctcgaagtgccatcctgggccgcagtaccagcagcacgtgggatcctgagaaatccacattcgcactgcagacttgctgcaccagagaccggggtggggcccagcaacctgggtttttacgagctctctggtgatcctgctgcatgttacaatttgagaaccactgaattcaattctgacctgacaaactgcagtgcagacataagacagcgggcaccacccctttgcctctactctcacgttttttactttagattgtgtattaaacataaaatgcatgcaatctcccaattctagtgttctgaaattccatctgtatgtcttgaaatttagtaagagatttatgaagacattgtgttgtaatgtcatatacatatgagtggtggtagaggtaataatcagttctcattatccctggtagtcatggtctgtgaagtcaccggaaaccatgatgtagtgaatactgaaccatagctgcagaggaaatacagggttcgcgtcctgtgagtctccagtctcaacatttttgtcaactgatcgatacctgagcttgtctaatgtgtgttcgtgttgaaagacacctcatttaatatatagtagcgacttgctaacattgaactcaccgacagcgctgtctatacctcgtgcctgaaagctgatcaacatacgtatttccttctcaaggcacaccacagccttctggcgcttaggaacactcggcagctttagcacagcactccaagaccactttacacagccagatcacccacaacaagcacaacaatttggaagacctgtgacagcactgaatagacccacaaaagtgcacacttgttgacagcgtgagagctgaaacaaggcagggtcgccttgtgtgaccgcagcggggagcacgcagttgaagggactcaggtgtgtcattgttctgcacatgtgcggaggggcatggaggcaccacgcgtgtggagttggggcttacagatgtattttagcaagtaggtgaatttgcagagggtgaaccagagaataataaggatcaattgcatcttaatatttcagttacataaaatctaatgtacaacagtggtctagcaattactacgaagtctttgttttctgctgtgctgtttaaaagagtaaatcaaacattgaaaaacacattttaggaaaatttggccttattgatgttgcagtttgcccaattgaactcttcatagaatatgtttggatagttatttttatgttgaaagactgtttaattatcagaatttttgtaaaacagtttttagattattcttttttcactttatactaagtatagtaaacaaatgtgtaaaagtaaaaaaattggatattaaagaatgtcattggacccatttgttcaatatattaggttgaaacaatgaaatttctgtttctctggttcaaagtagtataatatggacaatttcatatgattctgcctaataattactctccgtgataaattttagcacttactttaaaaagttgggtttcagaacttaggtatttcattttgaataatgtactaattctatatttttctataattttctataagcttgtggaccttattgattacctaggactttctatgctttttatactcttcatattaaaagtctaagtatttttcatccttttttggatacaacatttatagcaatttcaaaatgtcctgataatctgtgccatgtataggagctttagcgtctctgtatgatttgtagggagctgtgggagtgtgccctgcagggctgcaggtggggtgctcaacaagccaggctgcccacagcctaagaaggtggctctgcctttccgtccacctgtctgtgcccgagttttctcactggcagaatggcattaacagcagtgcccccttcgaagaatgattgtgaagctcaaatacactgattgatctctctctctctctctctctctctctttctctctctctttctctctctctctctctctctctctctctctctctctctctctaagtgcttaaagcagggcctggtgtgtggtacatattcaggaaatgttagtggatactatggtagaacatatttgttgtgtttaaaatagaccaataatgaaaggaactttaacagaaatcagcaaattggatttgagatgaatctttgaaagctaaacttttaaagctagactggactgatctggataaagctgtgtacccttgggaatttactggatgttgctgaccctcttttttttttttctatataaaagagtagccacctttcaggtggctgaaggttttgttcatgtggtggtgtgaggtttacgagtaaggtacattggtctctggctctaagtgctggtcagagcgaaagcataccctgtccctcatgcacattcatatcatgtgcatggtatgatatgtgcatggtacgcactttctgtcggctgtgcgtaccacctactgttcactgaaatgctgacttctgattgagacaggattccctatctattctggaatgaaaattcggcaaatcctaaatcttgcaaaaaagaaaccataaagtattaaaatctgggcaaggatttttttttttatagtgatgaaagaggggaaatgttgacatctggtggctttctggcaatattgcatgccaccatttcaatattacatgcagcctttcaatcccaatctagagctatatcttggtttacacaggctattcctagaacatgctcataaaagaaaaattctgttatcatttaatatcatatttatttattgcaatttcctggactcatttaaaacaatgtacttataaatttcaccacttaggtaatttttaaatattaaataatatattctatatttttctataattttatataagctatggacttcatagtttacctagcactttccaagatttttatactcttcccattaaaataataaaacatgatattgttttattagtcttctatgaaggaagttaccaacttgtaaaatatatttaaatgtatagaggaggttaatgcaagcatttttaaaacagactttttattttagagctagatttacagaaaagcagctccctattattctggtacatgtgtcacaactaatgaaccagtatcaatccgttaccattaactaaactccacatttattctgatttcaccagagtactattcagggtttttcagagaagcagatcagacaggatgagttagtgagtgagtgtgtgtgtgtgtgtgtttgcatgtgtgaagagggagagagattttttaaaaataggctcacgtgattgtggaggcttggtaagtccaaaacctgcagaggtgacagattattttgggggttacaattatattttagcaaataggtgaatttgcaaatagtgatccagagaattgcagagattggatgaggtccacccccatgatggagggtcatctgcttcacgcagggtcccctaaactgtattaaccgtcaccaccagttttccccagtgcccttcctctcctccagggtccacttgacattacatggagttgtcacgtctcctcagtgtcctctgatccgagacagtttctcagactttcttgttttgatgatcacgacagtttaggggagtactggtcatgtgttttgtagaaggccgctccgctggggttcgccttgtgtttttatcatggtgagactggggttatgggtttgggggggaaggccacagaagggaagtgcctttctcattgcctcattgcaagggtgcgtgtcaacatgacacatcacggatggtgccagccttgaccacctggctccgggagtgcttgtcaggctgctcccctgtaaagtcaccccctgcttccatactgcactcttggagtcaagcttccatactgcactcttggagaagaaggtatgatgcccgcctcctggaaggggagacacacaccactggggtagagttcttctgtgggaaatgtgcctcttctccccatttatttatttatttgtttatttctatcaatatgggctcatagaaatgtattttgtactttagttataatccgatagcacatgatgtattttgttactcaggttgttctagctttagccatttggggctctttcaggatggctcctgtgacatgctctcattcttctgttgttttggtttttgttttttgagcactttcctacagtctggcagtacaagatgctccaggtacattttatattgccctgcctcagcccccaaatcggccactcctccatggagccctggtccctctattggagaatagtatttggtgtggtctgaatgtttgtatcccccaaaattcataggttgaaatctctctccaatgaaatggtactaaaggtggggcctttaggaggcgattaggtcatgattgcaaagccctcgtgagtgggattcatgcctttatgaaggaggccctgggggcttcttcacccttttggccatgtgaagacacagctggaaggcaccatctaggaagcatggagccggcaccagacactgaatctgctaccaccttgatcttggacttcccagccttcagacctgtgggagataggtaatggcaaaaactgcagttacttttgcatccacctaatacgtttctgttgtttataagtcacccagtctatggtattttgtcatagcagcccagatggactaggacagtgttaggaactaagatctaggcactggaggtgctcattgctactggagacagctctatggtatagagagatgacatagttgtatgtatatgtttgtatttgcaaagcaaggccacagttctgatatgcacaagtttcagtttatatgatacccatgtaaagccaggactgctcgtactggataaatgtaaaaaactgtatgtaacttttgtgtattatattgcataatattaaaatgaactggtttaatactccacctaacaaaaaaaaccactctcaatgctttaaatgctgaaaaaaggaataatttacaatttattatgtatctatatgcagtttccaaaatttgtctctaattcacacaactctacaaggaagacagtaatattagccttgttttagctaatttctgctcacagcattaagttatcagctcaggattgcatggctagggcaagacagagccagcacgtgaaatcaggtcaatttttagaggagttgcttataatttttggaataactttatatcttatattactaattaattttcagagggtgatcacataatcacatataccactttttatttttattttttgagacagtgtcttgcttcgtcacccaggctggagtactgcagcctccatctccggggctctaagtgatcctcccacttcagtctcccaattagctgtgactacagatccatgtgaacacacctagcttttttttttttttttttttttttgtagagacaacgtctcattatgttgcccaggcttgttctgaactcctgagctcaagagatcctcctgacttggcgtcccaaggtgctgagccactgtgcccagcctataccattttattttatcctaatgaattcgccaaactaggctaagggagatcctattattttaggaattgaggtctcccatttaatgactctaattactgatcccagggccccatgccattaaaatgtaaaacacttaaacaataagatagaaatagttatgtacttttcaattctcaattagggtttaaataatcaatgaaagatggaaaatcgtatggactaagtacaggtaacattgtattaggttctccagagaaacagaagcaataggagatacatgtctacatctatatttgtatatatctgtataaagagatttattacaaggatttagctcattgattatggaggctgacaagtcacaaggccttcaaggtgaatggccaagttggagatccaggagagccagtgaagtagttctgatccaacttgccagcatctggtatttttaagaatagccattctgactgatgtgagatggtatctcattgtggctttgatttgcatttctctaatggtaagtgatgttgaactttgttttatgtgattgttggccacatgtatgtcttcttttgaaaagtgtctgttcatgtcctctgcccacttgtttatgggttgtttttttcttgcaaatgtatttttaagttccttatagatactggatattagacctttgttggatgcatgaaatatgttattggtgtaaaatacacactggatttcaaaacttagtacaaaaaaattaaaaatatctaattaccaatttttatacagattacatgttaaaatgataatttatattagattaaaatatatcattaaaattaattgtacctgtttcttttactttataaatgtggatactagaaaatttaaaattgtatgtatttacattatatttctactgggcagtggtggtctaaaccaatccaacgtgaagattttatcactttaatctttaagcaagcagcatagctttaggttttgaaatttgagagaagagacaaatgaattaaggaactgttcaggttttgaacagaagtcataagaaatatagaagtcaagacttgctgggtttgtgaaactttgaccatcacagtctctctgggcaaaactgaaaaatggcctctgtgcaaagatcaaatcctaggcaggggtaaaggtgaaatcaaaggtttggcttaacaagacgtcagatttaggggtgtctcatagatccccaagataatagggctttaaaaaatcataagagaattggcccccggcagtctcaaaggtggaccaagggcccatctcaggtcagtgtggtttgtaactaatggatggggtgaactctgataaaattcaaagaaacccacaaggtattggcagagtgatggaagcgccactggcttgaactaaaagaggcacagacttttggacccccttccccagccttccctggaggaaagcaggctgagaggctacttagttgcaaacctaggccatttcttttccctgaggaagtctcggtagaagcaacagcccagaggacagagctaagggctggggagaaggcaggaagcagaagtgagtcctcctcaaggcaaggcagcaggagcctgctggaacccgcagtggctgctgcctggctccgccacctctcttgttggacaggtgcccactggggatgtcctggctctgtctcaccattgtcggttgggtgtggagaaggctgttgccttgtctctctagttcgcaggtcttcagatgtaaaggaaatacccaagcagaagcctcatctgtacgcggacatgctttagatgatgagacttctgagcatcttgaaagagctgagtgtatcgtgcatgtgtaaatgacctgtggccagaggacggttatggcggattaaagacggctgtaggttcttcccattgagagctggggtctattttccatctctttcattctgggactgctttgattatggagtacagtggaggtgacactgccagttgccaccttgaatagagctgacggcttctgcctcgctttcttggagccctaagctgccacgtagaaattccaacgacttcactggagggaccactcagagaagtgttgaagctgcatgagagaaggctcaactgagcccagacttccagccacccccgactgcatggtgtagacacatgagtgaagccttcttagagcctccacaccagaccaccctccacctgtatgccactgagcaaccccacggggagcagaagaaacactcaacctgccgcaattcctgagttctgtggattatgagcataacaacatgactgttgatttaatctacatttggggtggtttgttatggggtaatagatatctgggacacattcacacatatacatcctagctgtgtgacctcgaacatgttacttaaggtctctgacatcagtatttttatcaacaaaattgtaataatagtgtctacctactatgggtgttaaatatatgtaagaatatatgtaaaataatatatataaaagtaaaagcagctagcatatgtttggatcttaaatgactttgtgttcgatttttactttttttttttttttttttttttttgagacaagagtcttgctgtcttgcccaggctggtcttgaactcctgggctctagtgatcctcccatcttggcctctcaaaacactgcggttacaggtgggagccatcacaccagactcctttcttttgtttccctggcatgcccatcctcccacccctggcaatataaataatatcagcaagtctgtgtgggcttaagataccatagttttcctgatagatatgtatacacatacacacacatcacacatatacacatatacatgtatcaggatttaaaatctcattaattttataatttataaccacttaccacttttataaaagtggggaggattccagtgttcttagttcaacaatggattactgttttgtttgtgtttgtttttttgagacagagtctccctctgtcgcccagcctggagtgggtggggcgatctccgcctcccaggttgaagtgattctcatgcctcagcctcctgagtagctggaattacaggcacgcaccaccacacccagctaatttttgtatttttagtagagactggggtttcaccatgttggccaggctggtcttgaactcctgatctcaagtgatccgcccacctcagccttccaaagtgctgggattacaggcgtgagccaccctggctggactactgtttttgttattggtagtgatttcttgtcaccgtgctagggtggtgcatcagaaataaactgggctttttagtaaaaactcggaaatacatggtttacctctgtaaatacgggatacttggcaggagaaattgtacctgttgaaacttagatggcctcagctctcaaaagagactggctacggcaggacggggatgagtgttgtaccggcacccagtgcactaactgtcattactaaaatccctgtcgtgggaaaggcatgcctcgtgcagtgcccaccctctgagactcaaaaatgtagttcacctccgcgacctcaccccttcttcccttagcatgtgaaaatgacggcttggcagtttcaccagctcacaggagagcgtccagctgctctgctcctggtataatcctgggcctccaaaactgaaacgagcacatggtaacgcaagcggcaggcatgctcggggtgtgcaggagatgcaccggcttgtgtgagccggtagggcaggacgggcgtggaagggtccacgtctttagtatgcatgcttagatctagcgttcctgttgatggagtaatggttctcgcattgaccagatccggggcttcattttttaaacctcattcgtccactccccaccccagcctggtgtgcgcaccctttgatggggcggggataggcgagatggtcctgtggttctctgccttcttctggtgaattaaaatccgatttggaagagagaagggcagccagcaccagtatgcacagcccccggccccagagacccgggaaggagtagggaggccgggccgtgcgcggaggagtggccgctgggttggaaacccggcccggcagggagcggggaaggcgcgctttcccggaggtcggcgcggggccggggccggggccggggcccggagcggggatgggcgggcgcagccgggattagctggcgggcgagggcgcagcgcagggaggaggaggggaggcggcgccggcgcgggcggggcggaggatctggagagggaaggggcgtgcgagccccgcggaccccgggcgcgcccgggccgcctgagctgggccagccgcgcggcgggcgcgggcgcgggcgcgggcgcgggcgcgggcgggtggggagccccagccccggggccgcgggggcgcgtgaccggctgtctgcgtggggcccgcgcgcggtgcctctgcctgacggtgcccgagcctagcgcggagcctggcgcgggggctgcgagcacaggcccggggctgatcgtaatcgggtgagtctcatccggcagcagggctcgccttctggccgctctgcaggcgatgtgcgcggtgttctccgcccgcgggccggctgcgtctggcccgggcttccctgcaggcactcgggaagcgtcaggccggccccgggcatggctcacgcggggaagcgttcgccgccaaagggactccttcgtcactgcggtcgctcctgggacttgctggtgttgggtcagggcggtgtgagtgttccgtgctgaggagcggcttcccatggccaccctggagtgcccctgtgtgtccccccatccagaaaaccagcctgcattttaacccgttcagagtacagtgcttatgtcagacagtcctgtcaactaggaatagaaaattttgaaagctgctgtcactgacattagaatttctacaaagcagtgtggcagaggtttgtgggctgtcaagaagcaacctaaaacagtaactctggatgatgattttcctgacagctggaatggagtcatggagattggaactcacccttaacctccatgcgccaacaaatgagtgcagtctagtttagtgactgcacttcagtccaccctacgaagacctgtccccaaatcaacagccttgctctatttaaacagtatggacaggaactagtatagaacttgcatgtctatgtttagaagcttcatggacatgccaccatattcaagttttaaaatacctgtgggatgcatcctgtaagttgtgtacactttcttagactgtgtaggatacagaactagtccatagtttataggggattaaagaggttcaacattatgcatgagggaccagtaaccaatccttggttagagaacagagaaaccaaagaaccaaaacaagatgtgaaagagaaaaaaaaaaagaaaaagacaagaaagggattttgtaggctctgctgttaattcatgatgttagtaacttgtgccactggagagacaggcaggtcagtggcctggttcctcgaagaaactctgtccctatcttctttgtgctcttgggcaatcattgagttacggacttaaattcctgttcacctcgtttttttgtgaattgtgtggtcaagtttgtatgttattacactgaactctgaagctcaagaaattgcttaaaaggagatacagaggggaaggtcagagaggaaaaaagagggagaaatggcatggagtaggggagttttaaggcacctaattcgtaataattggtgtgactgttacccaacttcccatttccccctgccctgcatcccaagacctcctgggctcagctctgcgtccaagacagtgggaagcctggtcctggaaaggatgtggtgtgatgtgaagagagatgagttcctccgttttgtaaataattttctccttaatttgaaaagagcttccaccctttcccctgaaaaagagtgaatttcctagaggaataaattattcattgaaacaaactcgcatgcgtcccattttgaatttggcttcaaagttgcacaaaagcaggaggaggagctagaagcaggatagaccgtcttgagcagagcagatgctccgtttggcggtgaaaaccatttgggggaatatcagctgcccaaagaagagctgtgactttttaacgagtaaaacgttatccaatagtgtcttgaatctggggaatattttcatgtcaggtcacgatgtaatcctatgtttcaggcataaacattcagagtaattctgtagtgaaaatgagttccgcatttgagttgctaatttcgtcttcgccgtttgagtctttcaaccgagggcatcttttgtgtgacgagtgttatttcaggtgcttagcttaaaagatgaataaggtgtcaaggtcacaacaaaaagttaaaatgtgaaaagatctatataatacaaaatgctatgggaggtccaaagaaacaagaacacagcatcttcgtagagtagcaggtgatgatgataatagcagtgagaggacagtgcggtggctcatgcctatagtcccagcagttttggaggccaaggcaggaggatcacttgagcccaagagttcaagaccagcttgggcaatatagtgagaccccatctctacaaaacattaaaaagttagccaagcatggtggtagacacctgtagtcccagctactagagaggctgaaggtgggaggataacttgaggcctggaggtcgagcttacagtgagctgtgatcctgccactgcactctagcctgtggagcaaagcaagaccctgtgtcaagtaataataataacataacaataataatagcagtgagcaggtaaacccgatttatgtagcactgactgacacttcatatactttatctacagatgtggacactgaattcaggagaggaaaagttaacttgcttaaagcctcagtggcagagcaaatttgaaccccccattattattctgtagatatgtatcacaaaagaacaatgttttagctaattcatcatgctgagttttaaaattatttctcagtcatatattaactcctataccagtatgtttttcttagtgttcaaaacaaatctatttgatgtaacttttagttgttattttatgtcattagtatttgtatgtttacctaaaaagttactgagtcacatgtaaacaagaaataattaatggcttgaaagcaactgaagagggctaaaggtaaagcagtttgtcagcataaagcgtgtcctttattcttttctctggggccctttctttaacatctttatcctcagagttacctggttgtccgtaagatacctaagcaacaaagagaataaaaacaatcatataattctattattctctcttgcatgagacgtatctatggaaggtagatgttctcgccaatctgtacatggtaattactttgttttaaaaattctctttgttggctgggtgtggtggctcatgcctgtaatcccagcactttgggaggccgaagcgggtagatcacttgaggttaggagttcgagaccagcctggctaacatggtgaaaccctgtctctactaaaaatacaaaaattagctgggcgtggtggcaggcgcctgtaatcccagctactcaggaggctgaggcaggagaattacttgaacctaggaggtggaggttgcagtgagctgagatcaattaggtagccttataatcgaaagcaaaagcaaactttttaaaaatgcattttagagtggtgttctaactagaaatattgaaagttgaagtttttcctgattcatgaccatatcttatgttaatatatgttttatttgtaagggaaaataagatttctattgaagaacagaagttgttgattattaaacatcaggaagatattttgactagaggaagtaaatgttttaagcggttcattgaaaggacatttcaatgattaacaggaactgtgctacaccagttaggcttaatagtttatttaacatctagatatttcttctgttttagttcttcattaaattttaatatcttctaactcttgaaaactcagtatacccacaaacagcaatgctagattaaagcaagttaggtgtctgtgtggcttctgagtctaaagaatttgatgtttcttaattaatatgggattaatgatttttttactggaggagtggttgggttttgtaagtaagtcccttgtccctggtcaagggacaactgggacctgaaatccctgaaatactgtgaactgtttggggcaacttttccttctctggctgagtcacaaaaagttgatgttgtcttcagttcacataaaggtacatataggttaatggcaaccttgattttaagaaaaagaaaaatgatgacatcctaagtctcagtttcatcaggatggggtgtgtgtgtgtgtgtgtgtgtgtgtgtgtgtgcgctcatgcacaggtgggtttggagggatgtggcagaacgagaggagcaactttgtataaaagagaaattttaaaagtcttaatgaataaaactatattattacattagggagactcgtcatgttttattttatttccagaagaggactgtcagaaggacgtagaaggcacggttttactgtgaggagcaaagattctttacctacgcattttacaagaaatgtgcagaaagccattgataaatatacctggtaagaattcaccttgcttcagattacaaaatcacaaaatgcccgtaacaaatgtgggaaggaagttagtgactggccatgaatttctaaaagtaagatgcagttttatttttaacctagtgtaaacatcacactgtaaaaatatttcaaaattagtatactgtgaaattaataaatatatttaatgaaagaaagaggaagcaggctcagaaaagtgaagccacttagccatccaagcccttccagcaaatgtgatttctttgctcatgttcattcctgcagcaaatccttgtcatccttttcctccagcggaagccatacacccacgggagcccacacctcttggtctgggtcggccacacagagctctaccaccggctcatccacggagaggggctccgtttattcctggagagatgacgtatgtctcagaatattttggataatcttgtaattacagtttatagtgaagagttgcttccttatattcaaaattatttttaccaattataaaagcatgacctattgcatacatacatgtacatacatgtaaaagcatgtacatgttacatgtgaaaataatagatcacgaaccgtggaggaaaacagaactccctcgtgaccttctggccccgtcttagctgcccgcagttttcttgtttccaccctgcagccggctctccgggtgtgtgctccttgtgacttcttggatggtatccatggccggaaattcaggacttgaataagaaagaaatgctggaaaagtaaaagctgtggcagccactgtgattagagaactccccgccagtattcccagtcggatatttcaccttcaccccctaccgctgggggcgctgttgcctctgaactgcttttgtctgtgtgagcctgggattctggctgggcgagctctgcctccactgctccagcttgctcaggagctcactggctccagtctcctccctccccctccctccaagggtctccgtggatcccaggacacagccctcctttttaaggcccacctggctgcagcaccttgggtgttctgttttacctcgtttatgctgggtgttttgttgttgttgttgttgttttttgcttgcttgctttctctctctctctgtctcttttttttttttttttttttttttgagacggagtctcgctctgtcgcccaggctggagtgcaggggcgcgatctcggctcactgcaagctccgcctcccgggttcacgccattctcctgcctcagcctcccgagtagctgggaccacaggcgcccaccaccacgcccggctaattttttgtatttttaatagagacggggtttcaccgtgttagccaggatggtctcgatctcctgacctcgtgatccgcccgtctcggcctcccaaagtgctgggattacaggcgtgagccaccgcgtccggccttttctctcttttttttttttaagacagagtcttgctctgtcactcaagctgaggtgcagtggtgccatgtcggctcactgcaacctccgcctaccaggttcaagcaatactcctgtctcagcctcccgagtagctgggattacaagtgtgcaccgccatgcccagttaatttttgtatttttagtagagacggtgtttcaccatgttggccaggctggtttcgaactcctgacgttgtgatccgcctgcctgggcctcccatggcatgagccactgcgcccagcctctttgctttctttaaaagtggttccccactcccactgcacatgggaatccgcttctgtccgcagctgtgcagctgtgattctcaggggagccggcagggcaggtgcaccgagggggtctgaaagggactcagctcagcactgctaggaggacctttcacgcacgcagctcccttacttaggggcagctgcctccttcctctcccttacgcccactcaccaccatccctcaagcccgccttccttggtagaaggctgagcaccactgctttactctgtccaaattctaggattcttttagtacaacgtttaatggaattaccagggaaattcgtataacttccattaatactcaggcctcaccctaataaccacacttcttaggataactaaggatttttttttccagttcattgatttaaggagattaatggccttttctacaaaagtaattttcttttctgtggtatcaccagaagaaaaaaaaatcttgtattttgcaggtgtgcttaggtgtgtcaggcacagctctgtgaggagctgcctgtgtttgcagacatacagatgtggacgtgtctgtgtgtctacgctgatgtctgtggcagtatgaacacgtccatctatacctctatctatgcaaattcttgagtctcataacttccgtggcagaagttttctctatttaacagtaaaagaatccgaggctcagaatgagatggcatttctcagaaaggtaacagctagagcacaggtgtgtctgactgcaaagccaccatctttttaccaagtgatgcaccctcctacatagtgggtgacagtaaatgtataagtagcgttgatccagaagcccgcagttctgtaacttgcagtgttgtaaccaagtgtgcatttctgtttaggaatttgacgaagccagttcacagtcagtgcagcggttactctgggaggtggaggaaatgttatttgaagggaaagtgaaccctcagacccagagtctgctggccgaatgcggggagtggacaagaagatccctccatttgaggtgggaccttggtggtggaagttctctggggtgggttttccaagcacccacccctgacctgcctcgatacattcagtacatttggtgtgaaagtgcctgcccagtcagaatatggatgcagagcgcagtccttcactgagagatcactttcctcttacggcgtctgaggaaatactgagacattccagtactcaagcgccttttaatttgtgagaagcaaattcaggccatcctgagaagggcatgacacatatacgaatgcaagaatggtggaggccacctcttaccttcacattcactgtgtgtgagcagcacatgtctgtcttcatcacagaacacagcgagggtgggcagagatgatttgctgaacggctggatagatgggtcttcccatctcacccattccttatgtagggaggagcatgtgttacttttcatatcaaagatggagaatatggattgggtatgaaggcaagcttttcttttctttttgctttttttttttttttttttttttgagatggagtcttgctctgtcgcccaggctggagtgcagtggcgcgatctcagctcactgcaatctcagcctccttggttcacgccatcctcctgcctcagcctcccgagtagctgggactacaggcacctgccaccacgcccggctaattttttttatttttagtagagacggggtttcaccgtgttagccaggatggtcttgatctcctgaactcgtgatccgcccgcctcagcctcccaaagtgctgggattacaggcatgagccaccgcgcccggccaaaggcaagcttatctttcagtcactcagccaacgtactgggggacagtttatcaaagttacctgagttcctgtggattctgtctggggagaatgaatcagaacactcatgtaaatgtggctggatttcctggttacattcactaggtaacttttacagaaatcttgaccaactagggttgtttttttttttcttttcaacccttaataagccacctgccctaaagagtatgatatgtccactagatactagttgtggatactcacttttctggggatgatcactcaccagaaattcgggagctcacacttattcttgtcactgctgtcttacatcattgatagaaatggagggaaggtgggaaaagattgtcaggtacataagccaagtgtgcatatttatatatttgtattcttgttatgtttgtgtttaactgtgtattagttaatatgtatggagggcttctttgtgcccagtgttgccttagacacctgagtctgtcatatatgatctctaagccattcatcagccctgcaaggtaaccattattatcctgttttgcaaatgaaagacaaacaaatgaaattagcctgagaaccttgcctgagactgagtcagtggaagaacagtctggcctaaactctcaaagtcacacttctgtgatgcgtgatgcttcccacgttcccatacacatcttatcatacacatgccttcaaaatcattgtctcctacttttaaaatctccaaacattttccctttgtctgatcaaaaatgtcagtagcttctctttgacctcgcagagtattaggaagacagctgatcctgcccactgacaaaggcgtccagcatttccagggcagcactcctgcctccgcagtccacagacccccgctcagtgcctgcggacacagcagcaacatcagagagtatgttcagataagtgactctcaaaaagtattgttagctgtattttagttatactttttcatgtttatctcatctataagccttggctccacccattttggaaatttagattctgatgaagggcaggtacagagaacaatttttataagaagcttttgattctgaattgatgataggtgtatatgtgtgtatatagagagatgtgtaatatatatatggaacacacatgcacacacatggtagttaccttccatgtttgttccaaaggcgctgtgaaaggtggactgggtgcaggatggaaaccgcctcactgtgatggattataagcctccaggcggtggcagcaggagaaatgaagctctgtcctgtcgtttctgttcactagcagattttgatgactctatgccattcacacatatttggtgtgccgtgacacaatgcagtcctttcactgcaaccaaagagggtacaaactcatagaataatttaggcttttaagaagcccttaaaatgtttaatgatgcctgtattaaagtgtttttaaggacgtgagttttgtccaatgtaatattcaaccgttttgggagggggggattctgtactttacagataattgaaagatccgccatgatcgtttaagcattgcgttcttggtgttctataaactcccatgtagaatctgtttttttcccataggttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggagtaaatagaatcttatttgacattgacctcataaaataatattaatttatttgacatttattgttatcgtatgctcattaagtgttttgtgtattttttactcacccaaaagatttctgttcttttgagagtaatgtactccccagagcttttggattcctagccagcggtgcacgtgcgggagcagcgaagagggtgttcagtgcccttgtaaaagcagacaaggctcctcgcagccctggtcctgggggctccaggttccccagccctggctgcccaaaagggcctaaggggagttcctgcctctgtactaaattcgtattttgttctttttttttttttgagacggagtctcgctctgtcgcccaggctagagtgcagccgtgcgagctcggctgactgcaaactccgcctcccgggttcacgccattctcctccctcagcctcccgagtagctggaactgcaggcgcccaccaccacgcccggataattttttgaatttttttttagtagagacggggtttcaccgtgttagccaggatggtgtcgatctcctgacctcgtgatccttctgcctcggcctcccaaagtgctgggattacaggcgtgagccactgtgcccagccttgtattttgttcttaatcaaaaactacaactattacatgataaaactttgccccgtgattgaaaattggcacattaaaaagtaacactgataaaacaagtcttaacacatttgagaagactgaaatcaagcatcttttctgatctcagtggtacaaaactgaaagtcaataacaggaagaaaactagaaaactcacaaatatgtgtaaactaaacaacctgctcctcaacaaccaggcagtaggtcaaagaagaaacctaaagggaaatcaaaaaatataatgagacaaattaaaatggaaacacaacatattaaaaccaaacttatggggtacagtagaagcagctctaaaagggaagcctatggcaataaatgcctacattgagaaaaaagacatatctgaaataaacaacctaactttatacttgaaggaatgagaaaaagaacaaactaagcccaaacttagtagaaggaaggaaataacaaagctcagagccgaaataaatgaagagactagaaaaaaaaagaaagatcaatgaaaccaggagttggtttcttgtttttattcatgtgtaatggaaaaaaattatatatgttaaaaaagaacgatgctgtttaacaaagaatgtttattaatatatgtatacatgtacatacgtgaatgtgtgtagatagaattattttaactctaagcattgatcttttagtaattggagtgggtttttattcttagtgatgatgaatgtcttgaacaaaaaccagctcagcccggtaggaaatggcgcaaactcggacttcctcctgtttccccgcgtgactgtgtcaaagatgccgtggcagcagaagtgtttgatcacgtctggacaaatatggtagaacttttggaagagctgattagaaaacactgggaaactacactcacaggtacttacatgcagaatttagcttaatgaaaagaaaaagtccctgttcttcggccctgggctcctgctccccagcttggccagacctagaacgtgaccagtgagaagacaagtgggtgttctgactttactcatgagtgctctttagtcccttcaaaaaggacgctattgttttttgtgttataaaaaataatgcagggctggctgggtgcggtggctcacgcctgtaatcccagcactttgggaggccgaggcaggtagatcacctgaggtcaggagttcaagaccagcctggccaacatgatgaaagcctacctctactaaaaatacaaaaattagccgggcgtggtggtatgtgcctgtaatcccagctactcgggaggctgaggcaggagaattgcttgaacccaggaggtggagattgagattgcagtgagcagagatcacaccactgcactccagcctaggcaacaagagtaaaactccatctcaaaaaaaaagaatgcagggcaggcatggtgactcagaactttgggagaccaaggcaggagaattacttgaacccagaggttcaaggccagctcagcttgggcaacatagtaacaccctgtcttttcaaaaaatacaaataaaaagttagccaggcatggtggcacatgcctgtaggcccagctactcaggaggctgagatgggaggaccccttgagctcaggaattcagtattgaaagtgagcactccatcctgggcaacaaagcgagaccatctctcccccaaaaatagcagtgcatatgcagtctggaaaacacacagatacacaagaacaaggctagaagtcatgttttttgttatagtaaaaataatttacctaactactctctaataatgagatatttgtttttcattgttcgtgacattatctgtaatgtaaaatgtaaacattgctaattgaatcatgctttaatcctcttacatacaaaatattctctaaacttaacattgaacaaaaacaaatcataaaaatgtcagtgatggacattaatgaccagttttattaatcaatttgtacaataaggcaataatcacgttaacctaaatcctgttctttttccagtatttaaggaattagttgggctttatcatgtgctgagaatctgtattgcccactgtgtgatctgcttctccaagccctgcaaccacagttccagcagccagttgctccacaggggtctctgccctccgtggtaacatgtggagtggccgtagcatgggctcgtggtagctcaagcacacatattctctttcaagagtgaattttaagtatttgtattagataatctgatgtttcttgtaatattgattcttctgttgacacagaagggaaaaaacagagagaaacattgaaagtggctggaaacagatttccgcacgtcctcgttccacacgctcacgccgatggagccagtggccccccgtccggacacgccgaggctcacggcatctccctggcttctcgtctgaacccgccccaggtcggtgctttcacacccttctccctcttgccttcactctgtgtgtctgtcacctcagtttgtcgttctgttaaactgcagtactgagatatttggggctgctttccacgctgcccgcagaggggtccatgcaggctttccatggtaacttaaagggaaaccttcacagtgtcacaatgcctggagacctggacgtcctgcctatgaaggacgaggatgtgctcaagttccttgcggtaggagcccacgcaggcggcaccacccttggcttccagatggagcagtatatccacaaaaggacggaccagcgatggcatctctgtcataaatctgaagggacctgggagaagctgctgctggcagctcgtgccattgttgctgttgaaccctgctgaggtccctgtcttgctccaggaacactggccggcaggctgtgctgaagctcactgctgccaccagagccactccagctgctggccgcttctctcctggaaccttcactcgccagacccaggcagccttccgggagccatgtctgctggtcccaggcgaccaccagcctctcagagaggcgtcttggctagcccacctcccattgctctgtggaacacagattctcctctgtgctgtgtggaagtcgccatcccgtgcaacaagggagctcactcagtgggcctgaaggggtggctgctggctcagggagttctgggcatgcgtgacaccatcccccaggaacacccatgggagtccacgcctgacctctgcttctgcagagaccctgaagagattgaggtggaagagcagcctgctgctgatgcagctgtggccaagggggagtttcaggggaacagattgctccagtgcctgctgagcattgccgcccagcccgaggctgcagacccagcccctgcacacactgccgcccaggttgagggtggagacccagcccctgcacgcactgctgctcagcctgaggctgcagactgctctgaaggtgcaggtaccccctgtgcctattcagccgtccctactgcagactggagcactcagcctgccaggcaagcctgttctgcagctcccaatgctcaggcccctgaatgaggaggatcaaccactgagcggtctcaagctgttcttccacaggccaccagcaagatggaaataaggccgatggaaaataaacatcagtttctatttaaaacaatgatattcgggtctgtttgcaatgtgattatttcatgaagtttaacagaattaccacatggcactgctctgagatgtgaagctgttttctacattttgggagattaaaaaaatgctttcccctaatatttcgagctagtttgaaaattataaatgttctcctttctttccaccaaagtgataaaagaaccaatgagtatacattgggcttactcagcatttattggttgtagttgaggcgttttgaggagatacagaggtgaatcctagtgatacaaaagccgtgacacagggtcaggtgcaatacattctgtgagggtcgcgcaaaaaaaaacaaaaacaaaaaaaaccttgtagaagaatcaaagagagagtgatttgttctgattacaggagggggattggtcttttacattgaaggtaaaatttgagcaggaatgagcaaggctcttgtgggagagaactctgggtgggccatttcaggccaagcaaaggcgtggatgagtaaaagatggggcctgtttggggactgtgactgggctgagtttaggggataagaaactggcaactgcagcatagtggcaagaacaggggattaggaatcgagaggcctgagaggagtattcttctggatatgttgtttagcttttctgaactttagtgtccttagcttataatgagattattatcttgtccaagggattattgtgaggataaaatcatagaaatacccaagagctcctactacagggtccagcacatactgagcgcgtaataaatttttcttgaattgcatttttattgagagatgtggtcgcaggtgaggctggaaaggatacacttgttcacgcgaggcctgtagtggtgccaaggaggttgtttccactgcccaccttgtggggggagcagagaacacgggtaaggcaggagtcctagtcctgagctacacagaatttatagtatagttggagggagcccagccatgtcaaacaacacacacacacacacaccacacacagacacacaccacaccactcatacacacaccaaacacaccacacacacacactgcacacatccccccacacaccccccacacaaacacacaccccacacaaacacaccacataccatacaccacgcacacaccacacaccaaacacataccacatacacactacacacaccacgcacacacaccacacaccaaacacataccacatacacacactacacgcacacacaccacacaccaaacacataccacatacacacactacacacacaccactcaccacacacaccactcaccacacacaccactcacacacacactgcacacacccgacacaaacacaccacacaccaaacacacaccccacacaaacacaccacacaccaaacacacaccacacacaaacacaccacacacacagaaaatacataccacatacacacacaccactcacacacacactgcacacaccccccacataaacacaccacacaccaaacatatatcccacacaaacacaccacacaccatacaccacacacacaccacacactatacaaacacataccaaatacacacatacacacacactacacaccacacgcacaccccacacatgcacacataccacacacaccacatatcatacacacaccacacacatacaccacatgcatacacaacccacaacacaccacacatgtacacaccccacacctacacaccccacacatacacacacaccttcacacataccacacacactaccacacaccacacacacacctcaccacaccccacacacaccacaccacaccacacacacaccacatcacaccacaccacacacacacacacacacacatctccccacatgggagacagtctagctgatagcagagtgaaacttgcgtatatagactactagttctgggcttgatgtctgcatttaatactccgtgattgtaaatcagtccctgtttctcaaaacctcaatttcctgatttatgaggtaggaagctgtgagaattaaaggagataaaacattttgtgtagtgtctggtgtagagtggacgttcaataagtgttaccttttgttataatcagatgctaattatatattaatagtctatataatcctttgtaattagatttttgtgtaattttttaattagatgtaatgttttgtaattatatatattttataatgagatgtgttttggatcataagtcctctgggagtcagaagaaaaatatacttttcacagagtagggtaagatatgaaccaagccctaaatgacaggtgtgattcgttaacatgagaaaggaagggaggctcttcaaagcaaaagcaaaactgcacctggcgtgggagcttctaaacccgcgatctttgtgagactgaagggacacaggcctgaacagaacctgtgcttcggggagcagtggggagaacagagcgtctcagaggcttgtttcactctctagtgtaagtcttctgtgccttttctgttctaaagaaacttttggaattgctacctgcttattgtatttttttggtctctttaaactgctctgacaagttcaatacaacatttcccacttaaaaaaaataggcagtatgaatatcacacaaagagcagtggatgagcctttaaatatcaggcaaaataaacagaccagaaaaatatggacattctagaagctgaggcattttttaaatagctgttttgtttttataattactttgtttggataaatgttaaaaaaaaataagtggacagcaaagttaacagaataaaaatagagcctgctttgaaatactcaaggtgttctagttctaattatgaaagctcttaagttattcctctacatatgattgtggttgccacatgtgctcatgaactagaacagaattccagtcccagaaatcctgttctcctacatctaaatatggttatttgaaaaaatttttaatttactttaagttctgggatacatgtgcagaatgtgcaggtttgttacacaggtatacatgtgccatggtggtttgctgcacctgtcagcctgtcatctaggtaaatattattttaaatcctagttggtcatattgtgggactgaagagggagttaagaattacttagcccttagctcacgctttctgtcatctcatttaattctctcaatagctctgtgaagtaggtatgatttttccccaacataaagatggggccattaaagctccaagaacaaagtaagctttccagaattacaaatcaggaagcagttagagctggggttcagactgatgctttcgagggtccaggccatctcaccgcttctgggaagagaacccaggcaagtgtggagaggaggagaggagaggtcccaggcaagcaggacaatgaggagccatgatgcccggcctgtgcttctcccagttctctctctgccttcctcaccctggagttaccagaggctgatacacgttgaccacaccagtgctcccttgccctccaacctccgggatctcagagcatggggggagactgaagcacggctctgcttccctgcagcctccctgccaggtcaccctgggctggtggcgttcctaccccgtgcagctaccctctccgggtgcaggaacctctctctcacttctggccactttgggccaggtgtgctcaatgtccccactgttaggagccttggggaattaaccaattcgttgttaatgtctcagcccacatctttataaaatatatcccctttattagtttttcctccagttagctggtgagtgtgccgggtgtttcctgctgatttcggacaagcatcagtcattggaacggcactgggcatttgtaattctttttttttttttttttttttttactgttctcagattcatcacttctccagcagtttttatagtgacatgaatggtgtcatgacaattcaagcaaaaccgcttcagcggagacctgcctattttgctgacagaacgcagtacgtatcagaatcagtagtagttacccagcctcttccctgtgctgcaaacactggagcactgaagactgcaggggacatgagatcacgaaggtcccatttaatcccgtgcttcagatgtgcctgagcacgtctggaagagcagaaacagaccctttagtaccaaccacaaaacagttactatcgtgtatttggtagggagagatggggaaaggggaatgtagtcctgaaattcttaatcttgtgggcttgactgtttgattactgacagggaaaaccttagccctctgcctgtggatgattcttcattgaaacagaaacagaaatgatgggtcttttcattcattcaacccgtgcttaggagtatgttctaggtgccagactgttctaggcagtgctcaactaagcacagacaggtgcgttccctgttatcacagcactcgcagctgagtagctcacaggatttccttcccaggaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgtgagtctcatttctttcatagtaaactaaaggccacggaggacctagatgcttctcagttagggtttatggatcatcctggacaaagcatccctacctagttttacatagatgcttttctaatgagttcattgagcatttaacattccgcttgctccagtggtctacttagctgtatcctaggacacaaggtcaggcaatgtccctgtcacacaggcggaatgagcctctgatgctgggggaccttgggtggatttcagtggcctcatctgtgaaacaaataattagctaatgcctttcaattacataattaatacttttcaaggggaggtttaaataaaataatgtatataaaatgctataaaaataaaaggactgtgtccctatcggattatctttaaggatgcatttttctctatgtgggagtttcagcaaagctgttgattgcaggattcacatcccgtcatggcctcgttagaaaggtgcctgtctcttgccctccagctaacttaccagtatcggccaatacttacattgataataatagctaatgtttattgatcactttctttgttatcagcgccaggtaaatgaattacatttatgatcttatttattccccaccacaaaactttatattgttgggactcatactatcccaaatctgagatgagggaacaggctaagcctgccggagatcatccccgccaggaagaggcccagccggacacacccacaagtgctctcaggctttagagaccacccactggacccccggcctgcaggggagctgttatcaggagccgagctcaggagcgggcggctgccaacgcttacctggcacccagactttttccagatgcagtcataacccccctttcagctttttaattggtgactgtttctttcacagtttgggactgatgtttccagctgtgttgggtctgctgtgctgattccttcgagatccctctccctcctccgcctcgcttccccccatgccagtcagcagcacacggtgccagtcagcaacacatggcaggctttctcctcctgccccagcctacctgggccccctgtcacaccttcatcaaatagaaacccatttatgtttcctactgagatacattcagatgccactaactgtacaaatccctctgtgttctgacccctccctccctgtgggctgctgatttttcagctttctttttattattgccaccctgaggagcccttttcgaccattcttcccaattgctctccctacacatggaattgtagtcccacagacagcctgtttgtctgtgtgcatagctgtgctctacacatacgagggaagctgtggcttcagaggggccagtgcccaccccctttggtgatgctacctcacctgtgtcccccggcttctcacccgcctggattctcacctgccagcctcactttccctctgacccccccacacaccagctctgcgtcttctcacctccatcctctgtctttcacttgtattgagataacattttcccatagttatcagagtgctataagttccctggggagcatccggataataccacacatagcagaaatcaaagacctcctgtgtgcccctcacgcagaaacattgaaatcacagctcttggcagatttcctgtcacttgccagttatccatgtacctgggtgctcagtgacatgatgatgtgttgcaggccgactggcgtggaccacatggcttccccactggttcaaacgtcacggagcaggttccccccgctagtcacggagaccagggggcagaatacagcagttcctggatgccgccttgtttctgtaagacagatttcattctatttcagtggaccatttaggttctgtattggaaaacaaacaaaaacaaccttggcacttccaagtgaaattagtaacatgagatctgagtagctgtattcaaatgccttcataatctgtttccagaaagtaaatgaatggcttatgagaatttacagggagtgagaggcttaattcaccgttttgtgaaataaaagcatgtcttgaactaaatcagaaattccaggtgtcaaggaaatctctgataggatagtggagcaaagaagagagcatgaaatttggtcaggagacaggcaggtccgcgtggatcctgccacagaaactctcttctatgacttggtgcaagtcactttaatctccctgagccttagtgttctctgtaaaaggggattaatgattcttacctctaaagaattgttagaaggacaaaatgaactcataggtgttaaatgattcctgacgtgaaattatgagctcagtaaattaggaccctggtcatttctatcggtcatttttacagctaacctttgctatgtctattgcagtggagggcaataccttctgcagtcagactcgcctcggccaggcagtcaggtctgcggggggtgtgctgtggccagcatgcatatccaggcagcccccaggtttacagccacccctcactccacttcacacaagtaacttgtctctattcattttatacaacacagaaggacccctgttgtaggaacataaagacatagtgagagaaaaaccctacctggggccaggttccctcctgcatgccctgtgccaccttgagcccagcactggaacccattcccagaaggcaagagttgcaaagtgttcatgtttaaccttagaataacatcattttacaaaaggcagcggagtgcagtggctcacgcctgtaatcccagcactttgggaggctgaggtgggtggatcacgagggcaagagttcgagaccagcctggccaacatagtgaaacctcatctctactaaaaatacaaaaaaattacctggatgtggtggcacgtgcctgtaatcctcactactcgggagactgaggcaggagaatcgcttgaaccctggaggccaaggttgcagtgagccgcgatcacgccattgcactccagcctgggtgacagagcgagactctgtttaaaaaaaaaaaaaaaaaaaaaaaggcaaacatcacattaaaaagtctgctacttcacaaatgcagaattacattttcttaaggttttttttatctctctttccctattatgacactataattttatcaggcttaatagtgcagttacataatcaaaatatatttcttcaggtatttatccttaggagacctgatccttagtaatgtctaactaaaagtttccaaatagatgagtgaacgattgagcatgtcgagattttcttttgtgtttttaaggattgcatttattttaaacaagaacatactatccttcatttagtacagaggaaggcatctacaaaaccgtgtgttgagtgccatgcctgacggtacagaacgatcgcgtcttcgagaaagaacagccaccctggaacggttgtcaaggcccagcacaacccacacgttccgggtgggttctctgtttcctgtaactttaattttgaaaaacatttgaaaaaaatgaaacttgtccctgattttatttttcttccagcagtcggatacgcctcgaaaaagttcattgacacaaatggaatttgctgctcacacatggacaggtcaaagtattttgacaggtcagcttttctccatatgtaaataaagtgatgtagtaagtgagatttcaagtttcagacagtgaaatggaagatgatctaccttgataagcctattttgctgtaggagggaatagcaaatgtttggggcctgtggcctgacctcagaaacctcgatcacagagcacacctgcagagacttacttacctgctgtgaggtcaagaagaggggaatgtccaaaagctctcaatgaactgggggcctcactcaaaaaaaaaaaaaaaaaaaaatgctgtcttaggagcagtgagtacctctgtctgctatagcgttttcatgctctatttctaagtgaaactctactctcagattctctttgaaaatctgatgataaaaatgcttgagaaaattaacacagatttgctaattactttataacacaaggttttacagataaataggtattctcagcctggtatgctgtttgcaggatattctagtttgaatacgggccagtgatgtttccagttccagaacagtctccaacactgttttcaaggcgttagtgtggcctctggagtctgacgttggatttccaccctcgctctgccaccggctgtgcaaccctaggaatgtcccaacctctctggccctcagcttcctcttttataacaagcagggtacataaaatcattattggaaaactgtgaaaaggatctagctagataccaggcatgtattgctcagaaatgatgaattatgaaccatttgtattataaataacctgaaatttcagggataatttattgttttacagggaattttaaacatataattctaaaaataaatttcgtaacatgtaagcattgcgtagcacagatctgtcgctgtccacatcagccctcctgtcgtcctgtagcatagtgatgtagcatagtgatgtcgagattcttcagctctgtaaagttctgctcctgcgctagtcgctctgggctgctgggcctttttgttgcttttcttgtatgttccttagcagcattagcggtcattcacatgtcaacagctcgttctctaaaaagcagccatgctacatggtcaggtgttgcttttatttatttatttatttattttgagatgaagtctcactgcgacgcccaggctggagtgcagtggtgcaatctcagctcaccgcaacctccacctcccaggttcaagcgattctgctgccacagccccccaagtagctgggattacaggcacatgccacgatgcctggctaatgtttgtatttttagtggagatgaggtttcaccatattggccaggctggtctcaagctcctgacctcaggtaatccacccatcttggcctcccaaagtgctgggattacaggcatgagccactgcgcccagcccaggtgttgcttgtaacacgattgtaggtgcttggggggaagtaggcgcccaagttagcttatcaatcatggatgggtgtatcaagtgctcactctgtgccaaggtctatgccaaaggctgggattcaaacagcaggggtgtttccgtctgtgcctcaaggagcattgagcctggcaggcaagctggaaaaggctgtgagaggggtgagcagcaccacctggatcccctgtcagatggctggagggtgccgaggcttcctagaggagatgaccatcacaagggatgtgagagagagggagtgagggctgacagatgactctctggatggccagcggcgggtggtgctgagcgagggaactggggaaattctgacgagttcacttttggggatgctgactacagcacgccgagtggaggtatctgggaagtagttggagcacacgtaagtagaggtttggagtgggaattgggttctgaatttgttctaaatctcactgttaatcattgaccaaatgccaagtcagtgtattctcttatcagtaactttttttcctttaaaatatgctagtcattgtttctacaattataaaaaataatacattatcgaaacagacaacttacaaaacacaaaaatccaccaaggacaacacagccaaggcccctgatctcacgacgtagagagaacgcggctcaaaggcgtgacctgtgatgttggtgcaatgaggcgcgtgccccatgcagacgtccccaggccccaggtgaggcacatgtggcctcacacacggatttgagcttgggagcgggaggcctaagtcttatccctcaaaagtcttgtccctcaaaaatggaaagctctttctttcctcctgagcactctgtcaacgtcagcccaccacgctgctcacacagggagtcgcctctctggccaccagctcaggcagcacaccacgatctaataggacattcaggaatgaattaaaaaccagagtggattcatggtgacaccttcggcatatcactcactgctttctggaagaggaggtgggggtagagctggtatcgggggactgcagtgacccccactgggggcgtccagaggagttacattaacacgtgcaatcacatatggccacttaactcatgtaggacccagggaacggtccatgccagtcatctgcgcctcactgcctcttaactactgacccaagacaaaagagctattagaagagagaatgcagccaaccaaatgcacagctccaagaggttttgcatctgtaacaacaagctaacatttagttctttggttcaaaatatttcccctccttaaccatttttttaatgcttcaaagttcatccccatttggggagtgggaagggtatgtccaggccccctcaggatcaggctggcttttcttcctttccaccaggtgcacaggcaaaactggccacaggggactccctggagctccatgcagctcggcagggcctgtgcagtccggaagggagggcagagatgcccagggctgtaggtgccggcctgtgcaatccggaggaggccatgcctggtggtcgtgagagacacgggccttggcacggaagtcctagctctgctgctgggtgctgtgacaccaggcattccctgtgggtctcagcttccatacctgtaaaatgggaataacacctcacttaaggactcctgaaataaaacacggagcagataacgcagtgcctggtgcataacaagcctcaacatatccaaggactcatcctgatcacccatgagcctacttaaggtcaaccctgcctcatttaaaaaacaaaacaagactgtgccttcaagttcaggtaggggtggccctgtccggggccaacccccgcctagaaccagccaggcttgtgctgctggagaggaatggccaagccaaggcactcgggaccagcactgagcagcctggtgagctctaagcccgcagagcaggcagggcccccgacaggcaggtggtgtgcaggggtccctggggcaccaagggacaggaaacctcaggagaaggaggccctttcacccgccaaagtggaaccttccccactgaacaccggatctcccagcactgtctgaccttcagtcacattttaaacactgaacagagggacagagggacctgtgttccttgatgtttcatctttgttcatccatcggtcgtcctccaaaccaaagtccagaagcttctgcactaatttcgaagtcaggctgaaccttgagtcatgaacaaaactctttcaattttcctctaagtcttcatggagctcatcataagcaggatcctcataaaggaatttctgaatcattccaatcagtgattctaagaaccacatctttctgcggtccttctgagtggcccagctgtgcaagagacatccccatgcaaaagcaaagccttgatagcacctgatctcaggccggatgttggctccgtgcaccctgcggtgctgccttccttcagtgacgcccacgctcctgccttcctcccagccttcctgatgcccttccccatgtaaccccgcatccgccttcatgatggcatccaacacggcccggctcccagggtcaggcccagacgcaccgcttcagaggatgagctcttatcaggaactctgagacagctactattgatggtcagaggtcttttctatatctgcagaagtgatcgagggtccataagagggatcttcctgtctttctgagggtttgttttctttttctctgacaagcaggcacatgacctccttgctacctttgcgtccaggtcaaaaagcactgggaactactaacttatcaacttttattatttctgtgatagaaaaaaaaaggagccaaaggggtattccaggtagtgggaaggatcccttaaagtacctggcattgcacctgcccctgggaagcaggagagctgccaggaagtagtgctccctcagcctcctgggccaggacccgcctctgcatggaagcttctcgtgaatccaccagctcgggaggacgcgtggcctgcacctccgcttgattttgggggagcacacttccttttccttaggaccctaataggcagtttttgcatatgactatttcctaatttatacaaaagtgtattaaaataaaatatatattttaaagtatttgcatggagtgtacaaaacaatcgttctgagtgggtgcctttgtaacattttaatgagaattaccttttgcttggtgtttccaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttgaacactttgcactgtaaagagagtgaaagtcaaacccaccaagctgccttgctgaaagcatctccaaggttctgtaggctttgttcagaagcccctgatgtgtgtttgcagtccgtcattttatcaatgatacgcaaacataattagcatgtgtatgtactcacacactaattacatgtaagaatatattatctaggaatatgtcatttgtaactttgtactctgacgtattttctagtctcaccctattagtaattctgtcaaaatcctagacgctagtagatattagtatttgagacaatatgtcagagtctgaataagactcagcttgttctagtcatgctgagtttctcatatattttttaaaagtgcttccgccatgaacctctttgagaaatgtcagtggcaaaatctcccaagctaattttctttttctatgttccatcttcaaattcagacagttcacgtgaagtaccccacatttattgatcttagggttgaatataaacgcaattaaaagctatggcaggtgatgtcatctttattgtttacagtcgaagctcctccatgggaggggagcctcccaccctccacgtgccatcaggagctggcctttgcccagacgccaccactgcaatgacaccttcccagagccctcgtctcctcgcgctctgtcctgctctgcctggcttttcttcagagtgtgtttccccatctgacattactgtagaaaatggagcagagaacaggaaggggaattagcagagatgaggctccaggcatgtcttcctcttgtccctctccccactgtttctcttgattgtgattcaagtccttacactcatttttacattctcaaatctcaaatcagctaatttcctcttttctatcagataattgcatttcatcagtctaatttttactaatccaaactgtaactttataaggctatatatatgagcatatttataaacttagatttataaactatatacacacatatatgtatcatataaatgcataataaattactttcagactatttctggctgtaaggagaagggatcattgcctactagtagatgtctgaaattttaaaagatgtgttgagactaacattaatgttgtcctttatcacagggtgacaaaaatgacccagagccttgcctctgtttgaaaatttctccttgactttgctgactccatttcttttttcttttctttttttttgaaacggagtctggctctgtggccccggctggagtgcagtggcacgatctcggctcactacaacctccacctcctgggctcaagcgattctcctgcttcagcctcctgggtagctaggattacaggtgcatgccaccacacccagctaaattttttttgtatttttagtagaggcagggtttcaccatgttagccaggccggtgttgaactcctgacctcaggtgatctgcccacctcggcctcccaaagtgctgggattataggcgtgagcttccgcgcctggccagctgactccatttctatagcaatgagacacattaggcagcagcagcagcagcagcagcagcgaccaccaggtccatgcctcttttccgtggtcacagctccatgtgtccggggaagattgctaatgcttagtttcctgcacaaagcaaaccaaagcatttttgagaattttctacattattcctaaacattagcaatagaaacttttaagagcaaatgccagtcttaattcagcagctctcccacttgaggaatagttagatatgtgagtagcctggagcccatgttatagggctgctggttaggtgctctctggtgcatcattactgctcaaagcatgacccacttgctctttcagatccactcagggtattttatgtccatttccaggaaccatccaactccttccctattcagtccaaacttcctttttttttttttttacttgaagttcaggggtacatgtgcaggttgttacataggtaaacttgtgtcgtgggagtttgttgtacagattatcacccaggtattaagcctagtatccattagttatttttcctgatcctctccctccttccaccctccaccctttgataggccctagtgtgtgctgttcccctctgtgtccatgtgttctcatcatttagctcccacttagaagtgagaacggatggcatttgtttttctgtttctgcattagtttgctaaggataatgacttccagctccagccatgcctctgcaaaggacataatctcattcttttttatgagctcaagcttcgtagtagggaaaacaccggatattcagtctaaactaacattaaggtagggtatccaagataaaatgttttttctttgaaaaccactgaatatactttatggtagctttaccttgtttggctccagaggtttgcaaataagaatctattatttatatatatatattggtaaaagacaaaatattttttaaaaagtgatcttgagtcttctaaacattaaattggaagataaagtgccattttagagattacatagagacttggccctgtcattgattttaaaaatgaccttctcattgcactgatttttactccatgttaaagttagtattttatttatacattaaattagatttagagattagtaaataatgcttatatcaaggatggtgctttttaagctaattaggtaaaaattagggcagtgttttataatctactttaataaatgagtcttaccttagaattaatctattaaaaattaaaaaagaaaaattgaactacttctgagatagatttttaaattcagattagtgaattttacactaattgaattacattaattaaaatgcctgttagtttatccaaaaccaaagaaagaatgaagaaattttaaaacaatctaagaaaatgtaaaataccatagaaaactgctagattttgtgaatttaatataaaaggaagtatccatattgatattattctgaactagatggaatttctacaccaattcagaagtacgtttttatatatcatttggatattatattttttattgttttattataactacagatcattgtgtaggatttttgattccttaatttctaataaaatataaaagtgttaaaagagttttcaaaaatgtgtaacatttataaaagtatttttagattcccaatttttgtatcatttgtgcaaatatctctctattctgcagtttctaatacataggtatttattatttctaactacatagtaaactttccccagtaaattctaagtatatgtccatatatatttgcaaaggctttacataatttatgaatactccgttgtaatgtttgtttcagaagattatgctcctgtgtggtaatcatcatggatttgatttcatcaaacatttattaagcactttcttggtgtaagattttgttctaagcattatagtgaacaagacagtctttggcctaaaagaacttagattgtagtggaggcgacagactataaacaattaaataaaaacatgatacaggtcagttagcaataagtgctatgaagaaacaaagcgaggcaaggtgacggagtggaaggagctgcaactttccatcgagcggctggggaaggctgtgttgcagaggtgatatttgagcaaaccccaaagaagatgagaaaagaagcctgggagatatctggggagaaagaactgtagacagagcagaaagcatgtgcctaaacaagagtccacctggaatgtctgaagaacagcagagaggccagttcatgggatgcgcttggcaagggagtgaataatgggagctcagtgagctaacaggagctgagggactgaggtcccttttggactatgggaaatatgaaataagaagccactggagcagttgagttttggggatagaatgatataatcgacaagagatgatcctgtttcagtcagatgatagtggtaaggctgatgagaatcccaggactttgcatgtgttttgaaatttgagccaaaagatgtgctgttggatgagaggtggagtgtgtctaccaaaagaatcgagaatgcctccaggcttttggcttcacacttggaaggatggtgttgacactcactgaaattggaaagactgcaaggggaacacgtttggcagcatgaggggcaagttatgtgtgagatgccaattagatgcctaagtggagatattgagatatttggatatccacacttgggtgtggaggtgaggtatagactggatgtataaatttggggattgtcagcacgtagatggtatttaagaactgaaatggatgaggcaaccaagaaaatgagtgtagagaaatggaggaaaaagaagtactgagccttgtgccttttaacatctaaaggcctgggatgtgaaggaaaaccagcaaagcagactgagaaagaatggctggtgaagggaaataagagtcaggagaatgtggcgtcctcaaagtatgtgtgtgtttgtgcgggggaagtgtttcaaggaagtgatagggactcaagtatgttgaatgctgttgatgagtcaattacgatgaggtctgagaatcagactaaaggtctagccacatggaagttactggtggccttgacaagatctgctaggtgaatggacaaggcgaaagtaggcttgcagtgggtttgggagaaaagaagaagagagaaatccaagacagtagtcatgggcaagtcttccagggaatttttctgtacaggggagtagagtatgtgtgtgtgtgtgtgtgtgtgtgtgtgtgtgtgcatgcacgtgtgtttcctagtaaggttcatcttgatgaatgtcattattcagtataaaaatgttgatccaaaaaggaagatagctctagtgttctctggaggacatgcagagtgtattcccactggaaaattaaagaaaaagctgacagagctgagtgaatagtaagttataactcagaagcaacattcagagaaggctacaccttgtgaaggatgtcttcagagttcacaaaaagaacattgtgggggtgaaagttttagcttagaaggcaaaagatttcaaaaatatacagaatcaaaatgatgttaaaaataaacatggaggcattccactactgtttatgaaagaatagttcatgagcaaactgacctactgagaacaactataaaagctataaatggacaagaaacagctctttggaggcacgcgtggacacccacatccacacccacccagccccccaagacaaagcagcacaacttcaggaaacaaattgggagacaacaggaataatacattgagatgaaccccatatttgctactgttttctttccctgtatcaatatattttagattagtaatggggcatagaggccaagaaaaagggataccctcaaaatttgtgacaagctcactaggctgccaaaaggaatgatgttgggaaatgtctcagactttgaattgataatcttgaaggactacactctaggagtaagggcaagcttaatacagacaagtcctcaaaacactagaagcagaacctagaatcaatgaaacctctgtttagatccaggttatatgcctgtactttatatgaccaccagaaaaagtatcctctttaaagaaatatagcatcacctagaatttctattatttttatatacaatgtacagcattcaatctaaaattaagagacagcccaggatatagggccaagtgactgaaagccaagagagaaaacaaaattataatggacccacacgtgattaaaatagtagcactatcaggtacaagctaagaaacaatttgatttgcacattcaaaaatatattgaaaaacaatttcaagagagaactgtaatctgaaaaataatcaaactgatatcctagaaatgaataatacaatgactcaataattcactagctgtgttgaactgcagattacacatagcagacaagaggcttagtaaactggaaggcaggtcaatacacagtattcactttgaacaagcataaaaaatagatattccttaaaaattgtgaggccatgtgaaaaaatctcatatccgtgtaatgatagtcatagaggagaaagagaatagaacaatgcagtattgaacagataccatgaaagaatcttccaaaaatagatagaagacatcgatgcagtcatttaagaagctataagaaacacaagatagaaagcaaaacatactcaggtccatcacaaactgctagaaaccccaaatcaaaaagaaccaaacagcagtcagagggaggggggaaagactcattatcttcaaagaagcaacaataagactaatatttgacttttcaacacaagtgatggaagctgaaagacaatataaaaagcatctttaaagtgctgaaaaaaataattgccaacccagaattttatacgtagtaaacatatacctcaaaaatgagggcaaaagagcagtattttcagataaaccaaaattgggaatttatcaccggcaaatctgtactaaaggaaatacaaacgagagctcttcacagagtaggaaaattatcccagaaggaagtacaatgataaaagaagaagtaataaagatcagaatgtatacatacgtgggaaaatagaaaagaatacttactgtataaaataatgagtaatacagaattcagtatatatttgggattaaaatattatagaaatagcttaaaattgggaagggtttatttgctgttaaagtgttatagattcatcattgtccaggattactgttctaaggtagagttttataaagcagtgcgtgtgatatagcgagatgaaggcacaaaatactatcaggaatgaaaataggcataccactgctgattctatagatgtgaaaaaagataagcattatactatgaataacttgatttggtaatttagatgaaaattaaaactttgaaaaaatcacatcactcaagaagaaatagaaaatttgaaaagggttatgtctattataagacttaaatgtattattaaaagccttctcacaaagacaactccaagtcctgctgacttcattggttaatccttccaaatatttaaggaaaaactaataccactagtagcaatatcaaaaagctcttcaggcctgggcatagtggctcatgcctataatcccagcactttgggaggctgaagcaggaggattgcttgagcccagaggctcgaggttacagtgagttatgatcacgccactgcactccagcctgggtaacagagtgagactttgtctctctaaaaaactaacaaaaaagttattcaagatgattgtcattttgtaaggctaccacaaccctgatacaaaacctaacaaggacattacaaaaaaaaaaagtaaattacaataaagtaactgagaattataaaaaaaaaaaaaaaagcgaattataggccaatatcatccctgaactcccaagcaaaatcaaatcagtaatatatgaaatagataatacgtaccatccaaattaaatttatttcagaaatgcaagtttgatgtaccatgtgaaaatcattcagtgcaacaaatgatgtaaggaaacaagcatgggatcttctcgaaagatgaagaaaatgtctttataaaaattcttagtcaaccaggaagataagaatatcactgttatctcttcatgagtatctaggggaaaaaaacaactgcaaactgcatacttagtggtaattttattctgattttacttactgaagaagctatacttcctgagatcagataatacgaagtgtcagctaccgccactgttattcatgatacagaatatattttccaccccagcagggcaagattaaattattaaagggtcttaagatttaggaagaaagaaacaatttggtttttcacagaaaacatgattgtgtacatagaaaatccaaaataattacaaacacacttaaaaatgtgatttaacaacatcattgaaaacagtcaatataaaaattacgtgcatttctatataacaacagataatacaatttataaaaatacaatataatagattcaaaaatcaaatacctaggaataaatttaataaaaatgagtatattagagttcttcagagcaacaaaattattaggagatattagattatgtaatataatgtatatctggagggagagagtttttcttttttttgatttgagtgtattttattttattttattttttattatactaagttctagggtacatgtgcacaatgtgcaggtttgttacatatgtatacatgtgccatgttggtgtgctgcacccattaattcgtcatttacattaggtatatctcctaatgctatccctcccctctccccacaccctatgacaggccctggtgtgtgatgttccccatcctgtgtccaagtgttcttattgttcaattcccacctatgagtgagaacatgtggtgtttgggtttctgtccttgcgacagtttgctcagaatgatggtttccagcttcatccatgtccctacaaaggacatgacctcatccttttttatggctacatagtattccatggtgtatatgtgccacattgtcttaatccagtctatcattgatggacatttgggttggttccaagtctttgctattgtgaatagtgccgcagtaaacatacgtgtgcatgtgtctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacatcctctccagcacctgttgtttcctgactttttaatgatcgccattctaactgctgtgagatggtatctcattgtggttttgatttgcatttctctgatggccagtgatgatgagcattttttcatgtgtctgttggctgcataaatgtcttcttttgagaagtgtctgttcatatccttcgcccacttgttgatggggttgtttgatttttttcttgtaaattagtttaagttctttgtagattctggatattagccctttgtcagatgggtagattgcaaaaattttctcccattttgtaggttgtctgttcactctgatggtagtttcttttgctgtgcagaagctctttagtttaattagatcccatttgtcaattttggcttttgttgccattgcttttggtgttttagacatgaagtccttgtccatgcctatgtcctgaatggtattgccaaggttttcttctagggtttttatggttttaggtctaacatttaagtctttaatccatcttgaattaattttttataaggtgtaaggaagggatccagttccagccttctgcatatgggctagccagttttcccagcaccatttattaaatagggaatcctttccccatttcttgtttttgtcaggtttgtcaaagatcagatggttgtagatgtgtggtattatttctgagggctctgttttgttccattggtctatatctttgttttggtaccagtaccatgctgttttggttactgtaggcttgtagtataggttgaagtcaggtagcgtgatgcctccagctttgttcttttggcttaggattgacttggcaatgcgggctcttttttggttccatatgaactttaaagtagttttttccaattctgtaaagaaagtcattggtagcttgatggggatggcattgaatctataaattaccttgggcagtatggccattttcacaatattggttcttcctatccatgagcatggaatgctcttccatttgtttgtgtcctcttttatttggttcagcagtggtttgtaattctctttgaagaggttattcacatcccttgtaagttggattcctaggtattttattctgtttgtagcaattg
